United States Patent 9,238,822 (COMPOSITIONS AND METHODS FOR CONTROL OF INSECT INFESTATIONS IN PLANTS) - sequence listing, part 4

SEQ ID NO: 9741 - DNA, 1010 bp, Diabrotica virgifera
  misc_feature (66)..(83): n is a, c, g, or t
  misc_feature (874)..(874): n is a, c, g, or t
  misc_feature (903)..(903): n is a, c, g, or t
  misc_feature (913)..(913): n is a, c, g, or t
gtattacacaaaaaattcaaatctgaagtacgtgaagaatttaataaaggtactaatcttcgtagnnnnnnnnnnnnnnnnnnatggagattcttaagtcttcaccagacagtggtatgcggaattgcagatatggctaatttattagataatagaaaaaaacaaaattggtcagttaaaatgagcaaaatatatgaaaacgaatcaggttgtttaatctcccatgagaaattcatcaatgatatttacacaaaccttttagatgtacctggaagaagctatcacataaatccaaacatttttaaaatagacactacctataaaacttctgggcagtcgaaatccaaaagatctaaaaatgtacaaccaagaaatgaatttgaagaccacagaaaggagcaagatgtagttaaattcaaatatgacaacttcctctcagcatgtaggaattatttcaataatagcagtgaggaactacaatctttaactaataatttggcactagaggctgcagatgttattcaaaacaatagtgagaacagtgtttcagatatgaatggagcaaatgatggtcctgctgttgtcaaagaaataaatggagataaatatgtgttcccggaaaaatgtgaattttattgcaaaaatgtttttgatatggataaacacttacacagtagaaaatttgacctaattttgttagatccaccctggtggaacaaatatattcgcagaaagaggaagaaatcatcagatggatacagcatgatgtacaacgaagatttaaaaaatctgcccataggtgacttattatcagatgatgggctcgttgcagtatggtgtacaaactcaaagcaaaatctcgatgccttattanacgaggtatttccaaagtggaatgtgcangtcactgcanaatggggtctggtaaaggtaacaacaagaggagaacctattttgtcggtttttttgatccctcccgggaaggcacctttatgaaaaggttgattttt

SEQ ID NO: 9742 - DNA, 131 bp, Diabrotica virgifera
  misc_feature (8)..(97): n is a, c, g, or t
gtggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttaggggaaaccagcgaatttttttttggaa

SEQ ID NO: 9743 - DNA, 102 bp, Diabrotica virgifera
  misc_feature (11)..(62): n is a, c, g, or t
  misc_feature (65)..(91): n is a, c, g, or t
  misc_feature (101)..(101): n is a, c, g, or t
gggtggatgannnnnnnnnnnnnnnnnnnnnnnnnnnnnnnnnnnnnnnnnnnnnnnnnnnngcnnnnnnnnnnnnnnnnnnnnnnnnnnnacctatagang

SEQ ID NO: 9744 - DNA, 1201 bp, Diabrotica virgifera
  misc_feature (6)..(22): n is a, c, g, or t
  misc_feature (1138)..(1158): n is a, c, g, or t
gacacnnnnnnnnnnnnnnnnngttaagaagattggtgatattgaagtgcctgttggaaaaggggtttccagcaatgccaagtccagtttgttgtataacgaatatatcgtttatgatgtggctcaagtcaacataaaatatttactgaagatgcactttgaatataggttctaagtggcttagtagttttacttttgttattcactgtttaactgttagttgtaagttctaaaagttaagtgtttgttttttataagaattgtaatttatacactttttagtactttgggcataacaattctgtattcagtgttctcttagtagtattttggtaaaatcagaaaagagtaggaacaatttttgtgggaggtcacctttatgtcaacggttgttgtaaaaagcttgtgacggttgttacaataattttatatttggcatgttcaatcactgatcaatttgtttcttttttcagatcactaaccgtttttgggatctttagtttaaagtttaactttgacaccctgtatttcggttattatcaacttttgtactaaggtaagttagcttaaatcgacctcaggaatctaagggtaagctatggcccgttctttaccaaacaccctgtactataaaaaattcaatttcttctgcattaaatatcacctgttagtagaacagtgaactttacgctttctccatgcttttccaatgcaaattatgctttataggcgcttttctaatgtttttaacgcttactcagtatttttccaatgccatgctaccttctcaatgcttttccaacgcttttggcgcttggtaaagcgtcgttatcaaaacccctgtaaagtacacgaaaaagggattcatgaatttcccaaaagtgtttcattattgtagacaaaaacgttaaaaaacttggaattttttcctaatttttttaattcctcgaaaaaaccgcaaagggcgggaaataaatgtcccaaaaaaattatccttcttcctcccaaaaaatatttatcctaaaccattttttgtttctaatttaacaaaaaaaccgccaggaattgttcaagaaatttttcttattttgattccccaaaatgtaaaaaatttcttgaaaaaattcacccccacatnnnnnnnnnnnnnnnnnnnnngccctcaaaaaattttgcaaacaaaatgtttttaaaaaaatta

SEQ ID NO: 9745 - DNA, 913 bp, Diabrotica virgifera
  misc_feature (110)..(150): n is a, c, g, or t
  misc_feature (635)..(653): n is a, c, g, or t
  misc_feature (757)..(757): n is a, c, g, or t
  misc_feature (857)..(857): n is a, c, g, or t
  misc_feature (865)..(865): n is a, c, g, or t
gtttgtaatcgaaatcgtttcgttttcgttttgtcgtttgtactttattttgcactttatttgtgataattgataataaagacaaattaatacaaaatggaaacaatttnnnnnnnnnnnnnnnnnnnnnnnnnnnnnnnnnnnnnnnnnattgatgccatggtaaaagaaatgcttcacaaaaagacaactttcagagaagcaataaactcagcaccgacaaaagtacctgctggatagatatatggcttcaacagaaagactaatagatctttatgatgatagagacggacagcgtaaggctgaagtagccgctcttacgggccccaacgagttccaagaattctacagtaggttaaaattaatcaaagacttttacagaaggcatccaaacgaaatcagtgttcctatgtcagtggaatttgatgagtttgccaaagccagggaaaatcctaacgaggatatggctaactttgtagaatttacagatgaggagggctacgggaagtatttggatttacatgaatgttacgaaaagtatataaacttaaaaggcatagaaaaggtagattacattacctatttgggtatgtttgaccaactatacgatattccgaaggagagaaaaagcggtnnnnnnnnnnnnnnnnnnntatgcctaattgaatatttgacttggtttgtgcagcgtataaagcctctaaaggacttagacattgatctacaagaacaagttgagcaggttctgctaaactgngataatggaagtgtaccgggatggccaaaagaaacagggtctgcactaaacaaatgtggagcccacttggacctctctgcatttttcagtgggaagattnggcatcgntaggtttagacagactgaaatctgccttaaatggcggtagattgaaat

SEQ ID NO: 9746 - DNA, 990 bp, Diabrotica virgifera
  misc_feature (683)..(683): n is a, c, g, or t
cggacgcgtgggccagcatgctagcctttgtgtattacctagcagccttattgctcccacttgctgcgtctttgtccaccacgtcaccgagccgtaggttatcatgggtctaataacccttgtgtataaccatagagtcattttggggttaagcccccaattcttaccacacattcttctacatctgcccaaggacatagtagctttgtgtgtggtttttatgatgtgagtattccatgtaagcctatgatcaaaataaaccccaaggtattttgtttctttggcaaatgaaatctcttttcctcccagcaccggtggttttaggccttgtagtgctgtctttttggtgaagttgacgatttgtgttttctgagcattgactatcagtctcttgtttacaccagtcgtcaactatatttagggcttcttgcaatcttccagacaccaattctcccagtcgattatcatatggccctttattatcgaatcatcctttatataatagatataataaaagagaaatgtttaaatttagatattcattgtttttgaatattagtacagttgttagagacagcaattccactgagcctctaaaatcatacgaacaaactgaattttgctgagaatgtaaatttcggggacttgccgctcctatccctgcttccccttaaaaccactangtagggtggtggagaaacggaaaacatcgatttaagaatctgtacgccttagaaaaaatgtttcaaacaataaatgtagctgcgataattattaagaacaaagatgtctagcactttttgtctagaataaaccgttctctaagaaacaacgctgtagaataaaagggactgcaatacgtctatttatttttataggacagttttgtgtatttttttacagcataactatgattttctttataaattaaacacaattgacaattaaatataattgacaaatattgtcagttatattatttatgaaaaa

SEQ ID NO: 9747 - DNA, 989 bp, Diabrotica virgifera
  misc_feature (437)..(456): n is a, c, g, or t
  misc_feature (766)..(795): n is a, c, g, or t
  misc_feature (878)..(896): n is a, c, g, or t
aaaacataggctgtattttagtgtatagaacccatattatcagactaaatactaatgttcaaatatggtacagttattccaaaggatctttgcaccaacgtaatgattgacttgcagacaagttaaatcaaaccattaagtgaaaggtaggtcagtcagtattaggaagtggctattatcccaatggatgtattttataaagttactttattgatgttttgatcttttttcactattgaggaaattgatggactcgacactaaacagcttgaacatcatactgactggtactaatataaagataaatatagaatggtaaaacaaaacaacagtaatctcgaaaataaatgtttctgttcaaaagaattatagccaaactctgagactcatgtagtataatgacaatttgtagtttaaaaatattacttgtctcattnnnnnnnnnnnnnnnnnnnnccggaagtaaacaaataacagagcaacggttgttctaacacttattgtggtaaataaaaattacaatgaaatgtatgaacaaagactaaaagtttaatacagtagaaccccgcaaatccgaactaattggggggacagcctgttcggattatccgaaagttagccttaactagtagttcaaagctttcattgtgattttgagtagccaaacgttctcgcaagagtgtggacaatatttttggactcaagttgactacgagagaaccaaaataagtttgtgtttaacctttataaacctatatattaaagnnnnnnnnnnnnnnnnnnnnnnnnnnnnnngtcaaagtcctagtaatcctacattgtctaattttctggctttactctgtataataaacatggtttttaaagtttttgtcttnnnnnnnnnnnnnnnnnnncacttttccgttgggttcggatttgctgaaagttccggattccccggggttcggaatttacggggttctacttgtataatgaaaaactttttt

SEQ ID NO: 9748 - DNA, 271 bp, Diabrotica virgifera
  misc_feature (5)..(84): n is a, c, g, or t
  misc_feature (206)..(223): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnnaccttggaaaaccacgaattttttttggggaagtccaatcgaaaaaaaaaattggcaccccccccggtgggataaagtttaaaagtggggccccaagtaaaaaaaataaaacctggctcccnnnnnnnnnnnnnnnnnnggacctttaagataaaaaacacggggagggccccccggggggggtgtg

SEQ ID NO: 9749 - DNA, 745 bp, Diabrotica virgifera
  misc_feature (12)..(40): n is a, c, g, or t
gggggccccccnnnnnnnnnnnnnnnnnnnnnnnnnnnnncccctcccccccccgtgcttgtctaaaaagatctatatcaatcggaattcaaaatggagataacattgtctgaatcacgtgttcgatataagcatggaaattaataatactttcctgatagactcgaagacgaaacgtcgaggaatctacaggatataatgtctcattccgtcgcatgtgcaatcagattattgctaaataatgctaattttcgatgagtatcttaagtaagtagtcctttatgcagtaacaaaacgaaagaaaaacccacaacaaatgcaaccacttacgattatgccctagctcccacaagattttagaacagattacctacagcctattgtcatcctacctcttccatgagcgacacattaattgaacacattcgaattatcacacatatgacaggtaacacaatgcgatatagacgctgactatagaggataaagggctcataaatgctattatttttgcaggaatgatatccacatgagtgttcataggggctccttatgcgacgctttaagtagaaagaggattatacgggatgctttcctgatgtctgaattttttgctgcatgtgcagctttattctacttatctaagatgtactttaagcagctaaatttatgtctagggacaattattactggtccattgtctgctacgactagtcacttcaccgtatttccttctgcctcaata

SEQ ID NO: 9750 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9751 - DNA, 934 bp, Diabrotica virgifera
  misc_feature (822)..(822): n is a, c, g, or t
  misc_feature (847)..(876): n is a, c, g, or t
agcgtattcaaacctatacgatcaacttaataccagggaaggcgaagcaaagatatataaaatagccaaacagagagcaaagaaagcaagagattttaatcagattagatgtatccgagatgaaaataataaaatactaatactaataaaatactaataatactaataatactttgttagatgacctgccccataaaagtagaaaaattttatgcggggactttaacattgattatgctgctgctagtgctacacaaatatccttggtcaacatatttgaatcgtatggtctaacaatgcacgttgattctcctacaaggattacaaaaagttcatctaccataattgattatactgtctcagatttttaaccccttgacgtccactctacaattattaatgctggactatctgatcatgaagcagtttatacgaagtttaatatcttgagcaaaccctcctcgaaaacccgacgtttaggcaggatttttttcacccggaactttcgtaatttccaaaatttatgcttaacctctgagtggcgctttcctgttatggacatggataattatttcagtgcttttttggataagcttgtctgtatcttcaataaagcatttcctttaattgcaattaagccaaaacatcgcaaaccctggactactaaaggtatccgaatatcttccaagaatatgcgttctcttctctatatcaggaaatttactaccaacgtttctatcactgaatatatcaccaagtacagggcaacctatcttaaacttataaaatcagctaaaaaagactactaccataaccgtttgngaagctcaaaaagtgttgcaaaagnnnnnnnnnnnnnnnnnnnnnnnnnnnnnnataaaacccacactgctaaaacaatttcccttcagaccctgaaaatctaaatgaatac

SEQ ID NO: 9752 - DNA, 686 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 9753 - DNA, 945 bp, Diabrotica virgifera
  misc_feature (531)..(548): n is a, c, g, or t
  misc_feature (856)..(873): n is a, c, g, or t
gttcctgatgatagcatgttcaacatgtcacattcctttaatgaaaaattattccaggaaaaatctgttctcgaaataggaattagtaaaagatttcctagtcaagatgacatagacagaataagtagagttacttcccatacacctattatcgaagaggggacggactctttgggaaggaaaaccattgaatctctaaaagaaattgaacggaacagacatattcatctatgtcagcaaggatctcatgttatcgaacaagaacggcaaagagtaaatgcattaaagcaaaaagtacaagaagaagtaaagactaagtgggcacaaagagttcaagactgcgattccctaaattcttcagaagaacttgaggatgcacgaattagggaattagatcaacaaattaacgattatcaacgaccgacatatgaacaaaattcaataaatttgtctcgagatgaatctgaacatgccgaatctccaagaccgctatctgaaactagtgaaatgagtctagaagttggtactttnnnnnnnnnnnnnnnnnngataagtgataaacaaagaccgctcacaagatatcttcccattagaggaacagatctagatttaagacaacacatagaatcagcaggtcaccaagtggtattgtgtccccatgtcattataaactctagtgtttgcagaggttatctccacaaaagaggctcgaaattaaatggatggtctagaagatggtttgtatttgacaggcataagcacacgtttgcttactacatagacaaaagtgaaaagaagccaagaggtggagcttattttcaagcgatcgaggaagtatatttggatcatttaaatnnnnnnnnnnnnnnnnnnccacatttgacattcatagtgaaaactcatgaacgtttatactacttaatggcaccttctccggaagctatg

SEQ ID NO: 9754 - DNA, 215 bp, Diabrotica virgifera
tgtctattaatagaagtaattttatatatttgttcctttgcgactaaaatatatgaataagttagagatagattagaaccgtgtgtatcatgcagaggtagggtcatgatattgtaaagttttaatgagttgagagatatacttagaatttagatcgactgctccgataatagcagttagttgagaatagaggaagtgatgtgtgattatatgta

SEQ ID NO: 9755 - DNA, 801 bp, Diabrotica virgifera
  misc_feature (254)..(285): n is a, c, g, or t
  misc_feature (624)..(642): n is a, c, g, or t
  misc_feature (686)..(729): n is a, c, g, or t
ggtgttaagtggagcatcgcaggccacactgctagacaaaaagaccaatattggaatgcaccaatacaacactggagagcttacgaaagtaaacgaccgagaggaagactacaaatgagataggttgatgaaataaaaagagtagccggaaaaaattggaaatatgttgctcaggatagagaccgatggaaggagttgggagaggcctatgtccaaacgtggacgatagaaggctaagaagaagaagaagtacnnnnnnnnnnnnnnnnnnnnnnnnnnnnnnnngaaacataggacatgcttttattacccacatgtaaaagattttgtttttttttcaggcaaaaatcaattgaagacagccatccttcttaacgctgaaagtggagctgacgttgtaagggaacttggaacccaagcagttttggctggtgctccacaaagcgccaatgctttagccgctgccgtagactccgtcagcaccagtgatgtacaaagtgtaagtaaacaaatatttctactggaaattgtaaattttataaatacatatactatagtctagccgctgaaaagatgcactgatcacgtgaacggcacgcactcttaaacgttcctttcgttatnnnnnnnnnnnnnnnnnnncacagctaatttgtttataataattaaggaatctcatcaatgcnnnnnnnnnnnnnnnnnnnnnnnnnnnnnnnnnnnnnnnnnnnncaaacattgtacattcacagcaccctctacgatttttcaaaaatgtagttcaaacgattaataggggggaac

SEQ ID NO: 9756 - DNA, 1125 bp, Diabrotica virgifera
  misc_feature (231)..(250): n is a, c, g, or t
  misc_feature (458)..(475): n is a, c, g, or t
  misc_feature (570)..(593): n is a, c, g, or t
  misc_feature (1019)..(1036): n is a, c, g, or t
gtgaataacacaggccgaaattttgagattataaagtatggagaccacctatggaataaaattgtttgtgtccttagaaaattataaaaacgctaggatatgtcaacttttaaattcaaatgtatgtttaataaacataaatttaaatatacaggtaattcaagcaagtctaatatagtcagtggtgtcatcgtgtgggaatgcgtgggaacgccgttcccgcactggttnnnnnnnnnnnnnnnnnnnngagaatttaggttttgtaaacaaaaattagcagtgcgttccggcactgcgttcccgcactgctaattttgccatgacaccactgaatatagtagagtgtcaatgaaacgccctgtatatctttatgtttttagaagcttcttaacaacctcatctcaaaaagtgtataatgtagggtctgttataaataatacaaggtgaaattttgnnnnnnnnnnnnnnnnnngtcaagacattaaacacaaaaccacataaattgatacttagtttagaaaatgaatgcatttcatttaaaaaataatacccttatttaaagtgtgnnnnnnnnnnnnnnnnnnnnnnnnatgtgtttattaacttacgtgcatagaaatcggcccacttaaaaatttggtcatttttgatgtctcatatttcctaagcctcttggctgatttaagtgattttttgaacatgttatagcctgattctttaacaataccactgcaataatattgttgctaaaaaaaattttcgttatataacgggtgtaccaatcaaactgtttttttttctcaaagttcgcattaccctgtggaatattctagcattaataaaatactgaaattaaaaccccactatagcctcagcttttcttaatattctgttttttgattcattcgtttatgttggataataaaaaaagttagttaccttaacactagaaatgttcttcatcaatacccggggtttttaattaagtgtgacaaattttagggggtaattctgcnnnnnnnnnnnnnnnnnnggggttttttaaacttattgtcccccaaatgttttctttttccaagaaaacggggaaggttgaaatttttttttcttaaaaaccctgga

SEQ ID NO: 9757 - DNA, 777 bp, Diabrotica virgifera
  misc_feature (2)..(235): n is a, c, g, or t
  misc_feature (245)..(245): n is a, c, g, or t
  misc_feature (247)..(262): n is a, c, g, or t
  misc_feature (264)..(296): n is a, c, g, or t
  misc_feature (329)..(397): n is a, c, g, or t
  misc_feature (408)..(471): n is a, c, g, or t
  misc_feature (475)..(565): n is a, c, g, or t
  misc_feature (610)..(637): n is a, c, g, or t
  misc_feature (680)..(698): n is a, c, g, or t
  misc_feature (707)..(734): n is a, c, g, or t
  misc_feature (763)..(775): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggccgncnnnnnnnnnnnnnnnntnnnnnnnnnnnnnnnnnnnnnnnnnnnnnnnnngctgaatgaaaggttggatgaaaaaaaactggnnnnnnnnnnnnnnnnnnnnnnnnnnnnnnnnnnnnnnnnnnnnnnnnnnnnnnnnnnnnnnnnnnnnnccctataaagnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaggggaaaccggcggattttttttttggggagatccaaaaccnnnnnnnnnnnnnnnnnnnnnnnnnnnngtgtggggtttaaaagattttttaaattggggggggggcgccnnnnnnnnnnnnnnnnnnnctgtttttnnnnnnnnnnnnnnnnnnnnnnnnnnnntaagttctgtgaggtttataaaacacgcnnnnnnnnnnnnncc

SEQ ID NO: 9758 - DNA, 882 bp, Diabrotica virgifera
  misc_feature (138)..(155): n is a, c, g, or t
gcgatgcgaaaatgcgaaaatccatttcctcaaaaatgtttatggagtttcaagggacataacctccaatagtgttgtaaataatacacagtagtgatgtggtgtttgagaaaatgttcctacaattaatgaacaagnnnnnnnnnnnnnnnnnngggtagtaaacaacttaaattattcgatatggctgtgagcagttggatgctcaggcaacagaacagatacaataggtcaacaagacataacaaacaggaagatgtgctggcacagttgcaaagtttagggcctcaaggaagctgcacaaagcttttggagaaaatatgcgatcttaacgtcaaagaagagatactcttcagctacctgaatgcatttgtgaagttaacattgaaatgtggagacgactttgaatacaccattgaacaaatattgacctgtttaaggctttctctcattcacaactctgcccaaattcgaacagccggtttaagatgtatacgacatgtccttaaaacagaaacagatattgtacaggcaaataagttattaataccttatttattaacgaggtcacttgatttaattttaagaaacgatgttgaacgaatagaggcaatgaagctaataagaaaaactttaataatatcggctactacttttgatatcgctcttgcgcgatgtttggtttctctggcttacgaaggtgctgaagctaaagatagaatgcttagggtgtgcatggctactttatcggaattgtgtgttctaaattcaaaattgtttattgcctctggcggcgtaacagcaatatctcgaaatttattagagtgccaaaagccctaaaatcgctgaaatccttatggcggggtgttgctttttactttt

SEQ ID NO: 9759 - DNA, 950 bp, Diabrotica virgifera
  misc_feature (102)..(152): n is a, c, g, or t
gttgagaggaacaagtgatagtgttgttgtacctagtattggttttccgttattcaaaattaatcaaacaattttctattagacttctttaaattgttgagnnnnnnnnnnnnnnnnnnnnnnnnnnnnnnnnnnnnnnnnnnnnnnnnnnncctgattatgtggtcggaggaaaatatcgtctacttcgtaaaatcggtagtggatcttttggtgacatataccttggaataaatattacgaatggagaggaagtagcagtaaaacttgaaccaattagagcaaggcatccacagcttttatatgaaagtaaactatataaaattcttcatggaggcataggaataccacatatcagatattatggacaagaaaaagaatataatgtccttgtcatggacctgctcggtccgtcgttggaagacctcttcaatttttgtacccgcagattcaccattaaaaccgtactcatgttggcagatcaaatgatcactcgtatagaatttgtccattgcaaatcgttcatacatcgtgatataaagccggacaatttcctcatgggcatcggccgtcattgcaacaaattattcttgatcgattttggactggctaagaaatttagagacaccagaactagaatgcatataatataccgtgaagataaaaatttaactggtactgcccggtacgcgtccattaatgcacatcttggtattgagcagtcacgtagagatgacatggaatctttaggatatgtattgatgtatttcaatagaggctgtttgccatggcagggattgaaggcggctacaaagaaacaaaaatatgagaagatcagcgagaagaaaatgtccacgcccgtagaaagtctgtgcaagggcttccccgctgaattttcatgtacctgaactattgccgtggacttcgcttcgaagaaaccccgactacat

SEQ ID NO: 9760 - DNA, 858 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (606)..(606): n is a, c, g, or t
  misc_feature (633)..(682): n is a, c, g, or t
  misc_feature (687)..(766): n is a, c, g, or t
  misc_feature (768)..(849): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaanaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnntccctcccc

SEQ ID NO: 9761 - DNA, 941 bp, Diabrotica virgifera
cttctaatatcagcccaggaaaatccaaaaggaattccattttcattcataaatttaaaaagagaagaattagccataaaaaaggaaaaagaagataaagaacgggaacagcgagaaaaatcggacaaggaacgtaagtatcgtgaccgagatagatcccgatccagacgttccaggtccagatccaggaaccggaagtcatctagagaccgttcgagccgaaacaagaaatctaaaagcagggatcgaaattcgaggagtcgcgataggaaatccagaagtagggatagaaaatcgagaagcgtagacaaaaaatccaggagtcgggataggaagtccggtagtcgagataggaattcacatagcagggataggaagtcgaggagtaggagcagggataagaaatcggcgagcaggtcgagggatagggtaagcaaatctaggagcagggagagggataggaccaggagtagatcggcatcgaagccaaaggaagacattcccaggaatggagatgttagcccgaaagttgcagttaatggtggtagagaagattctgaaactgaaaagcaggcgaataactcagcaccagcacttccggtgtccaagcttcaagcgaagttgatgtcactggcagagaacaagaaggtctcgaggtcgcgttcccgctctaggtcccacacccgttccaagtcccgagggcctcgatccaaatccaggtccaaatcccgatcatcgagccgttctttcaaaggaaggaggtccacttcgaaggaggcgaaggtcaaaaggagatcgagatcgtcttcaggctcgaaggagaatttcgaaattcgcaagaaagaagacagcgtgcagaagaagcgacactatagatctaacaaggacagttccgacagcgaggcggacgcgaagaggaaaagtcgaggtcgaaatcagct

SEQ ID NO: 9762 - DNA, 933 bp, Diabrotica virgifera
  misc_feature (278)..(294): n is a, c, g, or t
  misc_feature (406)..(426): n is a, c, g, or t
  misc_feature (437)..(449): n is a, c, g, or t
  misc_feature (451)..(465): n is a, c, g, or t
  misc_feature (772)..(772): n is a, c, g, or t
  misc_feature (874)..(875): n is a, c, g, or t
gaagcaattgacaggaacggagtacagtattttggtttaatgaaagatattgaagttgcccgctttgtcactagaggagagtacggcatacccggcaactattcagatatcgtagcgaacaatcaaaaaacgttgcaatttgttagtggtataaaggcgatcaagaaccctgctggaggagaagacatatatatggtaacatccagattccagagagtagcaacgggtacattaaactcagcggaaattaattttagaatccaaaaagcttctacttnnnnnnnnnnnnnnnnnacaaaatgcgatccacgttactctccacccttaccaccaagaaccacggaagcacccaacgtcagtccaggaccagtcgtttttcctcaagatagatagaaaatgtacgtcnnnnnnnnnnnnnnnnnnnnnatgaccagtgnnnnnnnnnnnnncnnnnnnnnnnnnnnnttacaaaattcaaattttaatcaaaatttatctaataagagatcgttgattgtttatttcaaatagcacctatttgtcctgcccaattccactgtagcggcgcgattctttcgacagcgtctgttgtttttgttctaagatatatttcttcatttgggattcggtctctcaggagacacaaaacatctggcgctccatagccctctgagtcacgcaaatcttgttcagtaccttttttgtgattgttaaggtagttcagtttaccaaacgttgtccaggctaaataatccaatttcatgtcctctanattttgaagttacttctgtgttatgtttcatattatgatcatgatcatcaatccgaacgcgtccactgctgaaacgtagtccccctcagctctttccatctnngctctgtttgtgcggcttgtatccatttgtcctgcccattccactgtagctacgcaat

SEQ ID NO: 9763 - DNA, 165 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgaggcaggttggtttcta

SEQ ID NO: 9764 - DNA, 951 bp, Diabrotica virgifera
  misc_feature (882)..(882): n is a, c, g, or t
  misc_feature (889)..(889): n is a, c, g, or t
actccatattatctaacatttcttttaccttcagccttcgcttttatttctcccaattcttatttaacttagttttagtcatgcgtttattaaacaaatacatattttattatgaaacgcacagaaacataaatattttaatcttttaaacagttattgagtaaatttagttttgtagttttagctcttgtttgaaattgacatttatatattttactttatgtttctgggcacttcatacaaattaaatatgccgaaatcgtgtacctatattatggaacctcgctatatttaatcaatatttatcatgtttttgttgcaatctttgtaaattttttgcccacttatttttgcacacttctcggacaacacgcttactaaactttaaaaaatcggctttactcagtgagttgtctcaggaattatatgctcctctgtcaccctgattgaaaacttcccccattttttagtatttggtcgttttcatatctcctcttctttcttctacatattgtctgcctttcttcgttcttcttcagatttttcgcgcatttctcgtgtttctctttgaatatactgcacgtataagtgcttcatttcttttgtctattgtttgtttatattcttcatcaaactaaagctcttttctttgatgtgttttaattcctatcactcttttttttcgtttcccatgtcatcatcttactcttattccattcttcttgtatcatttcctccctttgttctaggagttccctattcaattcttttcaaaatcgattttcaatttctggatttttcaggtttaatttttcactctctgtgtgtttatccttctgtctgtttactttcataattttctaaacaaccagaattgattanattacgncaacttacattatttgcacaaactcttctgtacaaacggagcaagcacaaagtagttttgca

SEQ ID NO: 9765 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9766 - DNA, 691 bp, Diabrotica virgifera
attttttagtaaataagtacataaacataaaatttgaatttccataaataatatggaaagaaaagagggaaatgaagatgaagatacagtaacaaatatcaaggttgagaatagtatttttgtcaagcccgaattcataaaagttgaacctgatctattttatctagatgaatatgaagactgtaaacctactttgaaccatcttaaaacagaattatcagttgaatgtaagacatctgaacagaaccaaaacgatctagcacaattccagtatttagatagtgatgttaatacaaaaccagagcattctgttaaaggaagtcaaagcagtgaacatgtttttggatagaagtaacttttctcccatcggtagcctccagccttcattaccggtgatgccactttaaggccaagacaacaggaagcatccagagagcaacaaccaccaactatagcaactctcaacgtctcttgctgcattgacccgaggccgtccatttagcccaggtcgagagaagtcaacagctgtaccattcgacatcaagaagttaccatcgaaccagataccacaagccatgcataagtataatccaagaattgttagtttttggcaagaatttgaataatatgttattgcatttaaaaggtcatattttatgatatctttattgagcaataaacatgattagtc

SEQ ID NO: 9767 - DNA, 718 bp, Diabrotica virgifera
  misc_feature (81)..(99): n is a, c, g, or t
cccccctcgacggccggcggaagcgagttcgcaaagcagaaaatcccctttaagcgacatttacattgtgacttgtggatnnnnnnnnnnnnnnnnnnnccaggatgcctgaacaaactcttatcgcatatggcgagaccttctccttccagactgaaatctctcagctgatgagtttgatcatcaacacattctactctaatcaagaaatcttccttacagagatgggctccaactcctcagatgccttggataatagccgttaccaatcactcacgaatccatcctgtgtacagactgctgaaaaatattcgcgcattacaaatgttcctgacaacaggattgaaacttaaccatcatggatactggtatgtgggatgacgaaaccgtatttatgatacaagcttgatacgatctcacaatcacgaacaaacgtcttcatggaagccctccaagctggagctgatataaagtagagtggaccatttggtgtaggtttctactcaaccgacttagatgctgatcgaggagtacttgtatcttaaaataacgatgctgtgcagcacatttgagaatcgtctgcaggaggtacattcacagtaataccacatgatagatgaccactgggacgcaggacaacaatagttctttacatcacagaatatcgaactcgagtcttacaaaagaatgaatgtatagagatcttaaagaaaaactc

SEQ ID NO: 9768 - DNA, 577 bp, Diabrotica virgifera
gcggaattcccgcccctacccccgcgccccgctgagactgataatatgggaaatacttctacttgaaccacgacattaagacgaattaaagatctagaagcctaatagccgccttggacgccaaggtgttcccggaacaggtttatgacttatatctgtgcaccactccatagcagctgtaaattacatgttatgatatttatgattagattagaaggaagaaagtaactacgtatgagtgaagcgcattgtagcattctcagatagtgatagtaatagcagctaacggaattatctgaaccactgcgatattattctttgaagatattctggtggttaaaatggaataatcatcaccgctttggagccccctgttcaagatgtcaacatatctgttgagggaggcggtagacaggctactttctcatctacatacgcggtatgatataatggatgcaagcggtggcgacttggctgaattcgctcaaggtgatctccttatatcttatgcttttgacctaactgctgccatgatgaccttcccctttgctcttcactggctccgaacgttcttaac

SEQ ID NO: 9769 - DNA, 890 bp, Diabrotica virgifera
  misc_feature (798)..(799): n is a, c, g, or t
  misc_feature (847)..(847): n is a, c, g, or t
  misc_feature (857)..(857): n is a, c, g, or t
gatttttcttcactgatcaaactagagtaagcagtacagccggcggtgaaaactcagtagttcaaatgatcggttctctttacgatgctattgaaagtcgctatggatcagtcgctactagattgtacagagcattcaaacctaaaccagtgaaaagtgcgtcgagttggacatatagaaaagtatgttgtttaccatacgtcgtcttcttcgaagtgacgttattaatgttattaactggaacgtgtgccttgactatataccttatccatgttagtgcgacaactaccgttactgacataaatgaatttacgctaaaaatgattctggttgttgccgccttgctgctcggcgtcgcatgcctggccaatatgtatacctggagtaggatgttgaaagctttacttttttcccaaaggagacacctccaaaggtctatatctaagttggaaacattgaagtctgagggatttttgcaaacacttagacaagaggttaatttaatgaaagacatggtaaaatgtttagacagtttgagcagtcaacaaaccagactcgtagtggtagtggacggactcgatagttgtgagcaagataaggtgctgcttgttttagatactgtacatatgcttttttccgacgcgaacaccccgttcattgtgatattagccatagatccacatgttattgccaaggctgtagaagtcaatactagaagactatttagtgagaataatatcggagggcacaattatctaagcaatatggtacatctacccttctatctacaaaattccnnggtttgagaaaagtgaaaagtgcccagcagactgcgcttgcgcatagngaacaagtcngaaattggaccgagaacgatgagaaatctcaca

SEQ ID NO: 9770 - DNA, 913 bp, Diabrotica virgifera
  misc_feature (783)..(783): n is a, c, g, or t
  misc_feature (835)..(835): n is a, c, g, or t
  misc_feature (895)..(895): n is a, c, g, or t
ttatatataccaatattctttttaaataaagtagaatgtagtagaaatagtagaattttctataaaatatgaaacttgatatatttttgtgatagtctattttttaagacataataattatatagttgatcccaaagaattttaaaatgacagttactccaggattcactaacatgtttaaaggaactttaccccaaatatcagcagtattagcaggtactctatgtgctttaagcgatggaatgcattatggttggactgctcctgcaattccaatactaatgagtcctggctctccaatacctatcacaaaacatcaaggtgaatggctggaaaatgtgtatgtaattggtgctgcaattggactttggccaacaatgtatgccgtagataaaataggtcgaaaaaaatctattttattggcatgctttgtatctgctttggtttggattacaattgctctggcaccaagcgtggaatatatatttgtggcaagaggattcgctggagcagctggaaatatggctttcgtagcaactccaatgtatattgctgaaatagctgatcaaaaaataagaggctttttaagtagtttaatttatcttatgatgctttgtggaattcttttaatctattgtattgctccattttttcctatctatgtaccttgcattttaggagcagttatggtctctatagaacttatatggttttcgttggtgcctaatagtccttattatttgataattaaaaatcaaatagaagctgcccgacattctctanagagattaagacagaacgattctggcgtagaggaagagctcaaacaaattanattagctgtggatcgacaaagaaactgaagagcacgatttttagatttgtttctgatagncagcaatagaaaagcatt

SEQ ID NO: 9771 - DNA, 894 bp, Diabrotica virgifera
cccacgcgtccgcggaggaaagtggttttgattttgggttgttatggctgattgacttgtttgacagtcatcagaatttcagtgacttttttccagtttaaattttaaatcatttcatttacgtttttaattaaaactctacactcgttagtgattaagaatactttgaaatttccgtaaaattcgtcttttatctacaaattacgtgctgtcattcaagttgacttagtggtatttttataaatgctcatccaaaatattttgatgatttcgtgttactattaacaaaaaggaagtgaaccgaaagaaaaactttgaaaagcttagaaatgggcagtgttagacgcagccttgtcacagctggaagatatgctgtagctgctaggatttcaaagttacaacatggagtactgtctacgatctacacccctggcgtgccacatagtaaaggaatatccactagtattatagttttaaaaaccgctggtaccggagaaccaccatctggctacaacccacctcctcctccgtccaaagatggcagcagtggtagcggcaaaaataaaaacaccttgtcatgtcctaaatgcggggatccatgtactcatgtggagactttcgtcagttctacgaggttcgttaaatgcgagaaatgtcatcatttcttcgtcgttttaagcgaagtagatagcaaaaagaaggaaggtgtcgacgccaaaagtggtcagtacaagaaacctccgcctcatccaaagaagatatacgattacttaaacaagcacgtggtcggacaagaacatgctaaaaagatattatccgtagcagtgtacaaccactataaaaagatatacaataatagtcctacacaatcaaatattagacaagacatggctg

SEQ ID NO: 9772 - DNA, 574 bp, Diabrotica virgifera
caaacttgtacaaaaaagcttgcgtgaacatcttctaatattgatccaaagtaggagactggacccgcgcgagaaaatatgaggaatacaaaaaaaacatatctcttttcgcacatagtgtactatgggagcgtagatacggacggagatgtacattctaacagtactgacggcgtgatagtggacaagtttctcccgcaatgcctgcgcattccattctaatcgcgtggaaacgttgatgaccatatcatacccgggttatgcacctgtgaacttccaagagccagaaaacacagtgtcccgctttggtatccatgaagtttgacatgagcatagtaagcctgacccaatcaaatggactcaacaagatctatcattcaaaaaaaatggcggtttgacatgataatatcaaaagggtataccgtgtctattgactcacaaagccatgcacgatactgtcacagcttgcggtatcgttcttagtgacacacgtagcaccagatgaaaacagatctactaaagggtgtgtggttgaccattgcgaaaccgctaatgcagcgattagcggtattgc

SEQ ID NO: 9773 - DNA, 940 bp, Diabrotica virgifera
  misc_feature (214)..(236): n is a, c, g, or t
  misc_feature (797)..(813): n is a, c, g, or t
aattttaagagatgctaataattaatttgttataatggaagtaagcccattatgtataattttggtaaaatcagacagtaaaggtgacagattactatttaggtatccttttcaaactcaacacagcaatgaaccttcaggaactcgacgtaaaaatccttatactcttcctgtagtagatgatttgctgcagagaaataaccaaccacattcnnnnnnnnnnnnnnnnnnnnnnnccggatttactgacgaagttctttcttccctttttgcggttaaaactgaattgtgtaacagaaagtttgagcttaaagtaaatgatgtaaggtttgtaagtcacccaacgatacttcaacttagaaacaaacaggaaaaggaggatgagtcggagtctggtatgttagttaatattgtgtttgctttgcaagctttggcaagtcactctgttgttaaatgttatcatgatctgagtaaaagaatgggaattgttttgaagtatgaagaaaaaagatgtgggtatgtaaccgagcagactcagttaatgactacagctcatgatgatggttataccagtggtccaggtagtgcttttaaaataattttggaaaagtgttcgttagctggtaatattaagaaaatgtatgatgatctatgttcaactggattggttagtttgagaataaatagatggataccgctaagtttttgtttgccacaaaaagttcatcaatggcacatgcggggcaaaattgtagagcctgctgacattgacaggtgtttaaatgctttaagaccgnnnnnnnnnnnnnnnnntcttcatccattacaacaaatgaacgatttcacatctttagatgggtctccttctttggatcgaatgctgtcacaatattcttcttttaaaaaatttacaaaacattagcaatctgattcctgacct

SEQ ID NO: 9774 - DNA, 696 bp, Diabrotica virgifera
  misc_feature (3)..(50): n is a, c, g, or t
  misc_feature (52)..(169): n is a, c, g, or t
  misc_feature (171)..(497): n is a, c, g, or t
  misc_feature (499)..(617): n is a, c, g, or t
  misc_feature (627)..(692): n is a, c, g, or t
ggnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaagggnnnnnnnnnnnnnnnnnnnnnnnnnnnnnnnnnnnnnnnnnnnnnnnnnnnnnnnnnnnnnnnnnntttt

SEQ ID NO: 9775 - DNA, 529 bp, Diabrotica virgifera
cttggaaataaggtttgaagtagtagaaatgaatagtgtttggcgagaagaaataaaactttatatctccttgtgaaagaactattttttatgacataataatgatatatataggatgactacggaatgtgagtcaatgtaagtatatttggtgatgtactaatatgagatagaggaaatttatccataggtacttgagagggaaagagtgggagtataggatgatttaatagattaggatggtattaggtgtttgagaaagactcgtagctaagttgcaatatctaatgatgacctggatgacgcaatatgtgatcatgagtttctgaggatgaatggttgtgtaaatgtgtatgtgattgaatgtggaagttggactttgggatattttgtagggtcatatgtaatagtggtttaaaagtgatattaatatattaggaaggatctagtataaggagagtttagtaataaattgagttggaagaaataggggaatatatcatgtgttgctgaaggatacactggagct

SEQ ID NO: 9776 - DNA, 555 bp, Diabrotica virgifera
ggaaaccaaggtgcaagaggctacaacaaagctagcaacgagaaatgaccgattacaaatggaacagtatggatacgagcagcgtcatgacgtgacgccctatcaacaaattaaagaaaaagtggagaaaaattgtgttgaccctcagagtgatagctagtactaaacgccctgctgaagatatccaaagccaggtgccccgtatcaccagcgagactgaaccaatactgatgatatcacaggagtacaccccaatggttggaagatatcgcctagcgcgtctacgacactaagcaaactgcaatgagggatgccctatcggatgagcgtcactgatactgatttgcatgtgaagccaatagcatgacccaaatgatgcaaacgaccaatggaaagcttatacagagacttatgcgcagaacactatgaggagatgagagagaaaatcaatgctgtcatacaacatctgcgagacacgcggacgcgagagctcgtacaatctccgaatcaggaaacttgcccaaatagaaaaaagacgtaaaacagcaaagcctg

SEQ ID NO: 9777 - DNA, 226 bp, Diabrotica virgifera
aaaaaataatttgtactgtataagtatattttaatgggaatggaaatttaggatttcaaaggtgaaaatgttgggatagtatagatggacacttttttattttagtattaagtggttacataattattcagaatattaataaaattactagtaatttgaattagttttaatatgtattataatagtattaattctcatcatgtacctggctaaatagctaagcgct

SEQ ID NO: 9778 - DNA, 967 bp, Diabrotica virgifera
  misc_feature (2)..(51): n is a, c, g, or t
  misc_feature (59)..(97): n is a, c, g, or t
  misc_feature (105)..(218): n is a, c, g, or t
  misc_feature (228)..(841): n is a, c, g, or t
  misc_feature (845)..(959): n is a, c, g, or t
cnnnnnnnnnnnnnnnnnnnnnnnnnnnnnnnnnnnnnnnnnnnnnnnnnnccgtgagnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttt

SEQ ID NO: 9779 - DNA, 657 bp, Diabrotica virgifera
ccgggattcccggggggccccccccgcccgccacatttttatctagtcagggtgcatggagtttagtaggtcaagttgtagaataaggtggagtgcggagcttcgagtgacgctactgcccccgttgataccaggaactcctagatgaggctccgctgagtaaccagcagggactggttcccatgtcgtctcacatgtattctcgaatctcacagtgacatgaattcatagaagctttcaaacttataggaccactgacaaaagatgttatccaagcactcgaaattataatagcagaggtcacctatctatgctgtaggtaaagaaggcattgagaaagagctataagagaagatttacaacgctccatctatcgatctacttcactcaactgttggtagtgaactattccacaatggctgattccgaagagtactgtcaaagatatatgtgacgtcccgtttttatgataactatgacagaaacggtaccctagaatgtaacaaattagttttgctctcatgacctgtcgagaaaaatataccggataagattgctactacgctttcctaagacatggacatcggctgctacggcaggataagctcttacagctcttttcaccatcttaacatcagcacgataatcctgcacaat

SEQ ID NO: 9780 - DNA, 935 bp, Diabrotica virgifera
  misc_feature (904)..(904): n is a, c, g, or t
  misc_feature (908)..(908): n is a, c, g, or t
  misc_feature (926)..(926): n is a, c, g, or t
aaaatggtagaatatgttactagtgttataaatagtaacgaagtaaatataattaagtagaaaacatgaagaaataccatcgactattattaataattgtttccgcaataagtttaatcttatttttaatttatcgtcatgaatacaatcgcttacactatgtattagaagttttcaacttttttggccagccttgcaacttttcagacttgcagacaagtgactatacattaaagcagtatgattgggggccgcagccaatgtggcaagaaatagataatggttatatttattctgcgtttttaactggaaagattgaagttaaagctattgctcttcctctagatgctaaaaaggtgcccagaaattgctacctttggttcgaagacaagaagaaaccacttactggaaaatttactttttcaaaaatgctaaatactaatttaagctctctaacaccttactttttctactgcacagctcccactatagataactcaccatacgcagtttcatttacgtataagccaaaaaaagaaagtgagatgaaaaagatattgttggtagatattcaaataacaaaccacaagattccaaatatcaataccacaatttgcgtttctccaacaacattcagtaagaaaaaaattgttgagttttttagttttcatagacttgtaggtgttgaatcgttcatattttataccaaagatattccttatcgactttcaaaattgttaatgaatttatctaaaagacttgatgcacatgtagcttttttaccttgggattttccaaaaaatgatattgatgtagcccaatctattattgaatatgattgcctattccgtacctatggtcgatccagatttataattactttgaaattaaatgaatacctcgntccnactacatcttatactatncagggaact

SEQ ID NO: 9781 - DNA, 963 bp, Diabrotica virgifera
  misc_feature (450)..(477): n is a, c, g, or t
  misc_feature (499)..(527): n is a, c, g, or t
cagcgttattaaaatcgttgaccctgtccccgaaaaaccatgccaaccatctccttgcggtccaaacagtcaatgtcgtgaagttaatggacaagcagtttgctcttgcttgccagaatatacaggtagtccaccgggttgtagaccagaatgtactgttagtaccgaatgtgctcataacaaagcttgcgtcaatcaaaaatgcgttgatccatgcccaggtacttgcggcatcaatgctgagtgtaaggttgtcaaccataaccctatctgtacatgtacaaatggcaacaccggcgatccattcacaagatgctatcatataccagctcctaaaccagatatcacaaaacctgcaaacccatgtataccgtccccttgtggaccaaatagccaatgtagagatttaggaggccaggcaatgtgtctttgtttgccagaatatttcgnnnnnnnnnnnnnnnnnnnnnnnnnnnntgtcgtaaactcagaatgtccnnnnnnnnnnnnnnnnnnnnnnnnnnnnngcagcgatccatgtcctggttcctgtggtattagtgccacttgcgaagttcgaaatcataatgctatttgtttctgtccttcgggatacagtggagatgcttttagatcatgtttccctgttcctccaccaaagcctgagcccaagaacccttgctatcctaacccttgtggtcctaacgcacaatgtacggacggtatttgtaaatgttatccagaataccaaggtgacccatacgtagaatgcagaccagaatgtctggtgaaccaagattgcccacgtgataaagcttgtgttaacagaaaatgtaaggatccctgcattggtacttgcggacaaaacgctgaatgaccatatttaacccttacccctcttggacttgtctggatgggtactctggaaatccattctttatttgtaatagaattgaaaaaccc

SEQ ID NO: 9782 - DNA, 980 bp, Diabrotica virgifera
  misc_feature (390)..(428): n is a, c, g, or t
  misc_feature (688)..(712): n is a, c, g, or t
aaaatatcatgtaataactttttttctagatgcaactctgcatgtactgaattattaccctgataactattctactgtacatacgtgtaagttttctgggtgtaaacaaacctcttcttacgtgacgcataattagagataaccatttactcatctaggatagcatatgtctacttaaaatcatggctttggtcttgttaccaataaactgaagtactttcccagtttttattctctgaagtactttcctagtttttattcccttaagtactactgtatccgctgtgagctcgtacgtagaggggatatttacaaattctcgagcgccagtagtggcaagtctgtaaacgtttaccggaaatttgacataaatgtcaaagtgattaatgnnnnnnnnnnnnnnnnnnnnnnnnnnnnnnnnnnnnnnngttggtcaaagctgtggtatatatttttaccttaaatatacttacgttttaaatactgaatttaagtttttttaatgttccgtaatatgtaattataatttaatctaaaaatcttagcgccatctacacgataattgtgaaagtatccgaagtaagaaattcatattttatcaatagaacgtcaaaattattagcaaaatcttaaaaaaatcgattacaatttaattaattttttgcgttgtaaatgttaagcgataacnnnnnnnnnnnnnnnnnnnnnnnnnccggtgaaagataattccagtaatccgctaggagcgccaccagcgaagctcagagcgtatatatatttaatacaatggtagattttaaaaaaaggttaaatacttggatatttttaacgaaaatggcgaaagtagaccgtatttttaattaaattgtggtttattcgcacccaatttagtggcaaatggcgaattgcactcctaccaccttacgctttggtctcaaattttttttgttaactgtataatatcgttatcaaactgtcac

SEQ ID NO: 9783 - DNA, 965 bp, Diabrotica virgifera
  misc_feature (554)..(572): n is a, c, g, or t
cgcttacagtatactagggttctgagaataacttttgtttttattatggtttactcgacttcctcactcgatcaaattatgatggaggacaatgcagacaataataaagcatcaaaatgattctcgtaacatatcaatgtagtggtgtatatacgacctattaaggatgatatagaatggcttcaaattcatacaacagggtggaatgggtggaaataatcgagcccaagacacaggaacatatgtatgccaatttggctacaggagaatgtgtatgggatcctccagaaggtgtacctgtcaaaagaacagattccaaccaatggtgggaacttttcgatcaaaatacagctcgattttattattataatgctacatcacagaggacagtttggcataaacctaccaattgtgatatcatacctttagctaagttacaaactctcaaacataatacagattgtactccagcagcaactagccaccagtctactcaaacaggacatcttacagaaagggggcaagtactcactttatcagcaagtaccccacannnnnnnnnnnnnnnnnnngatttatgtagaagcagtagtttcagtcaaaggggagctgaagctcctttatattcaaattggcatgattcccaactgcttcctttggagcactttttactcaacaacagtcgtgattcagatagtgatcattcagatagtggtagtgaatccttgacgggtcatgaacctgacaatgaagattctgatcaatctgaaggcagttacttacctcatcgtttatcacatagacctgtagaatatttgaaccttccaacagcagctaccacagaaccaagagatagggatgtcaaagagagacctactgtacccttattaaaccattagctgaaacaactttgcagcctgaaaagagagctgatatggaaaaaattgctgtcgacaatctcaatt

SEQ ID NO: 9784 - DNA, 931 bp, Diabrotica virgifera
  misc_feature (233)..(251): n is a, c, g, or t
  misc_feature (702)..(719): n is a, c, g, or t
  misc_feature (888)..(905): n is a, c, g, or t
  misc_feature (917)..(917): n is a, c, g, or t
gaagagcaggagaagctgtggaggtattctacttgagcctccacattgggacgagaaaaatatctaaaagtctgaaagccgctttgaatgaaaaagtattcccagaactgctttatgacttatatagttgcaaaagggcagtgcatcaataaataatattttctgatatttttgtttagattaggatgaaaaaaatatctaattataaatgaaacccattttagtattatcannnnnnnnnnnnnnnnnnngctaacagaattatctgaaccattactatttaattatttgaatttattttcgttttaaaaaaagtattatcatcattgcttttggccgcctgtgtgcgatgcacacatagtagcggcggccctgactgtctgtatacttactaatttttttacttgttaaatattgttatatgtaacaggtttgctttcacttaattaacacatcctcatactcattgtttttatgtctttaaagagtaggcttctattttttacatttccccataaacttcctttgttcataccaatattaaccctttcacagacatgcctagtctaactatctcacaccaaaatttctcttatttgtcgcccactgtttccaggaacttaccattcacttgttctttttgctttttacttcagcattgactgtattcagcctgtgagacaggagaggcaaaggaagggnnnnnnnnnnnnnnnnnntcatcaggagagggcagaatactgcatgaagtatggggaccagatctgatcaaacaactattaaaactaatccaaaatataatggaaacatacagaatgtcacaagaatgggagatcagcatccttatacctctcatcaaaaagggagaccccgagcattacagagggnnnnnnnnnnnnnnnnnncaaagtaatganaatatatactaaca

SEQ ID NO: 9785 - DNA, 892 bp, Diabrotica virgifera
  misc_feature (791)..(791): n is a, c, g, or t
gcatgttatcatttagcggtttacccatatttttatatttccttttccaggatttcaaaacttgctccaaatatattttaaatagcgtgggtgatagacatcagccctgttttagacccttattcacttccaatcctgacgagatttccttgccgagtgtatattgcggtagtatagatttttacagctttaatgagcttcagattgatgttagttttttcgagggcttcccaaagtttactttatggcacagtgtcggatgctttttttaagtatatgtacactaaatgaaattcttaattgtaggctatttgtttgtctattaactgtgttacacaatataggtggtcagtggtggatctgccagcacggaagccggcttgctcttcggcctctaaatctttgtattcttcttctactttttacataattatagtaatggtattcttctgtaatattattggtttattgcatcatcacgccacaccttgtagtcgatggaaataaatattatgtaagtgtttcagacatacagaaaaaaatggtcatcacaccgaatatggtctatcgattatctccgatagttttatttaaaaaataagctctgtagaagcggttttaaaaatacaatgttccaattaaaggaaccatctccgttttgttaggttttatatcattttgtttccaaatgtaacaaaataagatagtttctttcattaaagcattgtactgtgaaaacggccttcagtatggaatcttaaacatgaagtaagtaatttgttgattaattntggtttatttctaacaagatacttcataataaccgacggaccacataaaatatttacagaatcttatgtatgattttgcacataagtataaaaacattctg

SEQ ID NO: 9786 - DNA, 991 bp, Diabrotica virgifera
  misc_feature (345)..(372): n is a, c, g, or t
  misc_feature (563)..(591): n is a, c, g, or t
  misc_feature (632)..(663): n is a, c, g, or t
  misc_feature (823)..(823): n is a, c, g, or t
  misc_feature (888)..(888): n is a, c, g, or t
ggaatttaaaaaaacagaaaggggagaatggaagggcgatgagtcagcgaaagaattattctatatttggagaaaattgaagagtagatgtcaagaagaatacaatgaagaaagagacaataacacacgattagaggacgaagccattagtaatatatatgctgaagaacagattgaagagaataaaactgaaatacatgaaaatagcggtaaaactgaaaaccaaatatataataccgaaactgaagataaagaaaatagcaatgagaaagaactggaagaaacagaatatgcccaaattataaacttaacggaaacaacttcagaacaaaaagatgaaacagnnnnnnnnnnnnnnnnnnnnnnnnnnnntgacgtaattgtacaaaggccagtaactccggtgccactacgacagtcccaaaaaagaaatattagtgctgcctttttggaccatatattttggccagaagagtcacctgaaaagaaggtgtttacaagaaaagaaaaacttccttatgccactacttcacttaaatggttgcagtaccacgaagagaaannnnnnnnnnnnnnnnnnnnnnnnnnnnngaaacaagagaaggcattattgagaaagaagaaacgagagnnnnnnnnnnnnnnnnnnnnnnnnnnnnnnnnggcgaaaaaagcaagtgctaaaaaatctaaaacaaaagtgaacacagaggaagacacagatagttcagaagaatgtgatgaatggcaggagagtggctcaagtctagatgatatttcagaacattttagtagtgacactgatgaaaatgagccacttgtncatgaggtaaaaaatcttaaaaaagatatttcaataggtgatttttactttggtgctttcccagnaaaaaatgtcatcataactatgtttgctctgtacaaatatttatgaacatcgtgagtgggagtacaagcttttactccatagaatcaagtaagtcttttttca

SEQ ID NO: 9787 - DNA, 1017 bp, Diabrotica virgifera
  misc_feature (2)..(35): n is a, c, g, or t
  misc_feature (38)..(200): n is a, c, g, or t
  misc_feature (202)..(302): n is a, c, g, or t
  misc_feature (307)..(383): n is a, c, g, or t
  misc_feature (397)..(432): n is a, c, g, or t
  misc_feature (434)..(462): n is a, c, g, or t
  misc_feature (464)..(532): n is a, c, g, or t
  misc_feature (553)..(616): n is a, c, g, or t
  misc_feature (619)..(640): n is a, c, g, or t
  misc_feature (662)..(684): n is a, c, g, or t
  misc_feature (692)..(754): n is a, c, g, or t
  misc_feature (763)..(787): n is a, c, g, or t
  misc_feature (817)..(834): n is a, c, g, or t
  misc_feature (938)..(950): n is a, c, g, or t
  misc_feature (952)..(1003): n is a, c, g, or t
gnnnnnnnnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccnnnnnnnnnnnnnnnnnnnnnnnnnnnnnnnnnnnnnnnnnnnnnnnnnnnnnnnnnnnnnnnnnnnnnnnnnnnnngtttttcacctggnnnnnnnnnnnnnnnnnnnnnnnnnnnnnnnnnnnnannnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnatggatgaaacaaaactgtcnnnnnnnnnnnnnnnnnnnnnnnnnnnnnnnnnnnnnnnnnnnnnnnnnnnnnnnnnnnnnnnnagnnnnnnnnnnnnnnnnnnnnnnctattaataaggtttgttaggnnnnnnnnnnnnnnnnnnnnnnncattaaannnnnnnnnnnnnnnnnnnnnnnnnnnnnnnnnnnnnnnnnnnnnnnnnnnnnnnnnnnnnnntttttttgnnnnnnnnnnnnnnnnnnnnnnnnnaaccggggaaatttattgggaaggtcaaannnnnnnnnnnnnnnnnngacctcatggttggattaaaagttaataatggggggaaacgcttaaaataataaaggtttgtttcacttttttaaaattttccttgaatttggggtttaaaacnnnnnnnnnnnnncnnnnnnnnnnnnnnnnnnnnnnnnnnnnnnnnnnnnnnnnnnnnnnnnnnnnccgaaaaggggccc

SEQ ID NO: 9788 - DNA, 608 bp, Diabrotica virgifera
  misc_feature (31)..(49): n is a, c, g, or t
ctccattctggtactacaaaatatgcacctnnnnnnnnnnnnnnnnnnncatagttatgactattaatctataatttaaaataaatgtccgcgaaagctgctcaagcaatagtattaacattagctggatgtatgctaaacaatgtttttcttgaatatattatcaaattagacccaggagcagggcatttgataacattatgccagtttttgtttattgctgtacatggactcatttttacctcaaagtttggaacagttaagcccaaaattccattaagtggttatatgacgttagtagtattattcttcactacaagtgtggtgaacaattgggcgtttgcttttaatattcctgtgccattgcatatgatctttagagcaggttcactaattgcaaatatgataatgggtattattgttctgaagaataaatactcactagataaatacatatcagtacttttaattaccttgggaattatcatttgcacaatttactcctgctcacagatgccaatagtatgtgtatactgtgaattaagagtataaactcaatgtgatgcagtagcagactgttacttctggtctctcgttgatatattcct

SEQ ID NO: 9789 - DNA, 659 bp, Diabrotica virgifera
  misc_feature (2)..(437): n is a, c, g, or t
  misc_feature (441)..(441): n is a, c, g, or t
  misc_feature (449)..(533): n is a, c, g, or t
  misc_feature (537)..(538): n is a, c, g, or t
  misc_feature (555)..(555): n is a, c, g, or t
  misc_feature (557)..(558): n is a, c, g, or t
  misc_feature (606)..(606): n is a, c, g, or t
  misc_feature (634)..(634): n is a, c, g, or t
  misc_feature (636)..(656): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggnccgcgtannnnnnnnnnnnnnnnnnnnnnnnnnnnnnnnnnnnnnnnnnnnnnnnnnnnnnnnnnnnnnnnnnnnnnnnnnnnnnnnnnnnnattnnataagaaatttattttnanngtaaaagcttaatttttttaaagacgagaaaccctatagagtttatanattataaatagttttttagtataaattnannnnnnnnnnnnnnnnnnnnnggg

SEQ ID NO: 9790 - DNA, 885 bp, Diabrotica virgifera
  misc_feature (403)..(425): n is a, c, g, or t
ttccacattacatttatttgtataagtatactatttatttattcggtagcatttcaagctactatccatgttagtagagaaatgttagaattatgtgaagttatatctcaatgtggtgaacgtctttttagtccagaagaaaaaccaaacgatcctagaatagtcatcagttttggagaactctttgcgatatacacagcaatttccgacaaagtagttggtattttacttagggcacgtaaatacaacttagttgacttcgaaggagaatgtttgtttcaaagacaagacgatcatgtaccaatcatacttgttaaaccaatcagtgaaatcagaaccttcttaaaagagaggatcgcgactgcgacaaaggcactgaaggagactggagaaatgtagtagnnnnnnnnnnnnnnnnnnnnnnncttaagcactaacatttaaccaaaaaatggaccatatttctttaagaactagtatctttccacattacatttatttgtataagtatactatttatttattcggtagcatttcataaaagttactttctttttatcttggagattgtattatttttaaatatgacattattattcttgatgaaaaatacagtggaaaatatggacaatctaccaaaacaaaaacacgcaacttttgagaaagaatctgacataggtacttgattatccattagaatgattttcactctataatagatgaccataccccaaacctagcaaagcagatgagaaacacatggccggttctgaggcctacattaagggagtagggattcaggtagcaattatgcatattgtagagttaacaccacaacgctttatctgtgcttcactgatgcatacatagtaaggttttttgagt

SEQ ID NO: 9791 - DNA, 889 bp, Diabrotica virgifera
  misc_feature (609)..(609): n is a, c, g, or t
cgaaaaaatactgtatcgctatatcccaaagttaaaaatataacctgtaatcaaacatgtatgtaactacttacttcttacactgaaaaaatatcacattcatatacaaagatatcattttttatcatttctgaagaatatcttgaaagctggttgcaatgttattcgttgcaggtgtagatatataaaaatatgatctctgttgtaatagttcttaagcaattagaagaaaatgaagtacttaactcttaaaaatacggtaatcttaaaatactgtagttgattgccatcctctttttttctttctcgactatcacgaccctaatagcagcgaataccggatgtatagggctagcaacgtactcgaagaagttaaataccaacgtctaagatgggctggtcatgtccatagactccctagtaacagccttgccaagttaagcggggaagaagccccccaggaaaaagggccttaggacgctcacgaaagcgatggagagacaatatatggtcagatctacgaacaatgggggtatccactgacccaactatcatggacgaccgttcgaggtggaagcgagttgtgcagtcagccaagagccaccctgngttgtagtgctacgaggagaattttctttctctctttccttcttttttcctcctccggttcctactgtgatactcccccataaaccatttttcataaatatttaagtagtttttaaccctttgcgtcgttgtcatgtcatacatgacaccattacaactcgtataaatttactaacaattttgcccacaggtcgccctgcatgtcatacatgaaaatcataaaacacgaaatttagtcgttggcatctctagcatgccgtaaatctaaagtcttataact

SEQ ID NO: 9792 - DNA, 884 bp, Diabrotica virgifera
  misc_feature (835)..(835): n is a, c, g, or t
ggagaatagtttataatcaatcgaaggaccggttcttgtggttcttttattgtttcgttaatgtcaagagtgcgtagtaggtgaagtatatcagtgttttgatttaagaatcatcataattaagaagatgttatacccatcgttcttgaaaatctaaatttccatgatcattgatcacaccacacctgaagtccaatcgactaacttttagttctaaaagtggaaaccatgggggttgagttgacactagttttgttgctttttggcagtgttgtgagtcaagatctcgtatcaccgtgccctaactggttcaaatatgaagccaggaagcctgacgagccagatcgaatttatggtgttcttacccttatgtcagagtctgatcttggtgggatatggatgcgagtgaactttgataggcctagtttacaactagggaactggtttggtatagtaaagactgatgacaacaccatgtacaaaattcaagctccgaacaaaaagctactagctaacgtacctacaaaggttcgcttttatattaaatacgacaccagtcagccacctccgaagttggtggaaattcgtcttaatgccaaaacagtttgtcctgaaaaaggagcgacgaccgaggctccagcaagtactgacatgtacttcacaagccctgaattgaatattccgagtactcaaagaccttttgaaagacctacacgaccatcaagaccatcaagacctactgtgcctataaatccgccagtcagctctatcgataatttttacgaaaacaacaatggaaggccctctaattccgatgacgatgatttctttatgngagactttgcctggttgggaaaacctagaccgaaatagacacagtatct

SEQ ID NO: 9793 - DNA, 689 bp, Diabrotica virgifera
  misc_feature (12)..(42): n is a, c, g, or t
  misc_feature (45)..(381): n is a, c, g, or t
  misc_feature (388)..(425): n is a, c, g, or t
  misc_feature (445)..(458): n is a, c, g, or t
  misc_feature (461)..(483): n is a, c, g, or t
  misc_feature (491)..(513): n is a, c, g, or t
tccccatggcgnnnnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggagtgagccaggttggcttctatctttactttattaatatattataacgccataggaccatttagatgatataatctgtatattgaaatacagatgctccataaaacaaatgggtgaccgctccagagatccatcatttctcacccgcgtgtgcacctattaact

SEQ ID NO: 9794 - DNA, 666 bp, Diabrotica virgifera
gtaccaacataaacagccagtgggaccactcaagtgaaataaaacaacgcataggaaaagcgagatcagcgttcataatgatgaagtctcttttcagaagccacgatttacctcttgctaccaaaatctctatcatcagatgctatgtattttctacgttattatacggagtagaggcctggacactttccgaggcttctttgagaaaactcgaggcatttgagatgtggtgttacaggcgcattttgagaatttcgtgggtggatcgtgtgactaatattgaggttctacgtagaataggcaaggaatgcgagattattaacataatcaaagagcgcaaactagaatatcttggccatgttatgaggaatgaacagagatatggcttgttgcaactcattcttcaaggcaaggtatttggaaagagaggaccagggagaagaagaatatcttggcttcaaaacctgagaaagtggtttaatacatcgacaaccggactattcagaatagcagcaagcaaagttaggatagccatgctggtcgccaacatccggaacggataggcaccttaagaagaagaagttaaattgtggcttattacccagttagaatattaaataaatatgatattcgcgatgcagtcacttatatggttgatcctgattc

SEQ ID NO: 9795 - DNA, 838 bp, Diabrotica virgifera
  misc_feature (245)..(262): n is a, c, g, or t
  misc_feature (813)..(813): n is a, c, g, or t
aaaaagtgcagtataaccgggatctgtcactgggttataaaagtatagaaatcctagtaatttgagtatattttgtgttttagttttcaagtgttaagttaaataatgtccaagccagagcaagttttgcaaatagagccccaacatgagcttaaattcaaaggtcctttcaatgaaccttctgggacatatatgaagcttaccaaccctactgataaaagagtagtatataaaattaagactannnnnnnnnnnnnnnnnngtgcgtcccaattctggcattttagaacctaactctcacactgagatttctattttcttccaaccacaaccgttgttgttcgacactgcggaaaagaacaaacacaaattcatggtgcagacagcatttgctcccgaatcggacttcaacatggatcagctgtggaaggaaattactcctgatcaactgatggattccaagttgaagtgtgtcttcgagttaccgcctgatcagacagaaggcaccactgaagacgctactaagtttagtcccaagacagttgctgctaattctgcagtgccagacaatagtaacgtagagtgggagctaaagaaagctgcacaagaggtacagcagcttagagaagaagaaagtcaattgaggcagcaacatttacgactaaaagaagaaatcctccaattgaaacaacagctaggccaatcacgagccgccccagtcaacagatacgccccacccgtacaggaacagaccattccaatggggtatgtcgggtttggcagtacttctgagcttcataggcatcatattgngcaattcgcgctctgaaacggagtc

SEQ ID NO: 9796 - DNA, 1081 bp, Diabrotica virgifera
  misc_feature (19)..(37): n is a, c, g, or t
  misc_feature (41)..(67): n is a, c, g, or t
  misc_feature (84)..(122): n is a, c, g, or t
  misc_feature (124)..(137): n is a, c, g, or t
  misc_feature (148)..(182): n is a, c, g, or t
  misc_feature (219)..(245): n is a, c, g, or t
  misc_feature (284)..(316): n is a, c, g, or t
  misc_feature (391)..(414): n is a, c, g, or t
  misc_feature (478)..(497): n is a, c, g, or t
  misc_feature (534)..(567): n is a, c, g, or t
  misc_feature (589)..(609): n is a, c, g, or t
  misc_feature (631)..(631): n is a, c, g, or t
  misc_feature (678)..(714): n is a, c, g, or t
  misc_feature (757)..(777): n is a, c, g, or t
  misc_feature (812)..(829): n is a, c, g, or t
  misc_feature (1018)..(1061): n is a, c, g, or t
cttctaatttagaagagcnnnnnnnnnnnnnnnnnnnttgnnnnnnnnnnnnnnnnnnnnnnnnnnnctgtgaagtgttattcnnnnnnnnnnnnnnnnnnnnnnnnnnnnnnnnnnnnnnngnnnnnnnnnnnnnncatatttatannnnnnnnnnnnnnnnnnnnnnnnnnnnnnnnnnnctaggtatgagcttacaaataacattttattacaacnnnnnnnnnnnnnnnnnnnnnnnnnnncaaattctcatatcttcaaatatgctattatttatatcnnnnnnnnnnnnnnnnnnnnnnnnnnnnnnnnnatatcaccatatacatttaaatgtatttaaatttaataatgatgaaaatattagtattaaatgaccgcatattcnnnnnnnnnnnnnnnnnnnnnnnncggaattcagcgacatttttttcccctgtttattaacaacctgtctttttgtattacatatccnnnnnnnnnnnnnnnnnnnncactcccaatggccgcggaattgtgaccgtgctatcnnnnnnnnnnnnnnnnnnnnnnnnnnnnnnnnnntaatgaaggattggatgacccnnnnnnnnnnnnnnnnnnnnnctatcaagaattttattgttangttcaaaagcttaaatttcttttcagactagagaccccaataagtcnnnnnnnnnnnnnnnnnnnnnnnnnnnnnnnnnnnnnctattaccaatttttttaattggcgggactaaaacaaaacacnnnnnnnnnnnnnnnnnnnnnacaattaaaaaagtttttggcccccactttcttgnnnnnnnnnnnnnnnnnnccccccgctcacgcccccaatttttttttggaggcccccccccgcaaaaaaaaaatgccccccccccgggcgggcttaagaccttaatttttggtaagcctcgctttttataatctccccccccttttatattttatctatacctcggttttaccccccttccggcccccgcgccgggggggcgctctnnnnnnnnnnnnnnnnnnnnnnnnnnnnnnnnnnnnnnnnnnnnccctcggcccccacccaatc

SEQ ID NO: 9797 - DNA, 714 bp, Diabrotica virgifera
  misc_feature (14)..(14): n is a, c, g, or t
  misc_feature (16)..(16): n is a, c, g, or t
  misc_feature (24)..(25): n is a, c, g, or t
  misc_feature (32)..(33): n is a, c, g, or t
  misc_feature (67)..(85): n is a, c, g, or t
  misc_feature (104)..(104): n is a, c, g, or t
  misc_feature (132)..(132): n is a, c, g, or t
  misc_feature (334)..(334): n is a, c, g, or t
  misc_feature (398)..(398): n is a, c, g, or t
  misc_feature (409)..(409): n is a, c, g, or t
  misc_feature (542)..(542): n is a, c, g, or t
  misc_feature (579)..(579): n is a, c, g, or t
cttcctggggcggngnaatggaanngaggaanngggaggagcccatgtagaggaagaaagagagagnnnnnnnnnnnnnnnnnnnggagagaggagaagatagnaaaaggatgatggtaggtgaaagaagantaaatgaaagaaaaaggttgagggtggaagatattagttataggtatgaaagttattatggttggagtagagatgaagtattatatgaatgaagataaagtgaatattattgtttattatgaagaagggaagaattgtgtaggggttgtggatatgtatgaaaatgtggttgttattgtggaagaattagttgaaggggttngtttagtataagagttaggattagaattgtagttagtagattatatggtattggaaggagaatntaagatatatntgaatatgtaaggagggttaagatagatagaattaggagggagattgtaagaagatatgttatagaagaagttgaagatgaaaatggagatgaggatataaaagtagaaattgagggtgaggaagaataaatnattgaagaaagtaaggataatgaagagagaaaagaanaaaggaagggttttattagaattgaatggaagtattgttatatgtggggtttgagttataagaaatatgaattgaatttgggtagtggtaattattatcttgtaatgagaagagttgtttttaaggagaaagata

SEQ ID NO: 9798 - DNA, 721 bp, Diabrotica virgifera
  misc_feature (79)..(96): n is a, c, g, or t
  misc_feature (124)..(144): n is a, c, g, or t
  misc_feature (280)..(313): n is a, c, g, or t
cgacaaaaatcacataaaaatcgtggtgttcatggtgacgcttggcgtcgaattatcttttccagcgagggtagaagannnnnnnnnnnnnnnnnncacacttatgggatactatagggacccnnnnnnnnnnnnnnnnnnnnncgttaaaatctgacatgggaatgaatgaggtatataaaacaagctggtttgcatttgatgtcattaccgtgttcgttttctatgcattttcatcatccatcatcttcttttgagtcttggtttttgtttgatccgnnnnnnnnnnnnnnnnnnnnnnnnnnnnnnnnnngcactcataaaatataccagcgtagctggacttctatcttgacattattggattaaaaaacgcgttttctgctgactaagcgctaaaataaatgtggccagtcactttaacgcgcagtttattccatcatttttggtgtgttaattaatactataatggacgttagacgttaacgttactgtggccccagcatcatgagaacgggcccttaactcattccccatatcttccacgatttttgaaaaaacacactcctttactcaattggaattcgaaatttggtaaaatttcggaaaaacttttggaggactattcggcacagaatatttctcggggattttttgtggggatattttgtccaaaaaaatttgtggggattacttgtccgggatttttgtgcttattttt

SEQ ID NO: 9799 - DNA, 240 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(234): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnntatact

SEQ ID NO: 9800 - DNA, 310 bp, Diabrotica virgifera
gcctagtgaatcatgagagcatcagaaaatatttactccttacgaatttgtataatgcttaataactagactacagatagtaaatagataggggatgcctaggagatagagatgataggtgacaatgaatatacttgaagataatgataagagagggccattagagatctttataagccttctatctaaaatcctgtatcttgtaataattaatgcccaaccttattctggatgacctaccactattgatatctaaacagatgttgatgaaccacacggcagattaaaggtttcgtatttaccagatggt

SEQ ID NO: 9801 - DNA, 567 bp, Diabrotica virgifera
  misc_feature (2)..(17): n is a, c, g, or t
  misc_feature (19)..(61): n is a, c, g, or t
  misc_feature (69)..(566): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9802 - DNA, 841 bp, Diabrotica virgifera
  misc_feature (24)..(45): n is a, c, g, or t
  misc_feature (535)..(552): n is a, c, g, or t
  misc_feature (826)..(826): n is a, c, g, or t
gtgattcaacaaataataaatcannnnnnnnnnnnnnnnnnnnnnctttcattcagtatttagaagataaaagaaaggaagccacaaagtttaagacacaagggaagaaaaagaaaataaccgttccggcaggacaaagtatcgcccattctgaaattagtttaaaagatctaactcgaagcatctacttccacacctcataaagccgttgagccagaaatcgtagatgattcagaggagaacaatgttttggacgaccactttccagtaggcagggattcatcagacgatgaaataaatgaggtgcaagagatggaagaagaaagcgaatttaatgaaaaactcgccattggtgccataaaacctcccaaaaaaatttccagacgaggattgtacattgttccagaaatgcgacaaattgtggtgggattagtttcaaacatcgtattttcactattgccgttataataaagtttattcatttaaaatgtagcaatggttttccttttatggttctttcataaatggaggtagnnnnnnnnnnnnnnnnnnggccactggaacatttttttggatttaattggtgcaaagtttaaaatccggtaggattactttgcaccagtaagcatattgtagccaaatattattaaaatatcgagtggtgcaaagtattgactcttctagggtatactttgcaccactataaaaactaggtttttcttttaattatgcaatatacctaaaaaatagctaaattaaaagctatattacgacctggttcatagatgtatataataaaaaggtcagatcttcttttcagtaactntatatccactctaag

SEQ ID NO: 9803 - DNA, 729 bp, Diabrotica virgifera
  misc_feature (493)..(513): n is a, c, g, or t
gtaggcatgtttgtgctaaggtgggttgggttcaatcgggctatttttggtcccagaatgtgtggtttggtttgtgacctgtatttttgttacaccctgtattagcgagttgttcactgtcttcagtaaatcggaatatttgttcggcattgcgcattcctgtccaatcgcgaatgatcttgagccatgagatctgcttctttccaattcctctgcagtccccgattttatctatcatgataagctaaaagattctctaccggtcgcttctaagaagatgccctcggtatgcaatttttcttatatttataatgttaggtaactcacgaacgtcttttctctatttagtaaagcttagttggtctgaatctcggtcgaggatattcgatgcattatatgtaaccacatctcaaacgcttctaggcgattgatcatatcagcgttcagagaccaggtctcgatgtcatgtaatatcttattacaagagattaannnnnnnnnnnnnnnnnnnnngagaaatacccagtagttggctgtataccataattaataatcatacagagcaggtaaaagcttcgtttgtatagtgatataggaggtttattgaagaactattaagaattcatccagaaggattcgcggagggttttcgatctagatcggatcatcttcagtgcctagaatgaagtatgtccacttttttgcatagaatctactgtgttaatactt

SEQ ID NO: 9804 - DNA, 908 bp, Diabrotica virgifera
  misc_feature (743)..(743): n is a, c, g, or t
  misc_feature (796)..(907): n is a, c, g, or t
gacataataatcttggaaatcctctaaaaatatatcttgcgcagtttatggcaattaataacgataaccacacattaccaattataaattgtgttaatcactattgataatgttgttattagagaacgtaatttaatctagaagcaacctaattctttctagtgatactaaaatggacggatttgctttttattttttaatgggtttggttcatagtatgtatatttttgatggagttaattttaatggaaattgctcattcgacgttttaagggatatatcaggccatataaacacatgtttgattaaagacccggatgccctaaaactatatttttcgcatgcacaagaacacttacctttacctgagtttatagaaaacagatgctcgattaattcaaatttaacagactgtgttgagaaacccatggataatttaaaaccttgctttgagtctgatttctggcaagctcttaaaaaatggaaagtaatagatgagcaggttctttctaagctttgtgaagacaatggtcagaaagctgcacgcatatttaaatttgaaggagaaaaatgttgggaccaaggactcagaaccgtttcaaatgaatgttccaaatttataactaacttaccaaatactttagccccctgcaggaattttaaccgatttaagcaatgctttgtaagtcacctgtcagaatattgttcaaccgaagctaccaattttctacaaccaatattanatattctttctgatgatatatgttagttaataaactaatgtttgataaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9805 - DNA, 189 bp, Diabrotica virgifera
  misc_feature (7)..(34): n is a, c, g, or t
  misc_feature (54)..(67): n is a, c, g, or t
  misc_feature (70)..(92): n is a, c, g, or t
  misc_feature (100)..(122): n is a, c, g, or t
  misc_feature (152)..(183): n is a, c, g, or t
attttannnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9806 - DNA, 801 bp, Diabrotica virgifera
  misc_feature (36)..(52): n is a, c, g, or t
  misc_feature (204)..(228): n is a, c, g, or t
  misc_feature (322)..(341): n is a, c, g, or t
  misc_feature (420)..(492): n is a, c, g, or t
  misc_feature (566)..(588): n is a, c, g, or t
  misc_feature (600)..(622): n is a, c, g, or t
  misc_feature (624)..(679): n is a, c, g, or t
  misc_feature (710)..(727): n is a, c, g, or t
  misc_feature (750)..(774): n is a, c, g, or t
  misc_feature (776)..(789): n is a, c, g, or t
tttatcttatctttaaaatcataaaatctctctctnnnnnnnnnnnnnnnnnagtaaaaatctctctctcttcaacggataagttaaatctcagtatccggcgagatgaatctctttctcttcttctaaaagaaaaatctcacttttcgtacctcgcgtatccagggatctcctcaattaatcaatctatcatcactcactacnnnnnnnnnnnnnnnnnnnnnnnnnatctcaaaatttttcaccgtaaaataaatactttaaatcaattttttcgtaacgaaacgttactcgtttttcaaataatcatctcaattttttnnnnnnnnnnnnnnnnnnnncttactaacaatatcatcttatcaattaaataacttttcaatattatctaatattaaatatcttttagggatcgagctnnnnnnnnnnnnnnnnnnnnnnnnnnnnnnnnnnnnnnnnnnnnnnnnnnnnnnnnnnnnnnnnnnnnnnnnncacgttatctaatctaattttcatcatcatctaataattttcatttttcacaaattttttaatctaaaatatcnnnnnnnnnnnnnnnnnnnnnnngtaatcggatcnnnnnnnnnnnnnnnnnnnnnnncnnnnnnnnnnnnnnnnnnnnnnnnnnnnnnnnnnnnnnnnnnnnnnnnnnnnnnnnccctgttattaaaaacacgtctttttggtannnnnnnnnnnnnnnnnncgcccactggataatttgaagannnnnnnnnnnnnnnnnnnnnnnnnannnnnnnnnnnnnnagttttttaatg

SEQ ID NO: 9807 - DNA, 52 bp, Diabrotica virgifera
  misc_feature (6)..(23): n is a, c, g, or t
  misc_feature (25)..(37): n is a, c, g, or t
  misc_feature (39)..(51): n is a, c, g, or t
caaagnnnnnnnnnnnnnnnnnncnnnnnnnnnnnnntnnnnnnnnnnnnng

SEQ ID NO: 9808 - DNA, 850 bp, Diabrotica virgifera
aaatttcgttgtaattttatagcatacgtattcttttatagtaaaagtaagcagtattcgtttgtgcatcgaatattaagaaatttaagcgtagatcgtccgcacgtaccaatattttctattaaaagtgcttttagtaagtgtcgtgaagtaaaacttatagagatttatcgtattgtaatctctcatttacccgacaatatgaatacaaaagtgttctcgtgacgagaagacacctcgccttttttgttaactcaaataaatagacgaaattttaaattaacattatttttctctttttaatacaaataatttccttaaacacatcatttacactcgtacatttttatggaaggagcagtagaaacagttgcagtaaaaagtttagagtatcgttcaatgaaaatacaatccgttttctccaaatctaaatagcggcatcaccgtttgatgtgtcatgtcatgtcatgtcatgtgtcacttcgtcatgtaaagtttgcttataggttatggtcgttatgttgcaagctgcaatttttattgttacgtctctcttacaatcgcttcgagtttaaaaacacatttaacacgtaagacagacgctgttagtaaaacactacactaatctattgtacctacttggaaaatcctagtcgactataatttttgtgtaaattgaggtgtaaaggaacctagtagaacacctagtaaaacgcttagcggaactatggtggacgtcggcgtttgccaataggaagaccaaggaagagtgacaaggtgacaaccgctgctaaaagagatattgagggtggacaacgggaggagagcagccagggacagagctaagtac

SEQ ID NO: 9809 - DNA, 913 bp, Diabrotica virgifera
  misc_feature (2)..(839): n is a, c, g, or t
  misc_feature (842)..(842): n is a, c, g, or t
  misc_feature (845)..(903): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggngtnnnnnnnnnnnnnnnnnnnnnnnnnnnnnnnnnnnnnnnnnnnnnnnnnnnnnnnnnnncaattttttt

SEQ ID NO: 9810 - DNA, 919 bp, Diabrotica virgifera
  misc_feature (118)..(136): n is a, c, g, or t
  misc_feature (172)..(190): n is a, c, g, or t
gaaaaatttataccactctttccttttaagaggtattatcaagattataaagcaagacttacatcatttcaaaaacatcgactccgcaccacttcgtctttaagacgctcatacattnnnnnnnnnnnnnnnnnnnatatcgtacaaggaaaaacaattatcgcgaaccttnnnnnnnnnnnnnnnnnnntctctctccggagatctaacacgcaatctcgtttttcgaacgaaagtgaatccttattttaatacggttggttctcattgagatttgacatcacttgttttattagtgatttttgtgcgatttctgggtgaaaactagcaatttttttaactctttatagtggtgatgtgttaggcttaccgttgtaaaagcgacagcagcaggaaataagtgcgaattacattttacaggtaaataaatatttctgttatgtgtgcgtagatgaacattcaataaatactcctatattcttagatatcgcctcttaaatggttaataatttgaaaattaacacttcaatgtaccttattacataattaaaattacatgggttaagttataaaatgagaaaaatttacattgtaaaattaaaagtaacataaaaatcaccattttaccagtggtgtaggtacgaaacggtacgaaataaatgaaattataaaatatatttgtggcaacttcgaaaatggaattaatagcgtatattgttattacatattattgactttttttgttaaacattttattgcttgattttattttgtttatatgtaaaaaaattatttaagagcacaggcgcaaatattttacggctatctcttactttttctttttttacacggcaattatatgaaataaaagttttcactggttatggatacgtacataaacattacttgacaatgacat

SEQ ID NO: 9811 - DNA, 778 bp, Diabrotica virgifera
  misc_feature (2)..(18): n is a, c, g, or t
  misc_feature (20)..(62): n is a, c, g, or t
  misc_feature (70)..(182): n is a, c, g, or t
  misc_feature (191)..(766): n is a, c, g, or t
cnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaagc

SEQ ID NO: 9812 - DNA, 554 bp, Diabrotica virgifera
  misc_feature (2)..(18): n is a, c, g, or t
  misc_feature (20)..(68): n is a, c, g, or t
  misc_feature (70)..(553): n is a, c, g, or t
cnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9813 - DNA, 693 bp, Diabrotica virgifera
  misc_feature (423)..(437): n is a, c, g, or t
  misc_feature (591)..(608): n is a, c, g, or t
ctttggattccacctcacgtatcatggaccccaaaggatctacagctgggtagatacccaattcagcaatggcacgggacaatacagtggtggcgtccaagtgagcgaatgtggtggctggggcaggatctgtcaagtcatcagcaggtacatagatagcctgtactgggtatctacccagctgtagatcctttggattccacctcacgtatcatggaccccaacattattggagccgaacattacaaagttgctcgtgatgtacaaaagatcttgcaagattataaatcactacaggatattattgctatcttgggtatggatgaattgtctgaagatgacaaacttactgtatctcgtgctagaaagatccaacgtttcctttcacaacctttccaagttgctgaagtcttcactggtcannnnnnnnnnnnnnntcctcttgaagaaaccattaagggattccaaaagattcttgctggtgaattagatcacttaccataagtcgccttctacatgctaggacccattgaagaggttgtccaaaaggcagaacaattagctgaatctacataaatgctaggatacctnnnnnnnnnnnnnnnnnngtgattccatcaatctgcagagagaaagatgtttctttttattactatcgtgtaaagaacttttcattacacctccatatttttt

SEQ ID NO: 9814 - DNA, 80 bp, Diabrotica virgifera
  misc_feature (7)..(60): n is a, c, g, or t
gatgggnnnnnnnnnnnnnnnnnnnnnnnnnnnnnnnnnnnnnnnnnnnnnnnnnnnnnnctgggatgaaagggtggatg

SEQ ID NO: 9815 - DNA, 745 bp, Diabrotica virgifera
  misc_feature (138)..(162): n is a, c, g, or t
  misc_feature (166)..(190): n is a, c, g, or t
  misc_feature (220)..(235): n is a, c, g, or t
  misc_feature (238)..(256): n is a, c, g, or t
  misc_feature (351)..(380): n is a, c, g, or t
  misc_feature (562)..(587): n is a, c, g, or t
  misc_feature (589)..(609): n is a, c, g, or t
  misc_feature (696)..(696): n is a, c, g, or t
acttcaacgatcagttaattcagtatccgtgagagaatcacttcaccttataaaagaaaaatttcacctttcgtacctccgtgtatccagggattcataattaataatctctcatcacttcatcaccctcgaatcctnnnnnnnnnnnnnnnnnnnnnnnnncacnnnnnnnnnnnnnnnnnnnnnnnnncttttcgtaacgaaatcgttactcgtttcnnnnnnnnnnnnnnnnctnnnnnnnnnnnnnnnnnnnctacttcactcaacaataatatcttatcaattcaaataacttttaatactaactaataactaaataatttttcagggatcgagctttaaaaatcnnnnnnnnnnnnnnnnnnnnnnnnnnnnnnaatcaaaaattcaggatttaaaaatttttcatcttttcaaaatcacgttataattaattttcactattcataattttcatttttcacaaattttttcattaaaatatcaaattttaaattcatttaaattctcagtaatggatggattaataattaagtattcaaaaaattggtatctttannnnnnnnnnnnnnnnnnnnnnnnnnannnnnnnnnnnnnnnnnnnnncacctcgtttaataaaaaacatcgtctttttcgtattcaaataattaaagtcttcgcctcgcccactcgattaaattttgaaacgangccgcgggtatcttcttgaaccggttgctaaagggtaagcataaattca

SEQ ID NO: 9816 - DNA, 503 bp, Diabrotica virgifera
  misc_feature (2)..(449): n is a, c, g, or t
  misc_feature (454)..(475): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgnnnnnnnnnnnnnnnnnnnnnngtatctttattaaaaatatatactgttt

SEQ ID NO: 9817 - DNA, 842 bp, Diabrotica virgifera
  misc_feature (7)..(41): n is a, c, g, or t
  misc_feature (145)..(170): n is a, c, g, or t
  misc_feature (553)..(570): n is a, c, g, or t
ggtggtnnnnnnnnnnnnnnnnnnnnnnnnnnnnnnnnnnnatttgtggtgtcaataaactaaatcacaaacagttctagtacagtgatgccaaattagttagttttaagaaaataaaagttcgcttataatatggcgaacaacnnnnnnnnnnnnnnnnnnnnnnnnnncggtaagctttagaaaaaaatgttataggacttttttgttctacattgtgtattgtatccatatcttgaaggaacgcactattttcggggacaccctgtatgactctatgatataattcaatattattattgtagacaatatttaagcaaggttgtagttgattttaaatttaaacttgtacaataaaaaaggactagaaagttaaaaccttacttcaaaccgaaacgttttattcccggccgctacataacccatccgagctataaatattttcgacagaatcactgttttttgcgtaaagtcaattataatttgatcaaaaactgcatcaagtaaacattcgtttgacacaaaggtatccacaattgaaatgaccatttgnnnnnnnnnnnnnnnnnntctacgacagaaagtatataaaaaaactcagataattccattcttcttctagtgccaataatgaaggttggttataaccattgcaaattcgtctcgatcttctgcttttctgaaaagcgtctgtatgtttaaccagtcgcgaaagtttttcagccagcatatttgtctaccaggaccactttttccttcgattttactcttcatactcagctgtaataattcgtacttatcatttctaagtatgtgccccaaatatgctggttttctctttt

SEQ ID NO: 9818 - DNA, 767 bp, Diabrotica virgifera
cccacgcgtccgtacgagaacataaacacacccattaccacacgccctctcaggacattcttggagttaaagcatgtataatatgtaagtcaccatgaccgcaacattttccgaacctccgaccataacattggaggagacaaccgaaaacgttacatatattcaatcctatttaaaagggatccagaaagagatcgttggacattctgttgctcaacctaaatcacggagagaagaacaagaagaggaaaatgaacaggaataaggaacttattttgttgaccactatgatcactactattatcaggctaaggcctcaacccaacccgtgatgacagtagtgccaacaattgctactagtgaatatactgatgaatacgatattaatcaagagaatgatgaagaggaagaggacggaaaacagcaaattatccatcaacgtgaagataaccagtttgtgattacatacggcaaagcgtaccaaagagcgactgaaataccatctgataataattcctatgaacttatctatgtgcatatcgttcaagatcccttggatattaaagaaggagatcagactgacatagatcaagatatgactgaggatgatttcgatgatgctgaagatgaatgagtagtagattcacacaaagacgacaatagtattatacctagactattacctataaaatcccaagttgttgtgcgagctcacaggtgctactattgccactataccaatctccatcggtatcttctttcctcgc

SEQ ID NO: 9819 - DNA, 144 bp, Diabrotica virgifera
ctgattatcagaataaattacctcaggcataacagcgtacttttattggagagctcaaatcgataatatagattgcgccctcgatggtggattaaagttataatcggggagcagctatttattaagcctggtcgacttttaaat

SEQ ID NO: 9820 - DNA, 545 bp, Diabrotica virgifera
  misc_feature (2)..(36): n is a, c, g, or t
  misc_feature (161)..(180): n is a, c, g, or t
  misc_feature (278)..(313): n is a, c, g, or t
  misc_feature (327)..(353): n is a, c, g, or t
  misc_feature (456)..(483): n is a, c, g, or t
cnnnnnnnnnnnnnnnnnnnnnnnnnnnnnnnnnnnaggaatcgtggttacaaattttatgatattgatagttgtttagaattgaagatacaatgtatcattgtgaaaggagaaaattttatttattgtatcgtgggtatcagggattgttaattagtagnnnnnnnnnnnnnnnnnnnngatttaacagagctgatgctttattattttttgtgaaaaatagatagtttatataatttttgtgaagtgatgtgttattcggttttgagtatatctgnnnnnnnnnnnnnnnnnnnnnnnnnnnnnnnnnnnngcatatttataagnnnnnnnnnnnnnnnnnnnnnnnnnnnggattttgaggtgtgagcttacgtatagacttttattaaaatttaagtgttaggtaacaattaggatgaagatttttcagatgttaatagatgtgatatttgnnnnnnnnnnnnnnnnnnnnnnnnnnnngatgaatgtttaattatagtataaatttgaagtatttacattgtatgctgtgaagataatat

SEQ ID NO: 9821 - DNA, 909 bp, Diabrotica virgifera
  misc_feature (742)..(759): n is a, c, g, or t
  misc_feature (794)..(794): n is a, c, g, or t
  misc_feature (833)..(833): n is a, c, g, or t
  misc_feature (846)..(846): n is a, c, g, or t
gcattccatcttctatcttcctgtctcgcattgtggcctgcaaattttcattttaacgctgttatatgttcagttatattttttacttttgtttcctctcttatccatttgtttgattttctctcttgtagttttattcctaacatgaatctttccatttttctctgagttatttcaattttgtttatgttggtctttgttaatgttcatgtttctgagccatacgtcagaacaggaaggatgcactgatcaaatacacgggtttttaggtactgttgtatctttctgctttttagtatccatcttaactttccaaatgctgccaacgccaatcgcattcttctctgtacttcaattgtttggttctctttattagctttgattatttgacccaggtatatacatatattcgtcaacaacctcaatattgacattatttatatttacgttttttctgtcgtttgtatttgtgatgattttggttttactcatgttcaattttaaccctatcttctccgatgtgtgtgctagttgagtcagcattgtggctagttcttcttggttggctgtaataaggacaacatcatcgcaatatcagaggtgatttagattcttcccgtttatattgatacccatgtcttcccatttcagttttaaagacgtctcccagagctaaggtgaagagttttggggatattacatctccttgtcttacacctctacgcatttctatgggattggnnnnnnnnnnnnnnnnnncccattcgactgtcatagttgctgttttatagatngtatgtaagagttgcctgtacctggagtctgttctgctngtatttagagctntttctatcgcccatattagtatctcggcactattgaacgctttttcatagtctacaagggcta

SEQ ID NO: 9822 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9823 - DNA, 316 bp, Diabrotica virgifera
  misc_feature (7)..(37): n is a, c, g, or t
  misc_feature (43)..(168): n is a, c, g, or t
  misc_feature (170)..(219): n is a, c, g, or t
  misc_feature (222)..(280): n is a, c, g, or t
  misc_feature (285)..(312): n is a, c, g, or t
taatcannnnnnnnnnnnnnnnnnnnnnnnnnnnnnnggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnatccnnnnnnnnnnnnnnnnnnnnnnnnnnnnccct

SEQ ID NO: 9824 - DNA, 791 bp, Diabrotica virgifera
  misc_feature (19)..(99): n is a, c, g, or t
  misc_feature (104)..(126): n is a, c, g, or t
  misc_feature (128)..(185): n is a, c, g, or t
  misc_feature (187)..(201): n is a, c, g, or t
  misc_feature (212)..(233): n is a, c, g, or t
  misc_feature (242)..(254): n is a, c, g, or t
  misc_feature (256)..(591): n is a, c, g, or t
  misc_feature (598)..(635): n is a, c, g, or t
  misc_feature (655)..(668): n is a, c, g, or t
  misc_feature (671)..(693): n is a, c, g, or t
  misc_feature (731)..(731): n is a, c, g, or t
  misc_feature (754)..(785): n is a, c, g, or t
attttctattttaatacgnnnnnnnnnnnnnnnnnnnnnnnnnnnnnnnnnnnnnnnnnnnnnnnnnnnnnnnnnnnnnnnnnnnnnnnnnnnnnnnnncgacnnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnnncgtctttttcnnnnnnnnnnnnnnnnnnnnnncgcccaccnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacattgatctgagtttanaccggtgtgagccaggttggttnnnnnnnnnnnnnnnnnnnnnnnnnnnnnnnngaaagg

SEQ ID NO: 9825 - DNA, 677 bp, Diabrotica virgifera
gctaccgaaagtgacagttcccatatttctgataattttaacagaatagtcttagaatacggaaatacgacaacaaggaatataggcactgccacactaaaaacagcacattatgccctgcccctcaacgaagcgaatcaaataggcttcttcttctatccagaaactcaatttccaattgatgcaaacgagatgttccaacaatatgtcgtcaaagggatgtcctacactgtcttcccccccccctagtgtttctgtgatgaactggcaaatactgatgagatagatatatttaggtagttaaaaactagacggtgatatgaactgactacacaataattacactataatttcttgaggtatgttctcctgagctagataaactatcatgctctgatgtacgactgtcaggaatgttcgacgactcgatcaataaatgtttcgatctatcgacaactatagtacattgcctatgacattgcccgctataaaaatatcatcgttgagcaaatcgactacttacttcttgtgtagcactctataagatactaatatgtgatatcctaataaaaatgtttagtcgtgaattagactatgtaagatcatcgatgaccataagacaattatgtgaatattagttttatcttctcccatctgtccttgtgctctaatattgc

SEQ ID NO: 9826 - DNA, 738 bp, Diabrotica virgifera
cagttccaacaggtcattttcccgataagttaacgtcatccggccaatcaagactagccgcacgggacgacgtgcgagtccgttatcaatactataaagatccgggctattcgcgtgaccttacatcggacgattacgtaaaacgggaggaacggtggtacaaataccaagaccggttggccaacgagcgacactacgaacatcggctcggcgactcaaggtggtagtggcaggcggagaggcaagaaacgcttacctcgcaacacagcggttaaattaaaaaagacgaggtttatcggtgtttcaaattcggtatgagatgcttagactgcgttgtttaacggttttaaagtgttgattttattgtacatataaagttgcttataacttttatgccactaaatatgaatgcgatggaaaactagcattcggcaaattttctttatacatatacggtatgtggcaaaataaacagtactgaaatttgtatgtgccatgtgccgaaacgtactgaatggtttccagacgtcgttgtaacttatgtgaatgtcgtgataatgggaggtgtttcagaatggttctcagtttcgcagaaaaaatttttatggtggagtactattttcggtcatacggaaaaggtcacgaaaatggtctaagattaaaatcaacaacggtttcagcaggacgggacaacctgtcacactgccagggagtctcttcgaatactgcgcgatcatt

SEQ ID NO: 9827 - DNA, 113 bp, Diabrotica virgifera
  misc_feature (6)..(110): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtg

SEQ ID NO: 9828 - DNA, 933 bp, Diabrotica virgifera
  misc_feature (342)..(362): n is a, c, g, or t
  misc_feature (496)..(516): n is a, c, g, or t
  misc_feature (804)..(804): n is a, c, g, or t
aattacttgttttctttcagccgttatgcctctaggaatggaattgggtgaaggttttgtcattccgttttgcaatctttgcattcagaatgtttacttcactttctgtctctgaggtgaagctggttttgtacgaaaaagtatatttacctatagaaaaatttacttgaaccatttgatttaggtatggcctggtattaattttattcagtttatatgcagaagtaccatcttgtcattcaaaaaagtcagctaattccataacaattactttaaaaaacttttcgaccttctagatacaacactagctgtggttttccgtttggttacttgttcagagcnnnnnnnnnnnnnnnnnnnnnctgttcgtctttttgcaatttccaaaattctccatttatttctgttcgtctcgcttctgtaattttttcggaacatctcctcttgcaagagatacaagatggttttacacggtgcttagcaattgtggctgttnnnnnnnnnnnnnnnnnnnnnattgctaggctctctttaaatttctttcgtttacggatttcccctgttttagttaaattgtcgttttctgccctttcaacagatacatatatctaccaagatgtcttgaataaaatggagacagtcttccttatcttcttcttcacctttggaatcagattcttcaggaacaacatttgcagctctcaaagttatatcactaataatcttcactttatttaaaccttttatgtttaaatttccggttcctcaatttcttccgtctctgaatctgacaaataaaaatcnggggtcataccattgctggaaagttttcggtcctcactttctaccgtctctgaatctgacaaataaaaatttggggtcattatcatgttgaaattttctcgttgatcactttcttccgtctctgaatct

SEQ ID NO: 9829 - DNA, 951 bp, Diabrotica virgifera
  misc_feature (156)..(168): n is a, c, g, or t
  misc_feature (170)..(185): n is a, c, g, or t
  misc_feature (478)..(478): n is a, c, g, or t
  misc_feature (735)..(735): n is a, c, g, or t
  misc_feature (769)..(788): n is a, c, g, or t
aaacagcgctagaaagttgtttcgagtgtaagcaggacaaacatatattgcgattttgcaatgcgcgcacccgcttttagtaaacatactgttttgaccgttgcgttgtgcgacagctaacagtggagccattttatatggaatgtaagagacggnnnnnnnnnnnnngnnnnnnnnnnnnnnnngtatatttactacatgcaatcaatacataaaaattataagcatgtttgttctttgttcaggggggtgtatgtataaaatttggatttgttatccagtgataacaaagactccactagtctcttaaattattgaactgtgccccctgtaagggtaagtacttcactgcactgcacggcactacacttcacttcactgctgcttagaacctatatggtagctccaatggtttgtgtctcttcagtcttcgagtctgctcactaagcattatctagcaggttcagtgcaagattantttgggtggttttctaattttaccaaatagcggctgctgtattcactcactatctccttaactgtgactacttggagaccgtctcggatttctctgtttggtataaaccaaggtgtatttgttacggtccgtagtaccttagactggaagcgttccaatatctctatgtttgagtttgcagccgtaccccgtagttgtataccatatgtctatattggttttaaggctactttatataccaataatttgttttttanactaagttttgactgtcttcccaatagccagtannnnnnnnnnnnnnnnnnnncaagttgttttcttttgttaaaaatgtgctttctgccagtcagtcctttgtctaagtgcatccctaaatacttaacgctgtcagattgaggcagatcttgtccatttactgtaacaggtggcactgtacctctgaatttggtagatgtaacctgcactgattt

SEQ ID NO: 9830 - DNA, 651 bp, Diabrotica virgifera
  misc_feature (10)..(38): n is a, c, g, or t
gacacccttnnnnnnnnnnnnnnnnnnnnnnnnnnnnncttttttcatacaccggcctccacaccgattactgatgtatctaattaatgtatataacaaagactgtgatctaattatacttcctaatacactacactaatctaatttacaatgctgacatacggacgatataattattgatatcactcacactgttaaactcgtatttcaccgagattagtaaactccgcacctgatcggcgactgtgcttacacgtttgaggtactacaatcatgcagccgcgaagaaggggacataattggactagagaaaaaagtcgcgcacatttgagcgcgaatcacaaggtcgtcgctgacaaaaccgcgccgattacaaaaagacgcgtgcccttgatcgcgcgaataaatatcgcggcatgttttacattattaaaaccataccattgattttctaaaaggttctatataaattctatttgcatactttaactatatgcattatgagccgattattcttgtcattccatctaattactttttaatgtatcttggatgaataagaagatgataaaaataacgcatatctaaatactttttactggattttgaatgtgtatgagatgagaatataagagatgagaaccatttcat

SEQ ID NO: 9831 - DNA, 917 bp, Diabrotica virgifera
  misc_feature (366)..(385): n is a, c, g, or t
  misc_feature (407)..(431): n is a, c, g, or t
cccacgcgtccgggggagcatgtctagttgttaaggggcctaacttttttattgtccaacataaacgaatgaatcagggaacggagtgttaggagaatctgagtctatagttgagttttagtttcagtattttgtgggtgctggaatgttccacagggtgatgcgaactttgagagggagacacagcttgattggtacacaggtatacaatgggaatttacctgtttagcaacaatattactacagtggtattgataaagaatcaggctataacatgttagaatcacttaaatcggccaacaaggttaggaaatctgagacttcaaaaatggccaaatttttgagtgggccgatttctatgcacgnnnnnnnnnnnnnnnnnnnncttttacttttcaaagttagcnnnnnnnnnnnnnnnnnnnnnnnnnccacgtcgttcctgctctctttatttaattccatctctacttgtgaagtattgggtgcgtattggccaaaagtgtactagtgctgactggcagggtcagcgcaaaggaagccaacaacatgcggggttccaaaccagtctcccatccaagattcaactgcactcgacactgcttgactttggtaatcggaggagaaccggtatattcagtgtggtatggccattgctctaagaactctaaactcattgtcactaggttcttactttgaatatgtccttggcagcttggcttgctacactctattacattttcactgctaagtgattcccccaatatattcatttctaagtttattatttgtcacttacatctagctggttaccagcgtgcaccgtttcctctgtgattatattaacggagaggtatagtgccagtcgagatattgtttttatggttttaacttatattgtgataatctacctaaat

SEQ ID NO: 9832 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9833 - DNA, 749 bp, Diabrotica virgifera
  misc_feature (2)..(533): n is a, c, g, or t
  misc_feature (541)..(642): n is a, c, g, or t
  misc_feature (644)..(733): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattagtaagtttt

SEQ ID NO: 9834 - DNA, 400 bp, Diabrotica virgifera
  misc_feature (2)..(26): n is a, c, g, or t
  misc_feature (137)..(157): n is a, c, g, or t
cnnnnnnnnnnnnnnnnnnnnnnnnngaatggccggattattcggaaaggggaaatatgttaaaaccatttaaagaattgggtactggaagtaatcaaaattattgggtttgcacatttaaattatgctttaggttnnnnnnnnnnnnnnnnnnnnngctacctataattaaaatacccaattttacttgtggaaactataaaattgtatattaattgtaaactgaaaaaagggtttgcagtaagggcaattattccgattttttgaatgtatggagtacacgcattaaccccggtacttttacgaaaagatgtagaaatacttttggaccacgattatcttgttattatggctgataacgttaatagaaggatgtagatataatagtattgtatttata

SEQ ID NO: 9835 - DNA, 875 bp, Diabrotica virgifera
  misc_feature (243)..(269): n is a, c, g, or t
  misc_feature (835)..(848): n is a, c, g, or t
  misc_feature (850)..(868): n is a, c, g, or t
gacaaaatgtcatgttataatgttataaaaagtttaaatggtcaacttttacgacgaagcagcatttatttccaaagtgcagaggttgcattacccagcagaattcatcaaaatgctagaaaatacagcaacaatacaccttttcctaaacccaaaccgccaggaaggggtattggaccgataacgtggaaaaatcttggaattactgccgtattaggtggcggtttgttagcatttatgtgnnnnnnnnnnnnnnnnnnnnnnnnnnnacaaatgaaagaaagacagcgtatgctcggaaaagctgctattggtggaagctttgagcttgtagatagtacaggtaaaataagaaatagcgatgagtttctcggaaaatggcttttaatatattttgggttcacacattgcccagatatttgtccagatgagctagaaaaaatggcaggtgttattgacattttagataaagctgaggatatgcccaaaatccaaccactgtttatctcagtagatccaaatagggacactccagaagtggttggaaagtattgtaaagagttttcccctagattgctaggactgactggaagtgaacaacaagttgggcaggcgtgtaaagcttacagagtatattttagtgctggcccaaaggatagtgacagtgattatattgtggaccatactatcattatgtacttagtaaaccctgaaggtggttttgttgactattatggacaaaataggacagcatcagagatatctacgtcaattagggttcatgttttaaaacatactacttcgaagagttggttataataagataatatattcnnnnnnnnnnnnnngnnnnnnnnnnnnnnnnnnnatcatca

SEQ ID NO: 9836 - DNA, 784 bp, Diabrotica virgifera
  misc_feature (2)..(15): n is a, c, g, or t
  misc_feature (20)..(583): n is a, c, g, or t
  misc_feature (590)..(627): n is a, c, g, or t
  misc_feature (647)..(660): n is a, c, g, or t
  misc_feature (663)..(685): n is a, c, g, or t
  misc_feature (693)..(715): n is a, c, g, or t
  misc_feature (763)..(763): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatcttttaattattantatattttagtacgaaaggga

SEQ ID NO: 9837 - DNA, 170 bp, Diabrotica virgifera
  misc_feature (2)..(50): n is a, c, g, or t
  misc_feature (52)..(169): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9838 - DNA, 422 bp, Diabrotica virgifera
  misc_feature (320)..(378): n is a, c, g, or t
cccccccccccgcccgcccccgatagttggtagatctgaaggattcacctcctaagaggaacgaacattaagattaggggttaggtatttaatatggtgaaggaatatgtatctcttaatataacacagcataatacctatgtacgagcatgaggagaacgactggtctctctgctcatcataccagttcattgttttggaatataacagacacgaagacacccaggtcactgtttgatcgatcgctgtctccaaaagagtatttcggaccaaattggaatactcacggacagaggtcgacaatcatgaaaagatatgcnnnnnnnnnnnnnnnnnnnnnnnnnnnnnnnnnnnnnnnnnnnnnnnnnnnnnnnnnnnctgtatatgcgacgcgctgactcatagggcagaaggctatatca

SEQ ID NO: 9839 - DNA, 574 bp, Diabrotica virgifera
  misc_feature (73)..(88): n is a, c, g, or t
  misc_feature (90)..(106): n is a, c, g, or t
  misc_feature (110)..(129): n is a, c, g, or t
  misc_feature (415)..(435): n is a, c, g, or t
  misc_feature (472)..(494): n is a, c, g, or t
aaatattaaaaatcaaatttaatatgaaaaagtttcgttttgcatagctttcaaagtaataaacaggaacagnnnnnnnnnnnnnnnngnnnnnnnnnnnnnnnnnactnnnnnnnnnnnnnnnnnnnntcaattttttatacgcaaggtaaaaataagtcgatgtatacaaaaatgttttgtaaatatatttctcttcttaactatttaacaaaatattgtcaaacattaaaattaatgataatgcatcatttttcgtaatatacataacaaagacgaaaaaataaagttacgacgacatcggttcatcatcattttcctcctcgccactatcctcttcctcctcaccaccatcatcttcttcctcctttccgtcaccgttttcttctacatccgaacctatgtagatatgtgnnnnnnnnnnnnnnnnnnnnnctatcatcatttctcatcccactttttagactggagnnnnnnnnnnnnnnnnnnnnnnntttacaatgacgagggatgtcaatattaaaattagaaaattgtgtatcaatatataagatatataggggaaaacggaaac

SEQ ID NO: 9840 - DNA, 800 bp, Diabrotica virgifera
taatactggacgatgataggaataggggactcttctttcaccgcggatttttggagtgcggtgatgggatgggttcgcttggcagtgctttgtctagatattggctagctacaggtcgtatgccgaaaggtaggtagaccagggcctcgattggtttgtgcgctcttcggagtgggcggaacaatcgaaggcacaaaaatgattctccttcatgtcccttcggtacatttggactctctccctggccaggatgtgcaccggcacagaaccagccaccacctgtaaggcaatggttgatacattcctgtacgctctgcacaccctgatcaggggtttcctttgagccctcagaagcatgtctttataatttttcatccggaggacctcatgccatagtggagccccgtataatattatggatagtattgattgtaacatcactagcctcttctgggatccgggccccctatatttggcattagtttattcagcgttgtggtcctctcctccgcctttcgacatgcttctatcacatgttgtccaaatgtcaatctgtcgtccatagttatgcctaaatactttactgaccgttggggtcttatttcggagccttgatatctgaaaactgtatcatctctttgtcttggtcccctcgagattattatttctatcttgtctactgctagctgtaaatcgtttttctctatccaattctgtactacctggtacagaaaagaatctgcatctagaatctatggaagtccattctcactgataactcctatcccatttctatcatc

SEQ ID NO: 9841 - DNA, 395 bp, Diabrotica virgifera
  misc_feature (3)..(68): n is a, c, g, or t
  misc_feature (70)..(130): n is a, c, g, or t
  misc_feature (132)..(164): n is a, c, g, or t
  misc_feature (319)..(341): n is a, c, g, or t
  misc_feature (365)..(387): n is a, c, g, or t
agnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnccttagggaaaaaaccgcgtaattttttattgggagaggttcaaattcaaataaaaaagaattggggacccccccagggtttggaattaaaagttttttaaaattgggggggaaacaaccttatttattaattaaaaggccgggggtccgcactnnnnnnnnnnnnnnnnnnnnnnnggatatcgcgggcgggttaaacannnnnnnnnnnnnnnnnnnnnnngggtgtgt

SEQ ID NO: 9842 - DNA, 228 bp, Diabrotica virgifera
  misc_feature (23)..(60): n is a, c, g, or t
  misc_feature (79)..(92): n is a, c, g, or t
  misc_feature (95)..(117): n is a, c, g, or t
  misc_feature (125)..(148): n is a, c, g, or t
  misc_feature (184)..(216): n is a, c, g, or t
taaattacccttaggataacagnnnnnnnnnnnnnnnnnnnnnnnnnnnnnnnnnnnnnntgcgacctcgatgttgaannnnnnnnnnnnnnggnnnnnnnnnnnnnnnnnnnnnnntgttcgannnnnnnnnnnnnnnnnnnnnnnnaagtttaaaccgggggggaacccaggttggttttcnnnnnnnnnnnnnnnnnnnnnnnnnnnnnnnnnccaaaaggggcc

SEQ ID NO: 9843 - DNA, 222 bp, Diabrotica virgifera; identical to SEQ ID NO: 7599
  misc_feature (6)..(28): n is a, c, g, or t

SEQ ID NO: 9844 - DNA, 292 bp, Diabrotica virgifera
  misc_feature (4)..(185): n is a, c, g, or t
  misc_feature (187)..(205): n is a, c, g, or t
  misc_feature (208)..(266): n is a, c, g, or t
  misc_feature (275)..(276): n is a, c, g, or t
  misc_feature (286)..(287): n is a, c, g, or t
attnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnttnnnnnnnnnnnnnnnnnnnnnnnnnnnnnnnnnnnnnnnnnnnnnnnnnnnnnnnnnnnatttatttnnatatataatnntattt

SEQ ID NO: 9845 - DNA, 793 bp, Diabrotica virgifera
  misc_feature (145)..(174): n is a, c, g, or t
  misc_feature (279)..(298): n is a, c, g, or t
  misc_feature (316)..(333): n is a, c, g, or t
  misc_feature (341)..(360): n is a, c, g, or t
  misc_feature (378)..(398): n is a, c, g, or t
  misc_feature (430)..(454): n is a, c, g, or t
  misc_feature (456)..(473): n is a, c, g, or t
  misc_feature (475)..(500): n is a, c, g, or t
  misc_feature (568)..(600): n is a, c, g, or t
  misc_feature (646)..(664): n is a, c, g, or t
  misc_feature (752)..(774): n is a, c, g, or t
actggcaaaaatatgtctttgctttccgcacgattaactgctatcattgaagagaaatgcccctaatattgtaacacagtatgttattgttatcatacaagatgtttctatcagaaccctgaacatcatggatactccacaaatnnnnnnnnnnnnnnnnnnnnnnnnnnnnnngaagctaaaatattagaaacttcaatgaacaatatcgtatgttaaataatcactgtgtaaagaaatgttattcgactctcatgatatctaattttttacaaaacnnnnnnnnnnnnnnnnnnnncaacatatttactatacnnnnnnnnnnnnnnnnnngaattagnnnnnnnnnnnnnnnnnnnntcgtataaaacagtctcnnnnnnnnnnnnnnnnnnnnnaattaggatgaagacttttcatattttacaannnnnnnnnnnnnnnnnnnnnnnnncnnnnnnnnnnnnnnnnnncnnnnnnnnnnnnnnnnnnnnnnnnnnataatctaaatttaggaatgatgataatatcaacagtataaaattgtatatttaggaaaaatatattnnnnnnnnnnnnnnnnnnnnnnnnnnnnnnnnnccctagctattacaagcatgtctttatgcattaaatatcaagtcgnnnnnnnnnnnnnnnnnnnccggatggccgcggtatttagaccgcgctaaagtagcataatcattaactttttattatcaaaagctggtatgaaggactccatgacnnnnnnnnnnnnnnnnnnnnnnncataacgaattttattttt

SEQ ID NO: 9846 - DNA, 387 bp, Diabrotica virgifera
  misc_feature (147)..(164): n is a, c, g, or t
atctaatatttgaaatcaccattgatatttactctaagacgacatatattaatgtcgtgacaatattactgaaagcgagagaagacaattatcccagaaacacaaaacaaaatacccgtcgcaccctgcgtggcggccaatgtaacnnnnnnnnnnnnnnnnnnctatttccaagaacctgagaagtatgatacctatcttgccactgacattacaatagttatgaaagttttcgggtgacgactgtcttcactttttacaaacaatctattattcaaagaaacaatacagatagatttgcatacctatatgtacatattaagatgttatcattaatcataataaagacttactaggcgggatacccacatcttaacatttatttaa

SEQ ID NO: 9847 - DNA, 472 bp, Diabrotica virgifera
  misc_feature (16)..(34): n is a, c, g, or t
  misc_feature (47)..(94): n is a, c, g, or t
  misc_feature (96)..(119): n is a, c, g, or t
  misc_feature (122)..(200): n is a, c, g, or t
attctggggcgggatnnnnnnnnnnnnnnnnnnnggaatatcctttnnnnnnnnnnnnnnnnnnnnnnnnnnnnnnnnnnnnnnnnnnnnnnnngnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnngggatgtgctctgaatttaatagattaagatatgggcgtcatgatgtatctctgtcgtgatgatagatattagtagtagaggagtggatattgaggatacatatagaggtagaaaaatggatagtcgttagaggctttagccatgtatattaaaaggatagggtaggtgtgttcgtctggctcgtacgcgcagaagactgtatgtgtacgcacgtctgtggacttatgcctagacgtcgttctgatgctcaataaatattgtacaggtattt

SEQ ID NO: 9848 - DNA, 800 bp, Diabrotica virgifera
  misc_feature (2)..(44): n is a, c, g, or t
  misc_feature (52)..(535): n is a, c, g, or t
  misc_feature (550)..(579): n is a, c, g, or t
  misc_feature (593)..(665): n is a, c, g, or t
  misc_feature (669)..(687): n is a, c, g, or t
  misc_feature (689)..(790): n is a, c, g, or t
  misc_feature (793)..(793): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacagnnnnnnnnnnnnnnnnnnnnnnnnnnnnnnggcccacggattannnnnnnnnnnnnnnnnnnnnnnnnnnnnnnnnnnnnnnnnnnnnnnnnnnnnnnnnnnnnnnnnnnnnnnnngaannnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtntttttag

SEQ ID NO: 9849 - DNA, 700 bp, Diabrotica virgifera
  misc_feature (2)..(86): n is a, c, g, or t
  misc_feature (88)..(101): n is a, c, g, or t
  misc_feature (103)..(488): n is a, c, g, or t
  misc_feature (495)..(532): n is a, c, g, or t
  misc_feature (552)..(565): n is a, c, g, or t
  misc_feature (568)..(590): n is a, c, g, or t
  misc_feature (598)..(620): n is a, c, g, or t
  misc_feature (650)..(681): n is a, c, g, or t
  misc_feature (684)..(684): n is a, c, g, or t
  misc_feature (692)..(692): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnnganaggaccanatatataa

SEQ ID NO: 9850 - DNA, 729 bp, Diabrotica virgifera
ggtatttgaaatagccccgatctgctgcttctcacccttctacgattattctattatccagggattcccatgatgaataattcctcttggcaatattcaacaacacatcctctactcttgtgtgatcaaatctacacaaggcgggctacggcacagcgagctccaccaagcttatccaggacaccaggtattttttgggaaactgagcaaaactcaagctgctatgtcgtcaagggctctagttgactacttcctatattcagaagctggtgttggtatcactccacgatgctgtcaaaaatgacttcaatgggcttgggcagagagtcaatcttttctacggcaagaccttgaaacctggttgagtggtcgttattttaagactggaatgcaccgcgcaccgctgcgactgcgatcctccttattgagggagatctctccgtagcatgaccaaggttatggtggtggaagtactactacttgacagtgaaacatatcatgcttatatgaacttaccgaatgctcgatctgcactctcttcggctggaaccgctgcttccgcttatctattgccctcctgagaagcaagcccttttagatttaccctgcggagtattacacgctgcagatgataaggatctcagaacagcttattcttattgttatgaatgttttgcatggtatgatagtggtgaatccccttagtcctcacagcccttaaatacatgc

SEQ ID NO: 9851 - DNA, 806 bp, Diabrotica virgifera
  misc_feature (2)..(678): n is a, c, g, or t
  misc_feature (683)..(795): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntataaattatt

SEQ ID NO: 9852 - DNA, 665 bp, Diabrotica virgifera
  misc_feature (3)..(45): n is a, c, g, or t
  misc_feature (53)..(81): n is a, c, g, or t
  misc_feature (94)..(128): n is a, c, g, or t
  misc_feature (133)..(163): n is a, c, g, or t
  misc_feature (176)..(224): n is a, c, g, or t
  misc_feature (226)..(354): n is a, c, g, or t
  misc_feature (408)..(420): n is a, c, g, or t
  misc_feature (422)..(441): n is a, c, g, or t
  misc_feature (443)..(456): n is a, c, g, or t
  misc_feature (458)..(539): n is a, c, g, or t
  misc_feature (566)..(586): n is a, c, g, or t
  misc_feature (608)..(655): n is a, c, g, or t
ccnnnnnnnnnnnnnnnnnnnnnnnnnnnnnnnnnnnnnnnnnnngtacctcnnnnnnnnnnnnnnnnnnnnnnnnnnnnncacattcaccacnnnnnnnnnnnnnnnnnnnnnnnnnnnnnnnnnnncatcnnnnnnnnnnnnnnnnnnnnnnnnnnnnnnngtaacgaaacgtnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttaaaatacgttattaatttaacttttatatattattactttcattttcnnnnnnnnnnnnncnnnnnnnnnnnnnnnnnnnncnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnncccggttttaaaaacacgtctttttcnnnnnnnnnnnnnnnnnnnnncgcccaccgattaatttgaacnnnnnnnnnnnnnnnnnnnnnnnnnnnnnnnnnnnnnnnnnnnnnnnncttggaagcc

SEQ ID NO: 9853 - DNA, 887 bp, Diabrotica virgifera
  misc_feature (682)..(699): n is a, c, g, or t
  misc_feature (835)..(835): n is a, c, g, or t
  misc_feature (840)..(841): n is a, c, g, or t
ctacaattgaaacatttttattaaaactaagtcgctatacttgcttattttgctacgaaccagaacttttcgctcgcaaatttaaaaagccaagaacttacaacaaaaagtaattttgtttgttaaggataacttggtttctttgcaaatattagtctgtctacatatttttaccaaacaagtgggaatactctaaatagattttatataattattgtcattattcgcttgacacagattacgtaagcaaaccaatgcaaatagaaaacatttgatatctggcagatagtggcttacaataataaatactaaaatgggtgctatggtattacctaaactttattccaatattaatatctcgaaagtaacgtgtcagaagttggttgaaaaatacaaacatctaatatcatggaggaaaaatgaatcaatattagagattggcattggggatggtagcaactctcaaaataccataagaccgctacttcccaaggattacaaagagtatattgcgtccgatgtgtcagttaacatgttgaagcatgtcaaagaaacatactcgatacccaacgcccaatttagaaatttcgatattagtggtgaacctcccgaggacttcaaggatcgttttgatcacatttttagtttatttacattgcatatggtaccgaatccaagtttnnnnnnnnnnnnnnnnnncaccatgctaaaagaaggaggacagatgtttcatgtttttttcgatgagatgccttctgatccagttttcgaatttctacataatcatccaaaatggagcaagtacagacataatagaatgttatccccttatttncagtnngcaataggaggcagttatatcacaatgacatacaaaaagcaggttt

SEQ ID NO: 9854 - DNA, 774 bp, Diabrotica virgifera
  misc_feature (21)..(41): n is a, c, g, or t
  misc_feature (116)..(141): n is a, c, g, or t
  misc_feature (145)..(175): n is a, c, g, or t
  misc_feature (207)..(238): n is a, c, g, or t
  misc_feature (284)..(307): n is a, c, g, or t
  misc_feature (314)..(331): n is a, c, g, or t
  misc_feature (333)..(376): n is a, c, g, or t
  misc_feature (459)..(486): n is a, c, g, or t
  misc_feature (492)..(514): n is a, c, g, or t
  misc_feature (516)..(574): n is a, c, g, or t
  misc_feature (601)..(620): n is a, c, g, or t
  misc_feature (629)..(705): n is a, c, g, or t
  misc_feature (707)..(742): n is a, c, g, or t
  misc_feature (744)..(765): n is a, c, g, or t
ccgtgagagaaatatctttcnnnnnnnnnnnnnnnnnnnnnatttttcgtacctcgtgtatcagggatctctcaattaataatctcatcatcattctcctctttcgaatcttcaannnnnnnnnnnnnnnnnnnnnnnnnntccnnnnnnnnnnnnnnnnnnnnnnnnnnnnnnntaacgaaacgttatctcgtttttcaaatatcnnnnnnnnnnnnnnnnnnnnnnnnnnnnnnnncttcatctaacaatatcatttatcaattaaatatttttatcattcnnnnnnnnnnnnnnnnnnnnnnnncgagctnnnnnnnnnnnnnnnnnncnnnnnnnnnnnnnnnnnnnnnnnnnnnnnnnnnnnnnnnnnnnntctttaaaatatcgttatctcattatctttatcatcatctatctacttttcactttctatcaaattttttatctaaaatatcnnnnnnnnnnnnnnnnnnnnnnnnnnnncgatcnnnnnnnnnnnnnnnnnnnnnnncnnnnnnnnnnnnnnnnnnnnnnnnnnnnnnnnnnnnnnnnnnnnnnnnnnnnnnnnnnncggttattaaaaacacgtctttttggnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnncnnnnnnnnnnnnnnnnnnnnnnttaaaaagc

SEQ ID NO: 9855 - DNA, 878 bp, Diabrotica virgifera
  misc_feature (2)..(754): n is a, c, g, or t
  misc_feature (758)..(758): n is a, c, g, or t
  misc_feature (764)..(805): n is a, c, g, or t
  misc_feature (809)..(877): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattnttttannnnnnnnnnnnnnnnnnnnnnnnnnnnnnnnnnnnnnnnnntagnnnnnnnnnnnnnnnnnnnnnnnnnnnnnnnnnnnnnnnnnnnnnnnnnnnnnnnnnnnnnnnnnnnnnc

SEQ ID NO: 9856 - DNA, 649 bp, Diabrotica virgifera
atttgacggtaagtttttgattcactgcactgggtttgcagcggtagcatttcttcgtgttctctgtacatgtggcatgcggccattgtttcggttttcctcatctggagtcgttttcgttggaactttgttgtgttcttcacttcttcattgttttggagggagagatgttctttcgtaatcatatgaagtgtttgaggtcaaagggtgtattatggtgtttgaagtttgtgtttcactgcactgggtgtgcagcagtgacatttcttcgtgttctctgtccttctagcatacaattgtttcgatttgcctcatcttgaagcatcgttggagcttcgggatgttcttcacttcactatctaaaagaggaagacattcaatcatactatccaatgtaacacagaaaataaatataatgtttgcatttttagcaatttttgcacgatgtaccacgtaaagttgatacacaattaaaagtgactgataaaaaagcataaaataagttttgtttcaactttataacagtaagaagtacatgatcaagtgcggtcataacaagtctatccctttcgaatccctatgcagtagctatttcaacactttcaacaatcacatttagaagttcaaaggatggtatttctggaactgt

SEQ ID NO: 9857 - DNA, 881 bp, Diabrotica virgifera
  misc_feature (472)..(501): n is a, c, g, or t
  misc_feature (563)..(583): n is a, c, g, or t
  misc_feature (675)..(692): n is a, c, g, or t
  misc_feature (805)..(805): n is a, c, g, or t
cgactatggccttgacaacccacataacaatgatgttcgcatcatgttcaaagcatatactaccaacattcgtcggagtatattctttttagtatatgcgtagtacaaacgtagcatgtaccataaaaaacattctaaatttcatgttctttgcatatactttaaggaataacctcgtaccgaatataatgagtacattcgtgtaagtagtatctcggaatattcaaaaaagtttattcccagaatatacctttatcgaatattacataaaagtatatacttgacacatacttataagtacttttaaaatatcttaaaaggaatatgtgtatggataggaagaataatgttagcccacatatatatatacacacatatatatacacatatatatacatatatatatatacacacatatatatacacacatatatatatacataggctaacagattatcaacttcgttatgannnnnnnnnnnnnnnnnnnnnnnnnnnnnntatgtaggcagtactattgaactaccgaattcattatttaaaattgttttaattgtaaggtnnnnnnnnnnnnnnnnnnnnngtattaatgaaaaaggagaaattctcgtttcgctttcataattgaaatgcatttactattttggtttaataagtttatcatgagtattcttnnnnnnnnnnnnnnnnnnggaattgacattcagataagctgagccaaaacccacaaacaaagaggaaacgaccgcttcatacctgcataagggggtaaggggttgggaacaaaaggcaaaatacaaaatantgaaaaacagttaggcaaggcatttggcatttgtatttgtatctacactcaacactatcactgtctatgcggggat

SEQ ID NO: 9858 - DNA, 406 bp, Diabrotica virgifera
cggcccctcccgcccgatagcactatggcgaattttctgcatgcatgcctatcaaccgagaagtatttctcagcgagacagggtattgaaatagaaatggtagcatctcgaaatagaggtgaagattattgaaatctccgccggatgactacagtaccaggagggaagccagcagtgaacatcagtatatagggtgtggcgagggaggtcaggctgcatattgtcgcgactggttgttaaagaggtgcctgtttgcgttaagtatcaaggctcgcctgaccaccgatgcatttgaagggccgaggcactttgaccgtgcgagggtagctccgtcatcaatgtgtttagtgagagctggaatgaaagtgcggaggatcatcacacaggccccacttaatcctataag

SEQ ID NO: 9859 - DNA, 677 bp, Diabrotica virgifera
  misc_feature (86)..(121): n is a, c, g, or t
  misc_feature (127)..(147): n is a, c, g, or t
  misc_feature (152)..(181): n is a, c, g, or t
  misc_feature (195)..(248): n is a, c, g, or t
  misc_feature (290)..(371): n is a, c, g, or t
  misc_feature (373)..(394): n is a, c, g, or t
  misc_feature (396)..(413): n is a, c, g, or t
  misc_feature (415)..(433): n is a, c, g, or t
  misc_feature (444)..(518): n is a, c, g, or t
  misc_feature (520)..(543): n is a, c, g, or t
  misc_feature (582)..(610): n is a, c, g, or t
  misc_feature (619)..(633): n is a, c, g, or t
  misc_feature (635)..(647): n is a, c, g, or t
gtgaattgagcttcttataaaaaaatatacacttattatttgtatgaaacaaaatgatttaatgcctagatctatcgcgatcgacnnnnnnnnnnnnnnnnnnnnnnnnnnnnnnnnnnnngttgcnnnnnnnnnnnnnnnnnnnnnaaacnnnnnnnnnnnnnnnnnnnnnnnnnnnnnngaagagagctatcnnnnnnnnnnnnnnnnnnnnnnnnnnnnnnnnnnnnnnnnnnnnnnnnnnnnnnctgctatacgattttaaagatatctaatttcttaggacatgnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnngnnnnnnnnnnnnnnnnnncnnnnnnnnnnnnnnnnnnnctataataagnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnncattaaataatcgtatatttagcaaaaatatgtatgtcnnnnnnnnnnnnnnnnnnnnnnnnnnnnncccctgtcnnnnnnnnnnnnnnngnnnnnnnnnnnnnataatgactcggctgccctctgattaatta

SEQ ID NO: 9860 - DNA, 247 bp, Diabrotica virgifera
  misc_feature (7)..(44): n is a, c, g, or t
  misc_feature (66)..(66): n is a, c, g, or t
  misc_feature (93)..(93): n is a, c, g, or t
  misc_feature (142)..(142): n is a, c, g, or t
  misc_feature (173)..(198): n is a, c, g, or t
  misc_feature (213)..(243): n is a, c, g, or t
taacagnnnnnnnnnnnnnnnnnnnnnnnnnnnnnnnnnnnnnntgcgacctcgatgttggattanagtttataattggtgtagcagctatanttattaagtctgttcgacttttaaaattttacatggatctgagtttaanaccgtgtgagaccccaggttggtttcctatnnnnnnnnnnnnnnnnnnnnnnnnnngtacgaaaaggaccnnnnnnnnnnnnnnnnnnnnnnnnnnnnnnngata

SEQ ID NO: 9861 - DNA, 853 bp, Diabrotica virgifera
  misc_feature (2)..(18): n is a, c, g, or t
  misc_feature (20)..(68): n is a, c, g, or t
  misc_feature (70)..(748): n is a, c, g, or t
  misc_feature (754)..(850): n is a, c, g, or t
cnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttg

SEQ ID NO: 9862 - DNA, 562 bp, Diabrotica virgifera
  misc_feature (61)..(79): n is a, c, g, or t
  misc_feature (441)..(500): n is a, c, g, or t
ctattgtagccaaggtcttactcatcaatggcgccatctagtgaaaacaaaacgatatcannnnnnnnnnnnnnnnnnnaactgtttttaattttgatgtaatgattttcttcttcactcttttgttagaaaaagagagttgttacttttaaggaaatccaattccatttttgtaaattaacacgtttgctcaacaaaagttttagaatatagttggaaacatcctgttggcataaaattatggtctcatctttgtatgtcactaataaacattgtgttgttatggctgttatttagcaatggggtaactatttttaatctgttagggagttatattttagttttttatttattaagggataagtatgtattagtaatttttatgttattttaataatggaacatagagtaggttgcctaataaaacgaatatgtatttgnnnnnnnnnnnnnnnnnnnnnnnnnnnnnnnnnnnnnnnnnnnnnnnnnnnnnnnnnnnngaacagaacaaaagctgcaaaagaaatcaaaattaagaactctttttttgaggagccaaaaa

SEQ ID NO: 9863 - DNA, 233 bp, Diabrotica virgifera
  misc_feature (7)..(30): n is a, c, g, or t
  misc_feature (40)..(40): n is a, c, g, or t
  misc_feature (79)..(97): n is a, c, g, or t
  misc_feature (109)..(130): n is a, c, g, or t
  misc_feature (159)..(159): n is a, c, g, or t
  misc_feature (164)..(164): n is a, c, g, or t
  misc_feature (166)..(189): n is a, c, g, or t
  misc_feature (197)..(229): n is a, c, g, or t
taacagnnnnnnnnnnnnnnnnnnnnnnnntcgataatanagattgcgacctcgatgttggattaagtttataattggnnnnnnnnnnnnnnnnnnnaagtctgtcgannnnnnnnnnnnnnnnnnnnnnagtttaaaccgtgtgagcccaggtggttnctatncnnnnnnnnnnnnnnnnnnnnnnnngaaaggannnnnnnnnnnnnnnnnnnnnnnnnnnnnnnnntact

SEQ ID NO: 9864 - DNA, 731 bp, Diabrotica virgifera
  misc_feature (54)..(74): n is a, c, g, or t
  misc_feature (100)..(115): n is a, c, g, or t
  misc_feature (117)..(135): n is a, c, g, or t
  misc_feature (225)..(249): n is a, c, g, or t
  misc_feature (251)..(265): n is a, c, g, or t
  misc_feature (316)..(332): n is a, c, g, or t
  misc_feature (335)..(347): n is a, c, g, or t
  misc_feature (353)..(377): n is a, c, g, or t
  misc_feature (451)..(493): n is a, c, g, or t
  misc_feature (500)..(515): n is a, c, g, or t
  misc_feature (517)..(543): n is a, c, g, or t
  misc_feature (634)..(652): n is a, c, g, or t
  misc_feature (659)..(678): n is a, c, g, or t
  misc_feature (702)..(723): n is a, c, g, or t
cgccccccccccttccattattgtaaataatcagatatcctttcagtataagcnnnnnnnnnnnnnnnnnnnnntagttgattaggatggcgagagaatnnnnnnnnnnnnnnnngnnnnnnnnnnnnnnnnnnnccttgtgcttcagggatcattatttcacaataatatattctttatttctcaattcaaaaagctagaaattaatatctctattgaaaaacnnnnnnnnnnnnnnnnnnnnnnnnngnnnnnnnnnnnnnnntgtttatatatatctaattgttgaatagataagtgatatttatttactatnnnnnnnnnnnnnnnnngcnnnnnnnnnnnnnttaagnnnnnnnnnnnnnnnnnnnnnnnnncaaaaataagatttcatcagaatttcatttttagattggaattacgaatacaaattctcacattttaaaatacnnnnnnnnnnnnnnnnnnnnnnnnnnnnnnnnnnnnnnnnnnnctctccnnnnnnnnnnnnnnnncnnnnnnnnnnnnnnnnnnnnnnnnnnntatattagcattaataaattgtatatttagagaagatatataggtttaataacggaattcggctacattgttttctcctgcctattaagcnnnnnnnnnnnnnnnnnnnatatagnnnnnnnnnnnnnnnnnnnncagtttgaatggccgcgagagtcnnnnnnnnnnnnnnnnnnnnnnacattagc

SEQ ID NO: 9865 - DNA, 492 bp, Diabrotica virgifera
  misc_feature (82)..(103): n is a, c, g, or t
  misc_feature (393)..(412): n is a, c, g, or t
  misc_feature (435)..(455): n is a, c, g, or t
ggtgagtttgctacatttaaaaatgtgcatctaaatgtctatatagagtgtacacttgtttatagggtaacataccatgttnnnnnnnnnnnnnnnnnnnnnnatttgacgtttctcagctccaattttttttccttcccactaaattatacttcctaatttcatttaattctttctctcttactttcaccagatttttgaaatcttattaaacatgttatacatatgcccaaactatttgaattaccacccctcttattgtggagacagtttctattagttattatttatgaaattcaatattttattttatctttttgggcgtctggtgtatggtgaggcgtcgatttcaagaagtgttgctggctaaatgggcgcagttcccaaaggtcnnnnnnnnnnnnnnnnnnnnttgagtatcctccatatcttccnnnnnnnnnnnnnnnnnnnnnggaattattgcttggtattaatataattgttgataag

SEQ ID NO: 9866 - DNA, 694 bp, Diabrotica virgifera
  misc_feature (30)..(47): n is a, c, g, or t
  misc_feature (61)..(74): n is a, c, g, or t
  misc_feature (76)..(89): n is a, c, g, or t
  misc_feature (104)..(139): n is a, c, g, or t
  misc_feature (144)..(174): n is a, c, g, or t
  misc_feature (186)..(235): n is a, c, g, or t
  misc_feature (237)..(378): n is a, c, g, or t
  misc_feature (395)..(419): n is a, c, g, or t
  misc_feature (421)..(640): n is a, c, g, or t
  misc_feature (646)..(674): n is a, c, g, or t
tcgtatcgtgagagaaactctttctccttnnnnnnnnnnnnnnnnnncttttcgtacctcnnnnnnnnnnnnnncnnnnnnnnnnnnnnctatactcaccaccnnnnnnnnnnnnnnnnnnnnnnnnnnnnnnnnnnnnttcgnnnnnnnnnnnnnnnnnnnnnnnnnnnnnnntaacgaaacgtnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaattcatttcnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctaannnnnnnnnnnnnnnnnnnnnnnnnnnnngtggaatggaaggttggatg

SEQ ID NO: 9867 - DNA, 937 bp, Diabrotica virgifera
  misc_feature (327)..(345): n is a, c, g, or t
  misc_feature (667)..(694): n is a, c, g, or t
  misc_feature (828)..(828): n is a, c, g, or t
cagtgaattcgtatatacatacttgataactagccccagaaccaaacaatggttgtacttataattcaatctacattacagtattgtgaaattggataggcgataggctaaacgccgatgttataagaatacctccgggaacatggtgagactttaaacgagaaccctaacaaccatcttgggccaacgaggtctgcctcgataaattgttcagtgtttgatctttcaggctggctctttcttttttgtagagaaattttttgaagttgaaaacgcacgctcgctttctgttgatgtagatatgatggttttaagtgcagtgagtgnnnnnnnnnnnnnnnnnnntctggtcagcttatttgaattgtagagtactagctcttgtttaatgacctttttggaattatccgtagacataattttaattcaaaataaatatttatgttataattctggatgcttcaaaaagtcagatccgtcgcataaataatagagtatttatgctaatcgatatggtacattatgatttacgccaaaattggaaggtttaaaacacaattgaaaaagaaatatttcaagtggaatagttgaaaatgattattaagcaggcagagataattttcagaaacatttattaataattgtgagttactaatatctccgctcnnnnnnnnnnnnnnnnnnnnnnnnnnnnccgcgaaatctggatttccatttttttactgatttcccgggaaatttgtcccgggaatggagctctatacagagctagccaaaagtttcctctccccctcgtgtcttttgaccgattatacttataatagttanatttggagggagaaataaacggacgtaggttttccaacagtcgtaacagatgacgtaatagtggcagatgacgttacagagccactttgaccgataatcttaatgggga

SEQ ID NO: 9868 - DNA, 956 bp, Diabrotica virgifera
  misc_feature (24)..(44): n is a, c, g, or t
  misc_feature (290)..(316): n is a, c, g, or t
  misc_feature (653)..(668): n is a, c, g, or t
  misc_feature (671)..(684): n is a, c, g, or t
  misc_feature (744)..(766): n is a, c, g, or t
  misc_feature (775)..(796): n is a, c, g, or t
  misc_feature (878)..(878): n is a, c, g, or t
  misc_feature (904)..(904): n is a, c, g, or t
  misc_feature (911)..(911): n is a, c, g, or t
ttttaagccatgtaaaaaccatannnnnnnnnnnnnnnnnnnnnaacaaagtaccaaaagtcatttcactgaatatttttatgaccaaagtggtgtttttaattccctgatcattaaataaatgtttgttcaaagattaataagtgttatttattgtttatctgtgaaaaacatacttttgaatcttcttttaataaaaagaaaccttaaaatggcttaggaatgtgaaaatggctaggaaaaccttgtcaaaaaaaaaaagaatattgttagcaaaaatgtatctagcnnnnnnnnnnnnnnnnnnnnnnnnnnntctatcgactcagcaaaagaaaagttgtagtaaagaaagtgtttaaaagaagctttttttttgcagaagtttgtagcatcaaaactaagccaggtacgctcaaaatacaattaatcccatttttttggtaaaaaattgtgaaaatctgccctgtttagcaccccaaatgaaactaatcgttgtcgccttacaaattacttaacttttttatatgacctgtgagtttcaccggttcaaagtgcttatttttaaaagggttctagttaaaagggcttgaacgagtcattaatcgtgagtatatgcaaattttaaacagccaaccaatttttgttttacnnnnnnnnnnnnnnnngcnnnnnnnnnnnnnnaagcaagacctacattcctttactctttgagatttttcgtatcactaatactttttaagnnnnnnnnnnnnnnnnnnnnnnnatttttccnnnnnnnnnnnnnnnnnnnnnnctataaaaccaaattttctcaaaaataagaacttcgaaccggtcaaacttacagatcatataaacaataaatatttaaagtnaatggtgaagcgctagtgatggattntatttgnggtgcgaatagggacatattttcacgattttttttaccaactaac

SEQ ID NO: 9869 - DNA, 1155 bp, Diabrotica virgifera
  misc_feature (380)..(402): n is a, c, g, or t
  misc_feature (878)..(898): n is a, c, g, or t
  misc_feature (901)..(925): n is a, c, g, or t
  misc_feature (992)..(1014): n is a, c, g, or t
  misc_feature (1036)..(1072): n is a, c, g, or t
  misc_feature (1083)..(1122): n is a, c, g, or t
tataggtaaagggtaatttccctactaaataactgacatacgtgatcttcattacctatgtaatgaaactatgtttcctcttaaatcctaatttatctctttacactgtattatattatagttatatgtcctttatttgtatttctaaaccaactaatcaacattaagaacaacgttaagaaattatatactggaggataagggtatattatatacaggaataaaaggccgctaaacgccggcgccgtaaaagtgagtggcgcatgcaatgttccagacctataatattcatatcaggtcttttgtagctggagtgttgtgtgcgccacttatttttacggggtttagcggttttttattcttgtatcaggagtttttcnnnnnnnnnnnnnnnnnnnnnnngtatgaagttgaatgcaatttttctcgattacacgttaagctttataaatggtcgcctttgtcgcattatctcccaaatgatctagtgtccatcgaatgtacactaggttattttctattcgaaatagattgaaaaaaattattgggatggccggttaatgaactcggattgtccgttgtcagatcaaattgagcgtcgtaaccactacaactacataaaccatttcggaaataatcgtttattatacttttgtagctttaataacttacgttattatgacgtgtttaaaacaaatataccagtccatttaaaaaggaaagcttttaaacccgtgggttcccacagtcttcatatgcggagcagaaactggatgaaacaaataatgtatgaaaatataaactgaaaaatatccacctttctttttacctaaaacataaacaattttgtttttgtatcgaaaattggtttattttgnnnnnnnnnnnnnnnnnnnnnccnnnnnnnnnnnnnnnnnnnnnnnnnccttgccaaacttttaataaattaaccaaacaattttaatttggcaaaaaattttttatttccaacnnnnnnnnnnnnnnnnnnnnnnngggaaagtgatttatttaaccnnnnnnnnnnnnnnnnnnnnnnnnnnnnnnnnnnnnncctaccggggnnnnnnnnnnnnnnnnnnnnnnnnnnnnnnnnnnnnnnnncctgggaaatatcttttccccccgggaaaaacc

SEQ ID NO: 9870 - DNA, 807 bp, Diabrotica virgifera
gagttttaataaaaattgtcatttttaatttacattgttaaaattaaattggaataatggcattcaattttccagcattttcttatataattgctttaatagtcgacgcctttttgatatttttctcgctatttcacgtgatagcatttgatgaattaaaaactgattacaaaaatcctattgatcagtgtaatagtctaaacccgcttgtgttgccagagtacctgctccatctcctcttcaacatcttgtttgctgcatcgggagaatggttttccctttgcctgaatatacctttgattgcctaccatatcaataggtatcgtacgcgtcctgtgatgtcaggttatggaatatacgatcctacgagcatcatgaacgcagatgtacttacaaggtgccaaagagagggatgggtcaagctcgccttctacctactcagctttttctactacctctacggaatgatatacgtgttaatttccaactgagacttgacggccagcacgaccgtacgacaagacattttcgaacagtaaaatcattagttttagtaacaaatacaaagacagatgggaattcggttctcgatattatgcagagtatttacctgatgatgaacacttattggaggatagaaacgcataatttgcagaactgacttacccatgtaatggacaggtatgatggaaacgtatgtactttaatggtttgttagtatttttacgaaagaagctaagtagggttgtgaagaaatagatacttggtgtactcgatactttttattaactcattaattaattaaat

SEQ ID NO: 9871 - DNA, 817 bp, Diabrotica virgifera
  misc_feature (26)..(59): n is a, c, g, or t
cgttttaagatcatgttaccttatgnnnnnnnnnnnnnnnnnnnnnnnnnnnnnnnnnngcaagttccctattatgagtagcacatagataacaaaatttgatatctttttttagatgtgcaacacagctctaatgtatgccgctaaaggaaatcatcctcacacttgtcaagaactcctacttaatggaataaatttttcactggagaatttaaatggtgataatgcacatacaattgcagtagaaaataatagtactttaggatgatgtagaccagaatcgtaatcgatgtggagagatgttctctaattttcgcatgtggttttaccgtctcgttggaattagtttatctttcccattttcttcttaccagctcagaccgttattgaaaatttcctaattttgcaactagagtcaataatagcagttgaaccaagtggaagtagtgcagttttacaggaactttccaattgaatattatcatttatttggtttggatacaaagtttgtacagattttactattggtaccaaaatttatagtctaggggggtcagcgtgtccttttcaattctgatggacggactcaacggtttcttatggatttttggctgctgattactaatttcgggggtggatttcgatccgagtgactcataaactaaaagagatagaaaatgtttcaaataaaagtgtgatccttaataaaaaaacaatgaaaaaaacggatactagacttgaaatccacaattaaaactcaagatatcgttaaattagtgcacatagcaaatttgccaattgcaaaataattattttt

SEQ ID NO: 9872 - DNA, 1007 bp, Diabrotica virgifera
  misc_feature (717)..(746): n is a, c, g, or t
  misc_feature (760)..(787): n is a, c, g, or t
  misc_feature (789)..(833): n is a, c, g, or t
  misc_feature (847)..(898): n is a, c, g, or t
  misc_feature (925)..(987): n is a, c, g, or t
atcgctcgaaagaataaagaactcgactggttcgggttgtatattggctcattgtatgggcttgggaaaaaccttgcaggttatatcactgacacatacgcttctaaaccacagcaaaaagacgaaggtcgataaggttatggtggtagctcccatcaataccgtcctaaactggaaggccgaatacaaaaagtggatgcctagtaattcggcagtcgaagtgtacgaattggcaacgtcgaaaaagaactacgaaagagcgtacaccatagaaacgtggcatcaagacggaggtgttctaattatcggatacaatctcttcagactgttgagtaatcctgccaacaaaaaactcagtaagaagatgagggagaagtttcaagagggacttgtagatccaggtcccgatctagtcatctgcgacgagggtcacttactcaaaaacgaaaaaactaacttgagcatcgccatgaacagaatcaaaacgtccaagaggatagtcctgaccggcactccgttgcagaacaacttgaaggagtattggtgcatggtgcaattcattaaaccgaatctgatgggtacctacaaggagtatatgaatcggttcgctcatccatatcacaaacgtgactatatgtattacacataacgtctcacctgcccaatgatgaaaatgaatgacggggttattaagatcgtgctaagggagcacaatcnnnnnnnnnnnnnnnnnnnnnnnnnnnnnntgggctggatgacnnnnnnnnnnnnnnnnnnnnnnnnnnnncnnnnnnnnnnnnnnnnnnnnnnnnnnnnnnnnnnnnnnnnnnnnnaagaagaccctaannnnnnnnnnnnnnnnnnnnnnnnnnnnnnnnnnnnnnnnnnnnnnnnnnnnataaaaatgggggcgaatcgggggggnnnnnnnnnnnnnnnnnnnnnnnnnnnnnnnnnnnnnnnnnnnnnnnnnnnnnnnnnnnnnnnccccacttttttttgattat

SEQ ID NO: 9873 - DNA, 875 bp, Diabrotica virgifera
  misc_feature (784)..(784): n is a, c, g, or t
ggacgaagtcattccacttgactccaatacgaatttgtacactccaagaaccaacaacagaagctgtccgatctgtaccaaagaatattcttcgtacaagaacatgatgcgacactacaaaacccacagacctgaagagatcgaggagcatagacagcaacaacaattcgactacgattcacaagatatgcaagacatggatttggaggatgaagaatcgatgtattcgtgccccgactgcggcggaatgtttaagtctttagagtggaagatacatttgacagagcagcatcagcagaaaccttgtggggaatgcggcaagtttttccaattccagacggaacttgatcaacatcgaaccactcatttgaacttgaagggactcgaaaacacaatcatacacgagtactatgataagtcctggaggagaagatgacgtggaaggaggagaagaaccgggtgaccgagtattcgcttgtgaagtctgcgaattcgtgttcagtacacaagatgaattaatgaaccacaagcttgaacaagaccacggcgaactagagcctatggataacatggacggtatggaaaacatggacgataacatggacttagaagtaatggaaccattgcaaactatggaaattttagaaccacagatcgagactacttcaaagaaatctaagtgcgatgtttgcgatcaggagtttaataactacaacggcctgtgggaacacaacagaagcaaacatccagaaagaaaaacaccacacgtggatacataccctanaaaatgtaaggagtgcgacaaggtgtgtactactggagctgcttactacagacacattcaaatccattctaaagtaccagcagatgctggt

SEQ ID NO: 9874 - DNA, 564 bp, Diabrotica virgifera
aattttgcgggtttctttcgttcgtttttagttgttgttttgacattttgaggtgtgttttgtatgaaatgagctcttaaaaaggagacgtaactgtagctttcatagttttaaaggaaatttgtttgtgaatttgtgagttaatgaattttaacatcatgtatttatacaaagttgtaatattagctgcgatcctcgtcgctgtaagctgccagtcttatagagctggtattgttatatataaaccagtatcaatacttggcccagctgacaccaatttaaaaatcaacgcgaatataagtgcaagattgataaagtcctataaagatcaggcggatatatttgtccttccggaatatggtctcacaaatataccacctaaatcactgacaagtgtatatcaatacagtactaccattaatgaagtcggttatgatgtatgtggcagtaaggagaaggaggatatacagctaagggatttagcatgtgctgctaaagacagtaatgcctacgttattgcaaatttgttcgagtcaatacgagataatgcgaattatctaacta

SEQ ID NO: 9875 - DNA, 901 bp, Diabrotica virgifera
  misc_feature (510)..(531): n is a, c, g, or t
  misc_feature (770)..(770): n is a, c, g, or t
  misc_feature (862)..(862): n is a, c, g, or t
agattatacaacaaaacagattaatattcaatgtaaataaataaaaacatcagaaatagaaaacaagaattaaggtataatcttacgttacagttattaaggtaccaagggtattataaggataataaggctcgaggtcaacggtgtttttaacaagggcctgagggatatacgttgaccgaaagcgttattattataatacctgtggtgccttcaacgtttaatgtctgactaaattattctttatatgcgaaaaatttgaatgaattttgaattgattagtttttaaataagtacatttaccagtaacagtagtaacataattgtggtaaccatagttttacttaggttgatatttgtcaacttgacagtatctaagtcgttatttaaatttaatgcccaagggcgttatatcgtacttaagggggtattagtacgctatggtcaaaataggtggccaatttttaaactaacgtttaacagttctttgaatagatggcagcacgtacnnnnnnnnnnnnnnnnnnnnnngttctctgaacgacaccgcattgatgccatgtattgcaacttaggctcggcacatctcgatcttaatcgtactttgtatttacagacgacagttgttaatcctttctttacctgcctagggaaattctcattaatagatactaaacgttcattcatttggatatagttcattatttaatattgtattatacggcaattcgtaattctttacctgctcaaaaggatttatttcaaactanagaaatttgcaattatttgaaatacaagtaagtgcctatctaatgaccaaaaaagaattatgctaattctcagaatggagatcgagtataanattagtatttttaataatggtaaatacgtaagtcattga

SEQ ID NO: 9876 - DNA, 103 bp, Diabrotica virgifera
cgcccccgcccccctcggcccgattcattgttaaaataatcacgatatcccttctagcacaggcacagaaagatttcatttattgacagtcatttacgatcgc

SEQ ID NO: 9877 - DNA, 117 bp, Diabrotica virgifera
  misc_feature (9)..(9): n is a, c, g, or t
  misc_feature (21)..(21): n is a, c, g, or t
  misc_feature (35)..(69): n is a, c, g, or t
  misc_feature (72)..(72): n is a, c, g, or t
  misc_feature (78)..(116): n is a, c, g, or t
gtttataanattattaataangttttttagtattnnnnnnnnnnnnnnnnnnnnnnnnnnnnnnnnnnnggngtgatnnnnnnnnnnnnnnnnnnnnnnnnnnnnnnnnnnnnnnna

SEQ ID NO: 9878 - DNA, 558 bp, Diabrotica virgifera
ctgtaagactaccaagattccaagaccctatcccgatttttctaacccggaacggtgttccccccgagatagccctcacccggagatccgaacggaggctcattttagttccgcaacattttacctcaggagatgccatcatttcagtataagtttttattgcgttaggagaaggtcttttcattattatggcctgaaaagattttttggatatttgatggctggaagccttttctatcagcaccataccctggcctgcacgtttagccaatacaccaccaatgcaaccaaagtgcagtattaccccacacccgcctgcatttttctggataggccaggatccctactggtagggacggcctataagccaatggattggtggccgtatcccgccactaggaggcacgtactttattcgggataccgtattatattatgtatagacgtagaaataatatttaaagatttctattaatggtaacttaaagaaatataccataatttggttaatttaatttggattaatggatttagtggataaaagaaagtgacattttg

SEQ ID NO: 9879 - DNA, 146 bp, Diabrotica virgifera
  misc_feature (48)..(77): n is a, c, g, or t
  misc_feature (88)..(105): n is a, c, g, or t
tccttctgtgcaaaattgtgacttacccttgttgaattacattgtcgnnnnnnnnnnnnnnnnnnnnnnnnnnnnnntaaattagtgnnnnnnnnnnnnnnnnnntattaataatacgaaggggctcctcccccatacgcaaacca

SEQ ID NO: 9880 - DNA, 771 bp, Diabrotica virgifera
  misc_feature (2)..(46): n is a, c, g, or t
  misc_feature (53)..(729): n is a, c, g, or t
  misc_feature (735)..(770): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnng

SEQ ID NO: 9881 - DNA, 113 bp, Diabrotica virgifera
  misc_feature (2)..(62): n is a, c, g, or t
tnnnnnnnnnnnnnnnnnnnnnnnnnnnnnnnnnnnnnnnnnnnnnnnnnnnnnnnnnnnnnccggaattttgaccgtgctaaagcaacataatcattagatattttatttga

SEQ ID NO: 9882 - DNA, 874 bp, Diabrotica virgifera
gtcaattttaccattcgtttcgttgaatttaataactcaatatatttaagagaggtgatcaaaaagttcctggacaaatacttaaaaaatcatctaaaaattaaataaacactctctatttgcttaatttactacattataccctttaagagactccccttttgatgaatatacatttccgacatcgtttctatagtcgaaaagactagtttggttattttagaatccattggtttttttttcagttgattctgaaatgctctcttgagcttgagaatcaataaatagtctacagggataggcttggtgaataaggaggttgccttatcacaaacaagctattttccgcagaaattgggaacgagcaacgaagaatgaagtggtgcgttttttcctacacctgttatgcttttggcgatgtatttttttgactttcattaaaaggattctatctttgtttcttccacctatgataatgcgtttcaaaaattctcgttaccatttatccctccaataagctcctaaaaagcctgaattcagtggtgtttctgtctcagaatcattttgctaatgtttatactttttattattctttgtcgttttatgccgttttctgtcactttgagccctcattttctctcctttgataccgatgatcttctttttgaaaaatttcgccaaagtctgtacctaatttaaccaaagtgactcaaacactgaaaaatatccaaaaattgcctaaaacttcaaagcataaaagaacagtagagattaccggtctcgttaaacatttgatgccgattgtgtgtcgcaatttaaaaaatcctggggcttcgtgatcagtcctcatatattaacttctgcttttatccta

SEQ ID NO: 9883 - DNA, 626 bp, Diabrotica virgifera
  misc_feature (2)..(38): n is a, c, g, or t
  misc_feature (40)..(387): n is a, c, g, or t
  misc_feature (394)..(431): n is a, c, g, or t
  misc_feature (451)..(464): n is a, c, g, or t
  misc_feature (467)..(489): n is a, c, g, or t
  misc_feature (497)..(519): n is a, c, g, or t
  misc_feature (549)..(580): n is a, c, g, or t
  misc_feature (587)..(623): n is a, c, g, or t
cnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnatt

SEQ ID NO: 9884 - DNA, 946 bp, Diabrotica virgifera
  misc_feature (156)..(171): n is a, c, g, or t
  misc_feature (174)..(196): n is a, c, g, or t
  misc_feature (847)..(848): n is a, c, g, or t
aagcctcataccaaaaaccgagcctcatggtgattaacttccttgcaacttaagtttggcctctttaaagcttaccgttttatctgatgtcacgccgatgttgaaacataaaacattgtttgtagaagccattgcgcaattacaaattaaatcccnnnnnnnnnnnnnnnnccnnnnnnnnnnnnnnnnnnnnnnngtaaggttatttcccttccagcaatagtagatggtaaaactatttcacatcgtcgaatgagaagtccggacataaagcatttaatttggtcctttcgagcaggattgaaaccttaaatcgctggtttatatccgactcgaataaggggtttaatttttcattggccagtcagatactaatttctacggtgctcaatgtttcattgagatgattttcaaatgctaaataaaaatgatgttgaattaagaagcaactattttaagcagaatctttaaggctcttattctgttagctatatctggaaatatttattcgtaatgatagttttaaacaactaaaaaaattatggactgataaagaatggcgtaaggttatctgaatgttggaattttaaacagaattttttttgtccaaattttgtcttctctaaataggttgtcatcaagtttctagttctataggttactgtctatgaaggaatgttcaaagaaaaaagaaaggtagttgaagtcgtgtgttgtctatacatttcttaataatatatcaacttatagcaactttgaaacttaccaattatttgagaagtattaactagtggctttctagatttcctttgttagttttgcttctgttgcgcatgtctatatattnntgtaaggtatttatatcacaatattaaggtacccagcttggtcacaatcatcaccaatcagccccttgcatcactgctggatataggctccccctatt

SEQ ID NO: 9885 - DNA, 1002 bp, Diabrotica virgifera
  misc_feature (6)..(768): n is a, c, g, or t
  misc_feature (775)..(812): n is a, c, g, or t
  misc_feature (847)..(869): n is a, c, g, or t
  misc_feature (877)..(898): n is a, c, g, or t
  misc_feature (903)..(903): n is a, c, g, or t
  misc_feature (941)..(941): n is a, c, g, or t
  misc_feature (946)..(947): n is a, c, g, or t
  misc_feature (968)..(992): n is a, c, g, or t
aatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntggtcgannnnnnnnnnnnnnnnnnnnnnagttnaaaccggtgtgagccagggtgggttctatctttaattnattanntatatttagtacgaaaggacnnnnnnnnnnnnnnnnnnnnnnnnngattaatatt

SEQ ID NO: 9886 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9887 - DNA, 270 bp, Diabrotica virgifera
  misc_feature (5)..(42): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(243): n is a, c, g, or t
acagnnnnnnnnnnnnnnnnnnnnnnnnnnnnnnnnnnnnnntgcgacctcgatgcttggattaaagtttataattcggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnngaagacaaaaaaactaaaagatgaaac

SEQ ID NO: 9888 - DNA, 97 bp, Diabrotica virgifera
actttataaataataatatagatttatgttatttaaagttagtaaatgatgattcacattattagatcaaagttgtatatttaagaggagtatatcg

SEQ ID NO: 9889 - DNA, 922 bp, Diabrotica virgifera
  misc_feature (804)..(804): n is a, c, g, or t
  misc_feature (819)..(819): n is a, c, g, or t
  misc_feature (873)..(873): n is a, c, g, or t
  misc_feature (902)..(902): n is a, c, g, or t
ggcctggcttagatggagatattgaattgtttgtaaaatcttgtgaagcatgtttaaagaatactacaactccacgaaaggcacctttaattaagttccaagaaggagctcatgtgtttgatagaattcacattgattttttaggaccgtatcatgggaagaattatcttgttattacagatgcatactcgaagtggcccgaggtatatgagatgtcaaagactgactcagaacataccatcggtaaacttcgagactgttttgcccgatttgggttgccaaatcaaattatttcagataatggtccacagtttaattcagaggagtttcagcgattttgtaaaaataatggcattattcataaaacttcagctccttatcatccagcgacaaacggagcggccgaaaactcagttaaaaccctaaaatatgcaataaacaaaatgttaacaggctccccgagcaagagtatatctgagttgatttcaaaatatttattttcttacagaactacccctcattcagtgacatttcaaactcctgcctatctcatgtttgggcgtaaaattaaaaccagatttgactttttgacatttaacgatgacattgagagctagagaacaacagataaaataccataaaggtaatagggtggtagaatttatagaaggagaagatgtttatgttagggattacagggtaaatgcacaaaagcctaaatgggcaaagagtaaaatagttagaaaattaggacatcaaacatttctatgtcagcctttagataatccaagtcttgaatggaanagacatttggaccanattgttaaatgtggtcatttttacgatgaagaaatatctaaaatttctgatgancaggatagagatacatgtgatccactaangtcagttccaagtacttctg

SEQ ID NO: 9890 - DNA, 215 bp, Diabrotica virgifera
  misc_feature (22)..(46): n is a, c, g, or t
  misc_feature (80)..(93): n is a, c, g, or t
  misc_feature (96)..(118): n is a, c, g, or t
  misc_feature (126)..(148): n is a, c, g, or t
  misc_feature (178)..(209): n is a, c, g, or t
aaattaccttagggataacagnnnnnnnnnnnnnnnnnnnnnnnnnttgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9891 - DNA, 870 bp, Diabrotica virgifera
  misc_feature (486)..(499): n is a, c, g, or t
  misc_feature (501)..(513): n is a, c, g, or t
  misc_feature (587)..(604): n is a, c, g, or t
  misc_feature (766)..(783): n is a, c, g, or t
  misc_feature (812)..(831): n is a, c, g, or t
acaaaacgaacaaaacactacaaattcaatcgaattaaacgatcacgcgaatctaaaaaacactcaccattttcatcacttataaaaatcatccctagactttttccgaacgcggcgtaacgttcagtttcaggaaccaggaggatcatagagggtaaccaaggggagagttcggggagttataaccccccattcgggaacggtactttcgagctctcatacgcttaaacaccggttatcgagtaattgaaagaggttggcggacaaatcgagacagtttgaaatagtaacccctccaccccttaggatcattcctcgtacacccaggagtatagcccccttcggtaccttcggactcggcttttggtttgttttttggtatgtagattccattttttcgacggtaccagtctgaaaacccgtcagataatttgttattaacaatttatttgtttaaatgaacgtatcgtaataaactattagagnnnnnnnnnnnnnngnnnnnnnnnnnnngtcccttttgaaaaaatgaatactgaaaaatggttctcagcctgggtaccctcgaaaaatcggatccacacatnnnnnnnnnnnnnnnnnncacccctctcctagactatattggagttgcgtctctttaaaaaaagagttaaaagttaggggtaatcaattattacggattttgtttcagtttttacacttagaatattggtattataaaattactaatttaacagggtaatgtttcgattatacaggtctnnnnnnnnnnnnnnnnnntttaatacctaatagttttttgatatggnnnnnnnnnnnnnnnnnnnnctgggcttggtttggacctttagccacgtattatatcac

SEQ ID NO: 9892 - DNA, 789 bp, Diabrotica virgifera
  misc_feature (2)..(44): n is a, c, g, or t
  misc_feature (52)..(164): n is a, c, g, or t
  misc_feature (174)..(779): n is a, c, g, or t
  misc_feature (786)..(786): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattnaat

SEQ ID NO: 9893 - DNA, 874 bp, Diabrotica virgifera
  misc_feature (714)..(734): n is a, c, g, or t
  misc_feature (755)..(772): n is a, c, g, or t
  misc_feature (809)..(809): n is a, c, g, or t
  misc_feature (827)..(827): n is a, c, g, or t
aagcaataggtttagctgctgaaggtgacaatcgaaacgtagacaaactcgttagggatatatacggaggtgactacgcacgattcggacttccaggagatttagtagctagtagtttctccgccttgtgtagctttggacaaatgaattcgagagaaaggcgcagcaacgtcaccaaacaggatctggctagagcgacgttggtaacgatcactaacaacatcggatctatagcgagaatgtgtgcgatacaggaaaaaattgaaagggtggtcttcatcggtaactttttaagagtaaatccaatagcaatgaaactattggcttatgctatggattactggtccgacggtacaatgaaggcactcttcttggaacacgaaggatattttggagcagtaggatgtcttctgcagttccacgaagaattgaaaagttaaataatgataaagtcatctgtgcacatatataattctatgcgaatccttaaattagtttctgtgagataacatgtatctctttcgcgaaaggaagttataaagggtaatgattttgtgagattgtcgaaagtatattccgtttactattttgtaacaggaatcttttttcaaacatcgattctttgatatattatcgataatcgaatactatcgatatgtagttgaatgacatgatgacgttggcagttaacattcgtcattatctcattatcgnnnnnnnnnnnnnnnnnnnnncactgtacagatctcgaaagnnnnnnnnnnnnnnnnnntacatagttaatttctgagagtacatgagattacttngaatcaattttatattanaccatactgtataaacattatagtaataaaaaagtgtatttattccc

SEQ ID NO: 9894 - DNA, 238 bp, Diabrotica virgifera
  misc_feature (2)..(194): n is a, c, g, or t
  misc_feature (202)..(237): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttannnnnnnnnnnnnnnnnnnnnnnnnnnnnnnnnnnng

SEQ ID NO: 9895 - DNA, 900 bp, Diabrotica virgifera
  misc_feature (809)..(809): n is a, c, g, or t
cgtgtacctatgtgtcgtaccaaataaagcagtaccgtgtgtttgttattggatctttgatagttgcaattagatattttctgacagtgtaagtaatagaattagtaaattaccaaaaaaaatggccacgactaatgagcaacgattaagccatccaccaggaggggatatcacgatagaagaagaaaaagagagcgaaatttgtaaattttataaagacaaaactgttttaataacaggcgcaacgggttaccttggaaaattagtaatggaaaaattattaagaagctgtgatgttaaaaagatatttattataattagagaaaagaaaggcaaagatccacaaaaaaggtttgacgagatatttgatgaaccatgttttgaacctataaaaaggaaaaatcctacatttaaacaaaaattcaagtattaattggagacgcacaattcccaaattttggtctaagtgacgaagatatagaaactctaaaagcggaatgtcaagtagtctttcactatgctgctactgtcaggtttgatgaaaaaattagaacagctacatatattaacattagagctgtaagggaccttataaacataaccaaagaaatgaaacatttaaaggcatttttgcattgctctacagcgtatttcaattgtatacatcctgttatagaagaaaaattttatgatccgcccatcgatccagagacgttaataaatttagtagacaccttagatgaaaatactttacaggccattactccagggttacttggtaaatatccaaatacatacacatttacaanatgtattgctgaagccattgtaagaaaagaagcaaacaatattccagctgctttattccgaccttccatagtgatcgccacagccaggaac

SEQ ID NO: 9896 - DNA, 762 bp, Diabrotica virgifera
  misc_feature (26)..(60): n is a, c, g, or t
  misc_feature (81)..(147): n is a, c, g, or t
  misc_feature (150)..(178): n is a, c, g, or t
  misc_feature (191)..(209): n is a, c, g, or t
  misc_feature (211)..(297): n is a, c, g, or t
  misc_feature (306)..(462): n is a, c, g, or t
  misc_feature (496)..(515): n is a, c, g, or t
  misc_feature (692)..(708): n is a, c, g, or t
  misc_feature (710)..(725): n is a, c, g, or t
  misc_feature (728)..(741): n is a, c, g, or t
ggaaagttattaagaacggggagagnnnnnnnnnnnnnnnnnnnnnnnnnnnnnnnnnnncggaccccggggaatcgggannnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnngaatggaaaggtnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggtggatattattagaattaaaaattggannnnnnnnnnnnnnnnnnnnggtttattaagggaattcggcaccttttttttccccggttaattaaaaacttgtcttttggaattaattataaggccccgccggccccttgattattttgatgtgccgcggaatttggacggggttaaggaaccttattcttaagttttttaatggaaggttggatggaggggtggnnnnnnnnnnnnnnnnncnnnnnnnnnnnnnnnnggnnnnnnnnnnnnnngttaaaaggtttaaatttttt

SEQ ID NO: 9897 - DNA, 237 bp, Diabrotica virgifera; identical to SEQ ID NO: 9225
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 9898 - DNA, 382 bp, Diabrotica virgifera
cgtccgctgtaagactaccttgatttatagaccctatccagatttttctaacctgataatggtagttccccacttagatatccctcacccgaatatccgaacggaaaataattatagatccgcagcattttacctctcgagatgtcatcatttctgtataagtttttattgcgtttgaagaaagacttttcattattatggcctgaaaagattttttggatatttgatgcctgaatgccttttctatcaccaccatacctctgcgcctgcacgggttaggcaatacaccaccaatgcaaccaaagtgcagtattaccccacagccgcctgcatttttgttgataagccaggatccctactggaaggactgacctattaaccg

SEQ ID NO: 9899 - DNA, 82 bp, Diabrotica virgifera
  misc_feature (45)..(76): n is a, c, g, or t
attttacatgatctgagtttaaaccggtgtgagccaggttggttnnnnnnnnnnnnnnnnnnnnnnnnnnnnnnnngaaagg

SEQ ID NO: 9900 - DNA, 842 bp, Diabrotica virgifera
  misc_feature (127)..(144): n is a, c, g, or t
  misc_feature (309)..(572): n is a, c, g, or t
  misc_feature (576)..(653): n is a, c, g, or t
  misc_feature (659)..(703): n is a, c, g, or t
  misc_feature (716)..(841): n is a, c, g, or t
gtccgaatttctctttcaaaataaatcaaaatcatctttttcagtcaaaaggtaaaagaaaaaatctttcacctcaatcgataagttcaattcagtatccgtggagatgaaatcattttcacttctnnnnnnnnnnnnnnnnnnctcttcttttcgtaaccttcgtcgtattcaggggattcaccaattcaataattctctaattcatatttttcgaaattaaaagtgctaaaaaataaaattttcatctaaataaatatttaaatcattttttctaatcgaaacgttatttcgtttttaaatcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatnnnnnnnnnnnnnnnnnnnnnnnnnnnnnnnnnnnnnnnnnnnnnnnnnnnnnnnnnnnnnnnnnnnnnnnnnnnnnncaccgnnnnnnnnnnnnnnnnnnnnnnnnnnnnnnnnnnnnnnnnnnnnngcccaccgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 9901 - DNA, 539 bp, Diabrotica virgifera
  misc_feature (96)..(136): n is a, c, g, or t
  misc_feature (238)..(257): n is a, c, g, or t
  misc_feature (476)..(494): n is a, c, g, or t
ccccgacccttgcggccgccctattttaagataacacaatattttttacccctactaaacaaaaactttatttaatgatacccaattattattgannnnnnnnnnnnnnnnnnnnnnnnnnnnnnnnnnnnnnnnngtaccttgtgcatcagggattattaatcaatcattatctattcattatattcgcatctgcactagctacgcaatcacactttttactgtagactacatatcnnnnnnnnnnnnnnnnnnnngaactgttattcgtccttctatatatctaattactcaagacataaattaactttatttatcacctatatacttataccttacatatttttatcttattatcattccatattttgcggcatgagcttcaacacaaaatcttctcagaatctaattcttagatattacagtagtgcattacacctttcatatttcaccatatgctattattcattcttacnnnnnnnnnnnnnnnnnnncctatcaatatttcattaaaatttcctttcgaattatctcaatat

SEQ ID NO: 9902 - DNA, 693 bp, Diabrotica virgifera
  misc_feature (16)..(59): n is a, c, g, or t
  misc_feature (79)..(124): n is a, c, g, or t
  misc_feature (126)..(181): n is a, c, g, or t
  misc_feature (194)..(243): n is a, c, g, or t
  misc_feature (245)..(295): n is a, c, g, or t
  misc_feature (304)..(350): n is a, c, g, or t
  misc_feature (364)..(461): n is a, c, g, or t
  misc_feature (479)..(535): n is a, c, g, or t
  misc_feature (537)..(549): n is a, c, g, or t
  misc_feature (626)..(643): n is a, c, g, or t
gatagtaaataagaannnnnnnnnnnnnnnnnnnnnnnnnnnnnnnnnnnnnnnnnnnnggaacctggggaatcagggnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnngaaaggtaatccnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnngggaggagnnnnnnnnnnnnnnnnnnnnnnnnnnnnnnnnnnnnnnnnnnnnnnngataaaaaatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggaggataatataannnnnnnnnnnnnnnnnnnnnnnnnnnnnnnnnnnnnnnnnnnnnnnnnnnnnnnnncnnnnnnnnnnnnnggttaattaaaaacaggccttttggaattaaatataaagccccgccggcccactgataaattggaagggccgcggannnnnnnnnnnnnnnnnnaagcataaccataagttttttaatggaaagctggaaggaagggttggatg

SEQ ID NO: 9903 - DNA, 92 bp, Diabrotica virgifera
  misc_feature (14)..(89): n is a, c, g, or t
ctagacgagaagannnnnnnnnnnnnnnnnnnnnnnnnnnnnnnnnnnnnnnnnnnnnnnnnnnnnnnnnnnnnnnnnnnnnnnnnnnncgc

SEQ ID NO: 9904 - DNA, 526 bp, Diabrotica virgifera
  misc_feature (2)..(51): n is a, c, g, or t
  misc_feature (61)..(110): n is a, c, g, or t
  misc_feature (125)..(177): n is a, c, g, or t
  misc_feature (199)..(213): n is a, c, g, or t
  misc_feature (215)..(227): n is a, c, g, or t
  misc_feature (232)..(269): n is a, c, g, or t
  misc_feature (275)..(297): n is a, c, g, or t
  misc_feature (426)..(443): n is a, c, g, or t
gnnnnnnnnnnnnnnnnnnnnnnnnnnnnnnnnnnnnnnnnnnnnnnnnnnatgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggtgnnnnnnnnnnnnnnngnnnnnnnnnnnnngttgnnnnnnnnnnnnnnnnnnnnnnnnnnnnnnnnnnnnnncctaannnnnnnnnnnnnnnnnnnnnnngagatgggttaggtttagatgatgtttgggtatcaatctattgatcacaatagtgttagtattattggtggcttcacacctgatgtagtcattatgatagggatctgtaatctttagtgggtcattcannnnnnnnnnnnnnnnnncatggtataatgggttctactttacatatagtattctatcgatttgcggcgtatttataggggaatgcttttcaacgatgaga

SEQ ID NO: 9905 - DNA, 464 bp, Diabrotica virgifera
gaaaggaggtatcagcatctgtttcctccagatcctcattaaaatacatatacatatggattatgaatattatactaaataccagatatctacgatattgcacgaagaatgaagatcgaatgcacagacaagcctaaaaacagcacccatcagcgccaggactcatatacatggaaataaaaaaaacagaggatcgcgttccatagtgtacataaaaaaatcaggtactaatactactacctaaaattccctggtctttggaaaacttatgatactaaaacttatattttttgctcacaagcacactgcttgtgacatgtaggtgtcactaaccgacaacctccgtagctatgtacacctatgccgccacaatgcatgtgagcaaaatgaatctatgctgactcgtcgatatggcaatattttttattgcacataatgatagcgacttggattctgccctcctc

SEQ ID NO: 9906 - DNA, 896 bp, Diabrotica virgifera
  misc_feature (4)..(66): n is a, c, g, or t
  misc_feature (525)..(569): n is a, c, g, or t
  misc_feature (693)..(722): n is a, c, g, or t
  misc_feature (748)..(778): n is a, c, g, or t
cacnnnnnnnnnnnnnnnnnnnnnnnnnnnnnnnnnnnnnnnnnnnnnnnnnnnnnnnnnnnnnnnctatttcttctataaattttttattaccctataaagttaacttatttacgtttagtactgacgataacattagtattaaacagttgcacatccagcacctgtatatacgtctaatacaggaattccgcgacatatctttcacccgactcttcacagcctggctttatctatccaccacagaaatccgcccacccgctcccaccctaagtcgcctccctctcttcgccctaagagatcccctgtgaccccaacatgccctctcactattgactataggtacgccccaccttccttcataccgcggacctccaattccgcatggccgcccgcgccccacgccccccgcccccgggcccgtgggggcgggcccctccgtctctccttcgggtccccttaatcccatttcgctgcgcccggcgatcaagcgcgcccccccccgggcccccacccccggcgtannnnnnnnnnnnnnnnnnnnnnnnnnnnnnnnnnnnnnnnnnnnnggcggaccccaccaaaacccccccgcgacgaacacccccccccaacatttccccacccccgcacggccaccgcgaacagcaccctttgaccccccccccaacgcacccccccccctttgagtcnnnnnnnnnnnnnnnnnnnnnnnnnnnnnnaaccccccaaaacccaagaccacgannnnnnnnnnnnnnnnnnnnnnnnnnnnnnntctccccacaccccgggccgcgcggcgcccccgcccgcgcgcggccggggcgtggcggagggccctccccgcccccgacgcgcccccccaacctccaacacgtcgccccccccccccc

SEQ ID NO: 9907 - DNA, 823 bp, Diabrotica virgifera
  misc_feature (205)..(251): n is a, c, g, or t
  misc_feature (507)..(526): n is a, c, g, or t
  misc_feature (625)..(646): n is a, c, g, or t
  misc_feature (653)..(676): n is a, c, g, or t
  misc_feature (690)..(690): n is a, c, g, or t
  misc_feature (712)..(712): n is a, c, g, or t
  misc_feature (723)..(723): n is a, c, g, or t
tgaccaaaccgttgcggatatgtgtggcccaacctttatccgttcttataaggtgacctgcccagcgccatctttgtatatttgcagggggttttaatattgatacaactagtggttgaaccttattttccacataccattgtcgtagatgcgtcccaatatttttcgggttgtctttcttatttaagtttattagttgtatttnnnnnnnnnnnnnnnnnnnnnnnnnnnnnnnnnnnnnnnnnnnnnnncgcatactttactcttaaaacctaatcagccagcaacaacttcattatttgtaatattaccactacacattagacctttttacttttctactattgtagctagtggtacctacttcatttgttaaatattatatgttatttttccattttctacaattttaaaggcaattatctcgtaaattcaatgcaaaaattcagtgcaacatatatttacctttactgatggtttaatcctaaccttataattccatagatnnnnnnnnnnnnnnnnnnnngtttgaattttattcaagatccgtgaaaccactcatgtaatgagagtctgtgtaatgttgaataaacaatgtactgttaactttacaaagaatatttannnnnnnnnnnnnnnnnnnnnntgtgtcnnnnnnnnnnnnnnnnnnnnnnnncgtgatagttatgncaacttagtgattccgaataanagtattgattntagaactttaatctaatgcctttactcattatcttctatgaagtttgtatatttttatcattataatattatatattgtatctaataaaatgtactactc

SEQ ID NO: 9908 - DNA, 963 bp, Diabrotica virgifera
  misc_feature (4)..(766): n is a, c, g, or t
  misc_feature (837)..(838): n is a, c, g, or t
  misc_feature (845)..(868): n is a, c, g, or t
  misc_feature (876)..(894): n is a, c, g, or t
  misc_feature (931)..(953): n is a, c, g, or t
cgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttatttgggagagtcaaatcgataataaagattgcgacctcgatgttggattaagttnnataaggnnnnnnnnnnnnnnnnnnnnnnnntgttcgannnnnnnnnnnnnnnnnnnttgagttaaaccggggggaggccggtggtttctatcnnnnnnnnnnnnnnnnnnnnnnngaaagggcca

SEQ ID NO: 9909 - DNA, 898 bp, Diabrotica virgifera
  misc_feature (623)..(623): n is a, c, g, or t
  misc_feature (774)..(774): n is a, c, g, or t
  misc_feature (794)..(794): n is a, c, g, or t
  misc_feature (809)..(809): n is a, c, g, or t
  misc_feature (872)..(872): n is a, c, g, or t
atttatcatatcgtgtttattgcggtctacctccttttttgaattttaaattctttgttcctttgttcgcgttgtcattaattaaaggaaaattataattgaacacagtttatgttagtgtgaagttaacccgttagttatcctaaaatgtctatcttaattcaaaaaagtcgcatgttttaccgcctgataccgcttaggagcttcatgcttgttccacagaagacgacgacgctaagttcaaggttcttccttacatcagctgtcaacagaaatgtatcaacaaagcaaaaatcttcgagaggttcagaatggcaaatgataattactcgatttttaccagtcggaatatgcttagtagccgttatgcagtggagagcattaaggaaaagacaaaaggaaggaattgcaagtaaatgggagatcaactgttattgtttacttcctttaagaacagtatctagatgttgggggtatatagccgatgtaacactacccgaagtactgaggcctcccgtttacaaaatgtactccaacgcattcggtgttaacatcgcagaagctgaaaacgaggatttaacgtcttaccccagtctggcagatttttttgccagatctcttanaagtggtgtaagacaagtcgacgagagtagctgtcttgtatcgccatgtgacgggacggtcctccatttcgggactgttgatactgaacaagttgaacaggtaaaaggagtaacatattcactaaaagacttttttggtgagaatacaggnaaaagttcaaaatacaatgnagacttttagacctncttattgcacaaaccacatgagggaaatgtattgtatcacatgcgtatctacttggcacctgnagactatcacagatttcattcacatc

SEQ ID NO: 9910 - DNA, 931 bp, Diabrotica virgifera
  misc_feature (852)..(852): n is a, c, g, or t
attatttttaataaatgaaatgtctgtctgtctgttctcttctccctctttttctcttcccgttctctttctttcttcctctctcttggttttctgttactctcttccttccctcttttccctcttatcttctctgtcttttccattgcttttgattacactggttctagatccgatttattccttttcttccacttctcgcctccagcttttctcccctcgaatttcgtccctttcgcccccgctgctctcttccgcctttattgttttcttttttgtcccatttttcttcccacgagatgggtcgtgctgttcagttcagtgggtcagtgcgcccttgcccctccaaggctattttccactcgggctcgctatttcccttaggcatcgcttgtaacccactatgttacccttgggccatcaccccttcggcatgatagtgttacaccttgaggttggggtggcggtatattaggatgatacatatagccgtcatccctatgcatatccgtttgttttagtggtttcctcaactgatctcagaggttttctcctcgggtataggtttgggtatcgggacgtgtacgtgatgggtaggggtaggcgtcgtatgatagttgggagtattaaagctatgtcacagggacaggttatgactttggctattggagagcggacagctgctccaatttgttgccttttacgatgagcaggagaagctgtggaggtattctacttaagcggcccgcctccacacggggacgagaaaatatctaaaaagtccgaagccgccagccgtttgaatgaaaagtattcccgactgcttatgacatatgtacttgcaaagggcangcatacataaatatatttctgatattttgttagatgggatgaaaaagactacaatgataatgaaactcttttagtatat

SEQ ID NO: 9911 - DNA, 1037 bp, Diabrotica virgifera
  misc_feature (2)..(822): n is a, c, g, or t
  misc_feature (902)..(902): n is a, c, g, or t
  misc_feature (941)..(962): n is a, c, g, or t
  misc_feature (985)..(1028): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagcgtaattttattgcagagttcaaatcgataaataagattgcgacctcgatcgctggataaagtntataattggtgagcagtatattattcaagtcctgtcgannnnnnnnnnnnnnnnnnnnnnagtttaaaccgtgtgggacccannnnnnnnnnnnnnnnnnnnnnnnnnnnnnnnnnnnnnnnnnnngaaagggcc

SEQ ID NO: 9912 - DNA, 93 bp, Diabrotica virgifera
  misc_feature (4)..(42): n is a, c, g, or t
aagnnnnnnnnnnnnnnnnnnnnnnnnnnnnnnnnnnnnnnnaatttattatgatatagtatatttcattcttctataacatttattattctt

SEQ ID NO: 9913 - DNA, 569 bp, Diabrotica virgifera
  misc_feature (23)..(41): n is a, c, g, or t
  misc_feature (43)..(64): n is a, c, g, or t
  misc_feature (137)..(154): n is a, c, g, or t
  misc_feature (227)..(244): n is a, c, g, or t
  misc_feature (332)..(347): n is a, c, g, or t
  misc_feature (349)..(365): n is a, c, g, or t
  misc_feature (395)..(435): n is a, c, g, or t
  misc_feature (451)..(483): n is a, c, g, or t
  misc_feature (485)..(498): n is a, c, g, or t
ggccccggccccgaaccccccgnnnnnnnnnnnnnnnnnnncnnnnnnnnnnnnnnnnnnnnnncttgttaacacaaggcaaaaaaaactttcttcaacggcaggtaagtcagcctcgggggaaaacaatttattcnnnnnnnnnnnnnnnnnnctttttggaccctggggcaccagggatcctaaataagaaatattctcttactaatttccaaattcaaacaacnnnnnnnnnnnnnnnnnnaatggaaaaacaaacatttcaaataccttcttagaaaggaaacggctatcccgtctccaaatatatctaatttctctagaactaaacnnnnnnnnnnnnnnnncnnnnnnnnnnnnnnnnnctatctctatattattactatcaaacaccnnnnnnnnnnnnnnnnnnnnnnnnnnnnnnnnnnnnnnnnnctcttaaataaaaacnnnnnnnnnnnnnnnnnnnnnnnnnnnnnnnnngnnnnnnnnnnnnnncacaacattcactttaatcttcacaaattttttattctaatataaatgtaaataatatatatttacaacag

SEQ ID NO: 9914 - DNA, 576 bp, Diabrotica virgifera
  misc_feature (164)..(181): n is a, c, g, or t
  misc_feature (459)..(476): n is a, c, g, or t
agaactagtccgatcgcatggtcggagacggctcgtgtctgaaaattttgaaagccaaaggcgtgggagcgctgtggatattagtaggcttgttaccactttttggaatggttacaatggttacttacctattacagtgtgcgttcaattaaacatggacgacnnnnnnnnnnnnnnnnnngacactatgactatccaacttaaaaataggttttgtaatttaaagccaaaaattttcagataggtcctctcatcaatttgtacagctatatggacaaaaatttgacacagtaaagttaaaaacagaagtttttataatgatccagattatcttttaaaaaatgtacaacaattgtatcaatatttaacgtcttcagaagttgataatggatttcaggaactttttaaattggcaaacctatttttaataatgccggctacaattgcatccgatgaaannnnnnnnnnnnnnnnnnaacggattaatacgtgccttagaaataccgaattgcaagatcgcatgtggtcattttcttacaataccattgatgcacgcttattaaaatgatcttatga

SEQ ID NO: 9915 - DNA, 968 bp, Diabrotica virgifera
  misc_feature (38)..(61): n is a, c, g, or t
taaaacgaaaggtaccatttatttagacttgcttatannnnnnnnnnnnnnnnnnnnnnnnaataggaactgataacaggaagtggataaccgtccaatttttagaaatgtgtcctatatccggcttggttcagtttctgatagttcttgtaacagtgttgctggtatgtcatgcggtaatagtaaagagttgcaaggtcactttcaagcctaattctaccaaaatacacatgtatgattctgttcaagtcgcatacaacgtagataaagatcaaggaggcgagtatattcttttttccgaagatgataatatagcatcacttgacaaagaatatcttatatcgacaatatacgataattggaaaggaagttttaatataactggtaactttttgggtaaaactagagtgtcctgtagaaaaaaaatagaaggaactaaaacgccaaacagcagcatggatgttatagttataagaaaaaagcggtttattgataaaatgtttaccggatctgtggctacattaatcagtattttgtatattaattttggttgtgctttagactggaaagaacttaagacaattcttaagagaccaattggaccagcaataggattattcggccattttgtcataatgcctctgctgagttataccttaggagtattattgtttccaactagccccgaaatgcagttgggtctctttttcacgggtgtatcaccagctggaggtgcgtcaaatgtttgggccgtacttcttgaaggaaacataagtttatcaatcacaatgacagctgctagtaccatagcagctttcgctttcatgccattatggattttcacactaggcagagtaattttccagaacgccaatttgaaagtaccatatgtagagataatgacttatgttgttgcattagtggtacctttggcgattggttatttaatacaaagatatttgaaaaag

SEQ ID NO: 9916 - DNA, 820 bp, Diabrotica virgifera
  misc_feature (236)..(255): n is a, c, g, or t
  misc_feature (359)..(385): n is a, c, g, or t
aaacgataagtggctccgattatttatttaatcgtaactatattttattcgctaaattttcgatttttcgaaattttcgtcaaataaaagtattattaaataagtattcacattttaatcattttttcgaagaattatcgtaccaattttatcagtttatatttgcaaccacgtttttatttgttttattactatttaatttaatacagttttttattaaatatgtaatcatggtnnnnnnnnnnnnnnnnnnnngtatcaaataagctgccctttaaataaaaatttcttcgcgaaccaaacttatcatctgatatttcttattatttcgagcgaagaacaacatacgaagtcaaacnnnnnnnnnnnnnnnnnnnnnnnnnnncattctttcactttaaaccatttagaattcttagaaaataagcgtgcttattatcattaaaaactttcttaaacagggaatttaaaaaaggtcacctctctattcatagatgttttttttattctaagtcagtatttgtcagtcaatttttaaccttttcacgtaggaataggaaatccagaataaagcttggtgggcttctttgaccagatctggtattacatttggttgtattttcagcgtgaattcaccacaaaggtaacaaatgtaaataccatttaattttctggtataatgatacataccatctctggtatcctatcattattttgagcatttaattatatttaatcactttttgttctgaccaatatcaataccaaatatctttttctagactactccactcacacatcatataactataaactgatc

SEQ ID NO: 9917 - DNA, 962 bp, Diabrotica virgifera
  misc_feature (8)..(8): n is a, c, g, or t
  misc_feature (50)..(50): n is a, c, g, or t
  misc_feature (837)..(837): n is a, c, g, or t
  misc_feature (851)..(851): n is a, c, g, or t
  misc_feature (878)..(879): n is a, c, g, or t
  misc_feature (903)..(904): n is a, c, g, or t
  misc_feature (921)..(921): n is a, c, g, or t
cacagatncggtagtagggacacattcgtgggtaaaaatttttatatcgntgttattaaaatgaatcggtactctttgagttattgaagatcagggatttgtctgcttgagagcacacgcgtgaagttacggatcgatggaaggaaaacgttggttaatcgtgtgttaccgaaacgttatttttgtattatttcgatattataaatttagcaaaagtgtattcgaatatgtcaaatgtacccattattggacacccccagtttctggatatattcagtttataatgaaaaaaaaattcaattaaatatcgaaataatataaaaatgatgttttgctaacatgcaattgattaacatgttttttttatcatccgtaacttcacgcataatgtgctcttaaatagacggatctttgatctttaatagctcagagagtgttgatttattaataacatggtataacaggttttacttaagatttgtccctctatcgatttgtggggttatttttaatggaatggttttcacccgtgggaaggaatggtattcaccaccaggggaaaagtgcacgtggcaccaggtcagttttgtttcttgaggtatgctctggctagtcaccggttttcgtgcaaatcgatggaggtgtaacaaaataggaggtgaaaacctttaatgactgcactaactttcccctttcatcccttattgctactttctgtatccactggggtgtcagcctgaagggggtcatagttctcagtgtacagtggacacatttcacaggaaaaactccatattacttatgacgatgattttttggctctagctctccatttgntacaccatttttanatgggtgttacaaatatttctgtgttnngtctctctcctacggcgctacagnnctaagtcgggacctggnctccctcagcatccgcctccaagaatctctggcccctggtg

SEQ ID NO: 9918 - DNA, 697 bp, Diabrotica virgifera
aattgtttatatgtaatgtcaaaatcatatgatttttgatccaattttctgcaatattctctgggcgatcctggtcctgaagttatttgaacattgataagtttatttgaaaatgatataatatcaacaaatttatagtatcaagattatggtcgaggaggaaatctcaccaaataatatcaaataaaatcacagtgagaatatgaatgaaaatatattaggtattgagtagactgcacgtcgttaacaaatgtcaacatatgctgacaatgacgtgtgtgcaatggtcaaatcttagcacctccagtgtactatgaccccgtggctgcctgtctctatgtgagtatggcagccattgctactgtatggccagcctcacttaacgaagatattgatggacgtattgcggctctattgtgctgggatctcttatttcacaccgagagtttattgtgctatgttagcacaaactaattcatgacgcttatgtagatgtgagatacctactgatgatccataatatggatattgtaggttggataaaaggcgtataaaggaaccagaaacagatattgatcgctttcatttgcaatgctttcttgaaatattgtagaaaccgtcattctgtgtgtggcatgagttatacagcaaaaaaaggttgtgattgtatagtattcgttattttggtatttttttt

SEQ ID NO: 9919 - DNA, 115 bp, Diabrotica virgifera
ctttttttattcgtttttctaatatctcttttgtttctgaaatattaaaatctattacactttgtgcagatttatctatgccctgactcatatataatttctttggtcttgactg

SEQ ID NO: 9920 - DNA, 301 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(296): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagc

SEQ ID NO: 9921 - DNA, 765 bp, Diabrotica virgifera
  misc_feature (122)..(143): n is a, c, g, or t
  misc_feature (378)..(397): n is a, c, g, or t
catcaaagaggttttgaagaaacgataagtactgtacgtccagatcttataaaaaacaaatctataaagttaagttctgctggtttagtttatgcccattttggttttgaagtattagacgnnnnnnnnnnnnnnnnnnnnnnacctacaaatactgaatgcttaagatctatttttgtgtatgtatatgaagttttatgtaatgtgtgcccggtgtcgactttgatcatttccattgtgactgcggttaaagatgatgcacctctggtagttctattgcaaggttttgaggtaccgagtgatgaccatatatcctccaattcataggaaatgtcgttgtatgagctccctaagtatcaatacatctgttttcaagannnnnnnnnnnnnnnnnnnntggggagatatacttgatgggatccagcaagtctacgatcgagaagcgacgcataattcacgttacatacagctctatacacacgtctataattattgcacttccgttcatcaacagaacaatggacgatcttcggctattgctaatacgaagggtgaaacgaatcagatcggaggaggtgccctactagttggaatataactttattagactctgagagactttcttacgaactatcttgtgactttgctcatagatggactacatcgcatggatgaagacgttctcaaattttatacgaaccaaggggaggattatcagttccgtagtaaagtgctcgatggtgtatgtgcatatcttaatagaca

SEQ ID NO: 9922 - DNA, 496 bp, Diabrotica virgifera
  misc_feature (146)..(160): n is a, c, g, or t
cgggagatgcgcaatggctgctccttaaaacctaccaagtttcatttgtatgtctcaaccagttttggagcaataattgaatcgtcagtttgtaggaggaaattcgacatcccgtacctcggaggcagggcatttgtggacatatnnnnnnnnnnnnnnnggtcattgttttttcatgcagaattaattgccccttaaagtttgtcgcacttgtttggaaacaccttgtattgatgaatggcattgttagttgttaaagtgcctaacttttttgttatccaacataagcgaatgaatcaagaagcggaatgttgggagggcctaaggctacagttgagttttagtttcaatgttttatatgcgctggaatgttccacagggtgttccgaactttgaagaaaaggcacactatcattgatatatccgggatacaatgacacatctcttaagcatcaatatagtgacatcgattgtcttgaggcatgaagttataaca

SEQ ID NO: 9923 - DNA, 1228 bp, Diabrotica virgifera
  misc_feature (31)..(58): n is a, c, g, or t
  misc_feature (74)..(86): n is a, c, g, or t
  misc_feature (89)..(112): n is a, c, g, or t
  misc_feature (144)..(174): n is a, c, g, or t
  misc_feature (181)..(195): n is a, c, g, or t
  misc_feature (197)..(213): n is a, c, g, or t
  misc_feature (215)..(227): n is a, c, g, or t
  misc_feature (244)..(264): n is a, c, g, or t
  misc_feature (1072)..(1101): n is a, c, g, or t
  misc_feature (1185)..(1222): n is a, c, g, or t
agcgactcgaagtgaggttgtctgtggtgtnnnnnnnnnnnnnnnnnnnnnnnnnnnntcccttgaggatttannnnnnnnnnnnntcnnnnnnnnnnnnnnnnnnnnnnnnggaaagaaagtagctgcagctcctcttgcagnnnnnnnnnnnnnnnnnnnnnnnnnnnnnnncccactnnnnnnnnnnnnnnntnnnnnnnnnnnnnnnnntnnnnnnnnnnnnnctccccgtgatttatcnnnnnnnnnnnnnnnnnnnnnatacatccgtattcaaagaatgtgggctgtacttcttaggagagctgcagatacatggactcataacacaagtgtctcacacaatagttgtaggtacatctaaccactaaaaggtcactggaagaaaagcagatgtcatcctcgcagcacattatgcttcacaagctgctcttaggcttctaaagcctggaaatgaaacctatgccatcaccgaagctgtacaaaaagttgctgaatcatataagtgcaagccagtcgaaggtatgttgagtcatcaactgaaacaatttaaaattgatggtgagaagaccataattcaaaaccccaacgatgcacagaaaaaagaacatgagaaatttgaattagacaaacatgaagtatatgctatggatgttttaatcagtacaggcgaaggagtaggaaaagaagctgacactagagtttctgtctatatgaaaacagatgaaatctatcaattgaaactcaaagcatcaagaatgttctatactgaagtgaggacgaagtatggaaatatgccttttcatttaaggaatttccagatgagacaaagcaaaaatgggagtggtgaatgggtaaagaataggttgttagaacctttccaagtctatatgaaaaacaaggagaatttgtggcacccttcaaattccccgttctgtttatggcaaaccgggccccttaaaatccaagggactgcccttgggaccttgaattgcccaaatcaaaacattcatatttcgaccccaaaattaaatccatccctcaaagttctgccacccccaaaagttgnnnnnnnnnnnnnnnnnnnnnnnnnnnnnntttccccccctcccccaacccaggggaagtcgaaaagagctggtttagaaaggggctcccaccaagaaaaaaaagtgaattttnnnnnnnnnnnnnnnnnnnnnnnnnnnnnnnnnnnnnntttttt

SEQ ID NO: 9924 - DNA, 1180 bp, Diabrotica virgifera
  misc_feature (38)..(62): n is a, c, g, or t
  misc_feature (70)..(108): n is a, c, g, or t
  misc_feature (110)..(183): n is a, c, g, or t
  misc_feature (192)..(748): n is a, c, g, or t
  misc_feature (754)..(845): n is a, c, g, or t
  misc_feature (852)..(931): n is a, c, g, or t
  misc_feature (1037)..(1055): n is a, c, g, or t
  misc_feature (1059)..(1082): n is a, c, g, or t
  misc_feature (1091)..(1169): n is a, c, g, or t
gatagttaattcgtatcgtgagagaaatcttttcattnnnnnnnnnnnnnnnnnnnnnnnnngtacctcnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttattannnnnnnnnnnnnnnnnnnnnnnnnnnnnnnnnnnnnnnnnnnnnnnnnnnnnnnnnnnnnnnnnnnnnnnnnnnnnnnngataaattaacttacgggtaacagcggatttttattggggaggtccaatcgatataaagatggcggcctccagggtggagtaaggtttttaaatgggggagcagcnnnnnnnnnnnnnnnnnnncgannnnnnnnnnnnnnnnnnnnnnnnggtttaaannnnnnnnnnnnnnnnnnnnnnnnnnnnnnnnnnnnnnnnnnnnnnnnnnnnnnnnnnnnnnnnnnnnnnnnnnnnnnnccggcccgggc

SEQ ID NO: 9925 - DNA, 426 bp, Diabrotica virgifera
  misc_feature (2)..(410): n is a, c, g, or t
  misc_feature (420)..(420): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgatccantttttt

SEQ ID NO: 9926 - DNA, 711 bp, Diabrotica virgifera
  misc_feature (103)..(120): n is a, c, g, or t
attactaaatctagtttaaaatatttacaatagtgacttggaatgtaaaaactaaatttacttacacgtacaagttacctttttgttgcagtcctttatacannnnnnnnnnnnnnnnnngcttaaacatgttgcctaaaattttgagaaaataacataaaaaattgatacattatgtacacactcaccgacaaaataaaccgcccgccttgtatttctctcaatttgcagaaattgtcaaacttggaccaagaagatttactgctaaacaaactttatcaaggaatgcttggcaaaagtgcaatgtttaaaaatcttgaagaaaattcagacaaacaggattttggaaatcatagtctaattaaaaaaatgagtattaataatggatgttccgtctcaggcccttatgacttctttgagccgattcggcaatccattcatgatatccgattggaggatacctattgagctactcctctgacgcacccgtcttgagctctaccgaaggatgtagaggctgctactctcactattatttatgatggtggaactaacaatccataatacagcgaggaattatatctaccgccttatccctagtgatgagaaaaaacatgattacgcgcgagtccattaaataacgtagaagttttgagataatggaacatagtattcctgaagacaccaattactttttgacttcctggatat

SEQ ID NO: 9927 - DNA, 787 bp, Diabrotica virgifera
  misc_feature (2)..(44): n is a, c, g, or t
  misc_feature (52)..(770): n is a, c, g, or t
  misc_feature (773)..(773): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtntataaattattaat

SEQ ID NO: 9928 - DNA, 820 bp, Diabrotica virgifera
ccgcccaagactccaagattattgcatacaatttaacactagctaataatccatctttcataccatatctatcaactgatgaaatgatagggtacttaataactgttcctgctgatgtcttgaacattgcctctgcaacaggtgtttcggaaacacctgccaactaacaaatcgtcctaggatatttctacgcccctgtagactgaccgtaacacagaaatgctatcatcacagaagatatgtatacagctgttgaaccagaaaaaatgaatcaagttccattgttaatgggaatcgatagtgaagaaggactagatagatctctgtatccaaactggacaaacgaacttcctatcatcaacaatgacgataaacttctcagcaaccatcaatatgcgcataagttgtaataaaactctgaatgcagatgcccagacattaagagaaattgataccaacgaattattgctaaactatcactcaacagcaattaggaatttcaatgacatgtcattcaaaatacccattattcgtcatggtgaactacaatccacactccccgatggttatttctacccattttcctatgatgggaaactatgtttaggcggaatctagaactacgtagaactcgcagatcagttactacattctgaagacaccaattacttttaagacttctggaaatatgccccattttggacacttacgatcctgaatactttctgaatagcacaaatgaagactgttactaactaatttgcaaatacggaaccaactccaaatagagctaaatcttgcaaaatatttcctgggccca

SEQ ID NO: 9929 - DNA, 760 bp, Diabrotica virgifera
  misc_feature (12)..(12): n is a, c, g, or t
  misc_feature (223)..(242): n is a, c, g, or t
  misc_feature (386)..(408): n is a, c, g, or t
  misc_feature (685)..(706): n is a, c, g, or t
gttagacctcgncgagtttatcgagggatttttttgtgctgtgattagccgagtgtgtctagtgttcgcttgattgtggaattaattgcttgaggaagatacaccgtcgttttaacgcaattcaagtgaaaatgtgggatttctacaccctgccattggctgcaattggattaatagtgctcatctcttttatgctagactccatatggaatattttacaaannnnnnnnnnnnnnnnnnnnccattgtttatatcaactgaagaaacatcacttgcaaaaaagtttggaccatgggcattgattactggatctactgatggcattggtaaagcttatgcatttgaattggcaaaaaggggtattaatatcgtattggtcagcagnnnnnnnnnnnnnnnnnnnnnnnctgcagaggatattgaagcaaaatattttgtgaaaacgaaaataatagcagctgatttttctcaaggaaagaaagcagttgatattgtgaaggaaaaagttggaatattgccaattaatattttagtcaataacgttggaaaacagtatgactaccccatgtacctctcagaagtaccagaaaaagatttatttgatatgatcaacatcaatgtgggagcagtaactttactatgccgagccttcatcgaagacatgaaacaaagaggacgaggtgnnnnnnnnnnnnnnnnnnnnnngtcggagttgcagccgtgccctctgatggctgtgtatgcagccacgaaggctta

SEQ ID NO: 9930 - DNA, 1210 bp, Diabrotica virgifera
  misc_feature (464)..(495): n is a, c, g, or t
  misc_feature (612)..(629): n is a, c, g, or t
  misc_feature (632)..(644): n is a, c, g, or t
  misc_feature (716)..(738): n is a, c, g, or t
  misc_feature (938)..(957): n is a, c, g, or t
  misc_feature (1006)..(1022): n is a, c, g, or t
  misc_feature (1025)..(1037): n is a, c, g, or t
  misc_feature (1069)..(1118): n is a, c, g, or t
ctcggacatctcggtgtagagcatgagcaaactaaatttgtaaatataataaatgtaatgtagagttttgaatcgttggttttgaaacataataaaatggaagtgaaacaagaatttaatgaggagacgtgcaaaatagaaacagaggataatgacttggatgatgctcttctagatggctttaaatgtgaaattaaagaggaatccaatatacaaagtacacctggcacatatgattatttagaggaaattcctacaaatactgaaatacaccaagatccaaataaactgaatccattggaagaaaaccaaaccagtgaaaaaggttttactcaggaggagaataaaatgaaaatcatggaaacattttgtgaacactcatcccgtaaacaacactatacgagtcaaagcgccaaaggaaaaactggaaataagaatataaaagttcagactagaccgaaacnnnnnnnnnnnnnnnnnnnnnnnnnnnnnnnntctaaaacagatcaattgaaacatttaagaacgcacagtggagaaaaacctcacaagtgtgaaatctgttttaaacaatttagtcaagcaggtcaattgagaaaacatttgagagtnnnnnnnnnnnnnnnnnntcnnnnnnnnnnnnnctgttttaagcagtttagtgaaacaagtgatttgaaagtacatttgagagtacacactggagagaaacctcnnnnnnnnnnnnnnnnnnnnnnncagtttagtctaacaggaattttaaaaaacattttgaaagtgacactggagagaaaacctcccaaatggtgaattctgttttaaacaatttaatccagcaaggtcatttgagaaaacattttgaaaaggcacccttggaaaaaaaacctcccaaggggggaaaatctggttttaaaacaagttaagggaacaaagggggnnnnnnnnnnnnnnnnnnnngaaaagaacccccctgggaaaaaaaaaccctccccagggggggggaaannnnnnnnnnnnnnnnngcnnnnnnnnnnnnncacccagggggaaattttttttagacgggccnnnnnnnnnnnnnnnnnnnnnnnnnnnnnnnnnnnnnnnnnnnnnnnnnncccccaaaacggtgtggtaaaatatttttgtgtttttttatataccaaaagatctttttttttttacctacccaaggggcgttttttttttt

SEQ ID NO: 9931 - DNA, 425 bp, Diabrotica virgifera
  misc_feature (13)..(38): n is a, c, g, or t
tcacataataagnnnnnnnnnnnnnnnnnnnnnnnnnncgctcattcataagtgcaaagaactaactatttttatggcacactgaatatatagataaacgttttgtattgaaatgttattcttgattagatatatataagtattaccaaatgaagtagaattatttaatagccaatcaatataagtatatagatttctactatgaatattacatatcattatggatgaacttgtcattaatgttgattacaagaaaatttttatagagcaattaagattgaggattcccatattcacatatatgttgttattataactgtactattataattgtaatatacctatgagctcagtagtaaaacataaggtataatttacccaaatggagtactgattataatattatgatatgataagtatatatt

SEQ ID NO: 9932 - DNA, 546 bp, Diabrotica virgifera
caacaatttcttactcgaatgtcttcttgcgtttatttgtgaccggaccggagttggtagtgcttgaaaaagataactcatcattaagcctataccaaagcccttatagattattagcgttgacaatggaacagcacatcaccattgcactgaaaataaatctctcacccatcctcaactagattctacaaaccacaaaggacttcggtactgtctgaacaggatccctaggtaaacttcgtctatacaaactactactggcctgcaatgacctctacagcatcatccgactcctccaaaacgatactgcaatcacgtcccactagacgagaggaaatttttggagacgactctattgacaacatgagagctgaatgacgcgagtatatgcacgatattgtggctgctgctgaaaatagacctttgcctgctctagtactggctatacaacataaataaactataatggaataaatcatgattgtatttcatgatgccgctacaaggctgtatgacgaaataatgcttacagcagatgacatttat

SEQ ID NO: 9933 - DNA, 396 bp, Diabrotica virgifera
  misc_feature (351)..(373): n is a, c, g, or t
atccaaactatatccgcagtacctgcgccgaatcctcaatggggaggaggcggtaacggtggcgttggcgttaatgttggcgttggcaaggactctggcgttaacgttggcgttgacgttggcaaacctggcgttggcgttaaggtcggcgttaaccctaacttatttaacttaggtatacgtgtgggtcagtgagttggaacacaaaaccaaaccagtgattttagctcaaagtgataaaaactgttcttaatgaaatgttcatacctaattttacatgtggactctataaaattgtacattttatctatctctattttatatgtattgtatataagtattacagtatgnnnnnnnnnnnnnnnnnnnnnnncctaataaagatttttggatttt

SEQ ID NO: 9934 - DNA, 701 bp, Diabrotica virgifera
  misc_feature (9)..(49): n is a, c, g, or t
  misc_feature (51)..(89): n is a, c, g, or t
  misc_feature (91)..(126): n is a, c, g, or t
  misc_feature (177)..(216): n is a, c, g, or t
  misc_feature (218)..(234): n is a, c, g, or t
  misc_feature (309)..(373): n is a, c, g, or t
  misc_feature (457)..(483): n is a, c, g, or t
  misc_feature (523)..(542): n is a, c, g, or t
  misc_feature (559)..(578): n is a, c, g, or t
  misc_feature (659)..(677): n is a, c, g, or t
ggcatcacnnnnnnnnnnnnnnnnnnnnnnnnnnnnnnnnnnnnnnnnncnnnnnnnnnnnnnnnnnnnnnnnnnnnnnnnnnnnnnnngnnnnnnnnnnnnnnnnnnnnnnnnnnnnnnnnnnnntttttacatatatctaactttgtaagaaataagttaaatttatttatcatnnnnnnnnnnnnnnnnnnnnnnnnnnnnnnnnnnnnnnnncnnnnnnnnnnnnnnnnnccttagaactacacttgtatgaacatttaatttttacatagaaattaggattagaaattttcatattataaaacnnnnnnnnnnnnnnnnnnnnnnnnnnnnnnnnnnnnnnnnnnnnnnnnnnnnnnnnnnnnnnnnnttcaaattatttaactttagaactgatgatagtatcagtattataagactgcatatttaatacaaatatatatgactaataacnnnnnnnnnnnnnnnnnnnnnnnnnnnattattacaaacatgtctattcgacttaaatatctcgtcnnnnnnnnnnnnnnnnnnnngtcgagtgtgcgcgagnnnnnnnnnnnnnnnnnnnntcatactcatgacatcttttattgctggctggaatgagaggctgaatgattctccaactgtctttatataatctctatacnnnnnnnnnnnnnnnnnnntgagcttagatgtttttaaaagac

SEQ ID NO: 9935 - DNA, 274 bp, Diabrotica virgifera
  misc_feature (15)..(51): n is a, c, g, or t
  misc_feature (62)..(84): n is a, c, g, or t
tagcgggcggttagnnnnnnnnnnnnnnnnnnnnnnnnnnnnnnnnnnnnntcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 9936 - DNA, 243 bp, Diabrotica virgifera
  misc_feature (22)..(22): n is a, c, g, or t
  misc_feature (27)..(44): n is a, c, g, or t
  misc_feature (58)..(59): n is a, c, g, or t
  misc_feature (61)..(62): n is a, c, g, or t
  misc_feature (65)..(65): n is a, c, g, or t
  misc_feature (68)..(68): n is a, c, g, or t
  misc_feature (71)..(71): n is a, c, g, or t
  misc_feature (85)..(86): n is a, c, g, or t
  misc_feature (96)..(114): n is a, c, g, or t
  misc_feature (124)..(146): n is a, c, g, or t
  misc_feature (174)..(174): n is a, c, g, or t
  misc_feature (179)..(179): n is a, c, g, or t
  misc_feature (197)..(199): n is a, c, g, or t
  misc_feature (238)..(238): n is a, c, g, or t
ccctttaagggcgcccacgcgnccgcnnnnnnnnnnnnnnnnnnttttgaagaggaannannggnaanaanggacaaaagaacannaacagggcannnnnnnnnnnnnnnnnnnaaaaactcannnnnnnnnnnnnnnnnnnnnnngaccaaaagggaaaaacgaaacacaaangaaangacaggacaaaacaaaannnagaacggaagaaccccccaaaggaggagaaagcacccancagaa

SEQ ID NO: 9937 - DNA, 601 bp, Diabrotica virgifera
  misc_feature (4)..(38): n is a, c, g, or t
  misc_feature (42)..(558): n is a, c, g, or t
tttnnnnnnnnnnnnnnnnnnnnnnnnnnnnnnnnnnntacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggtgagaacattaagatttaaaaaattttttctctcctt

SEQ ID NO: 9938 - DNA, 800 bp, Diabrotica virgifera
attttgaactaaaagatggtagtgcaaaacgtatcatagcattcgaagattcagaacaaaccaaagaatctgtcgagcgtgctcaagatagcgacacaaaaaatattgcaatcgatgaaaatgctgcgcaagtggccatagtaacagatgacaatacagtacaaccaattaaaatatcagaacagattgctaaagcagttcatgatgaaaccaaagaacctgtcgaatatacacaagataacagcacaaacaatattgcaatcgaggaaaatgctgcgcaaatagccatagtaacagataacgatactgtacaggcaattaaaatatcagagcaggttgctaaagcagttcatgatgaaaccaaagaacgtgtcgaatatactcaagataacaccacaaaagatattgcaattgaggaaaatgctgcgcagatagccatagtaacaaataacaatacagttcaaccaattgaaatatcagaacagattaccaaagcagttcatgatgtgtttcatgatgaacgtgatgaaaatgacagtttgactaatgtaggaactgtagaagaccaagaaaaagtaacaagtaatctagaagctcaaactgtaaaacatacggaaccggaaagaaatattagagactcttcaagtaatgcactaaataccaacatatcagcctcatctgtatcagagcacatagttgctgaagatgatagtgttggacagtttgctgaattagtggaaaatgttccagatattattaacatcattcaagaacatcctaggagacaacatgattcatat

SEQ ID NO: 9939 - DNA, 127 bp, Diabrotica virgifera
  misc_feature (2)..(126): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9940 - DNA, 102 bp, Diabrotica virgifera
  misc_feature (10)..(33): n is a, c, g, or t
cccccctttnnnnnnnnnnnnnnnnnnnnnnnncaagcgatgcatgccttttcctaagaatattctctggtgcaggacaacctcataggagctataccaata

SEQ ID NO: 9941 - DNA, 822 bp, Diabrotica virgifera
  misc_feature (29)..(29): n is a, c, g, or t
tccttacgtccggatcctttgtaaaaggnatatttttattaaacttccctttcaggttacgttacaaaacgttttcggagtaacaatttcatcatgagtgctgcttacagatatacatgctttgagccaccaaaatatatggataaaaaccctttaaatattataaagttttagtgtagtaaataatatgtatgtttaaacttttccttgattttccatcacggcaacgtaagacttcatgaaacacactgtgggttgctagtcctaaagtagtcctacgatttgtgttctaatcttaggactagcaacacacactttggggaaacatcacatattattttctacaaaaatgtaactttcttacaactttataatattcaaagaggtgtcacccagatattttaaagttggagtaatattgtcaatagcggtttttagacgcccgtcgtctgaaatattttttgttcctgacgtttcgtgggaaattgaatacagcagtattctgtaaagaataattataaatcgaattctgtccaaaaaatgtaaataccttcaagatctacatgagctatcagttttagacctcactcataggtactggagaactaaaaaatctatacctttggtagaaagttatctaagtacggtaaagtacagtgaagttatctataaaagcccaattccgccttactacagtgcaatgacaaaaacattattttctaacaagggtaaaacatgttattttaagctcacatttaccgccaaatattgttgatatacttattagagaaaaatggtcaaattttcaatacatatttaccg

SEQ ID NO: 9942 - DNA, 1068 bp, Diabrotica virgifera
  misc_feature (280)..(302): n is a, c, g, or t
  misc_feature (375)..(395): n is a, c, g, or t
  misc_feature (448)..(469): n is a, c, g, or t
  misc_feature (581)..(581): n is a, c, g, or t
  misc_feature (772)..(853): n is a, c, g, or t
  misc_feature (866)..(954): n is a, c, g, or t
  misc_feature (963)..(991): n is a, c, g, or t
  misc_feature (1003)..(1036): n is a, c, g, or t
cccacgcgtccggtaggaggaccggaagcaggtaaacaaacaacatttctttcgagattaatcgatatgttcttttctattccacaggctgtttacaatctgaaataactgctactccctagtagctgtattctttcatcgtgaattttctggcaatcggtagaaatcatccatgggattcgagaacacgatagtagtctatataaatacccatttaagttgggacgaattcagtgtggttgtacgcgatcgggttaaataataaattaaactttgtaannnnnnnnnnnnnnnnnnnnnnngtagtggaattagtatgtttgatttttgtatacatttttaaattagtttgtaattaaagaatataaattcagnnnnnnnnnnnnnnnnnnnnnacctaagtattaataggaatctcgaaataaacattacaatataataattacannnnnnnnnnnnnnnnnnnnnntaacaccacatttttgttatttataggacacaatataaaaaagtattataaaaacaattatttatcaaatcaaaatgtcaattgtaaaaataaaaggatttctgcctcttgngtgaaagccaggtatcctagccactagaccatattggattggtggtatggagataaatacttggcatataagttctagtgcaacagtattaaaataactatgattttttggaataaataaactcatgcctccatgtaaaagctgtagaatattgcattgtcatcgagttctgagttatactagttctagannnnnnnnnnnnnnnnnnnnnnnnnnnnnnnnnnnnnnnnnnnnnnnnnnnnnnnnnnnnnnnnnnnnnnnnnnnnnnnnnncccttaatagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttttnnnnnnnnnnnnnnnnnnnnnnnnnnnnngtgcgatccccnnnnnnnnnnnnnnnnnnnnnnnnnnnnnnnnnntaaggaaaaacaacaccaaattttatattggg

SEQ ID NO: 9943 - DNA, 773 bp, Diabrotica virgifera
  misc_feature (171)..(200): n is a, c, g, or t
  misc_feature (320)..(343): n is a, c, g, or t
  misc_feature (345)..(360): n is a, c, g, or t
gtttactaaaaaaaattaaatgttgccgatatttattataccgttacgaatatgtatagttacgaactgtcgccgtgacgaaatgtcgctgttacgaattgtccgttaccatgtgtggggtcacggactgtcgccttacgagatgtcatggaaccgtttttaaaccgtccnnnnnnnnnnnnnnnnnnnnnnnnnnnnnnttctttcatattgttcttatgtaaaaagcgcataaatttttgttcgtttaaattttagggtatgatataattggaaaaaaacgtattatttttgtctgggagaagagaatttatagaacnnnnnnnnnnnnnnnnnnnnnnnncnnnnnnnnnnnnnnnngaatctttgcgtttatttttaatttgcacctatattggaaagtgagttttcgttttatttaaaaacttgtttttttctatacctacttaagaatagactagaatactagaacattatagacatatttgccaaaaacgccttaacttatatcacttccatactgtcttcggaatacagtaatgtatattaaaatgtttgcacaaactacaaaaacaacaaactttttctgtacctaacaaaaatttatgcctttcacttttgataaaatgcattctttgttataataatatattatatctttgcttgatgtttcaaatttctaatactgtatttacattaggtacgaatatttttaacaatgttttttgttacccaatatatatgtaaaccttgtcttaaatattttgtataat

SEQ ID NO: 9944 - DNA, 666 bp, Diabrotica virgifera
atatcgtacgtgaacaaagatagtcaaaatggggaaaacaacttattatggtactgcttacgatcctattcaaactgaagatgaatagtgcgggatctatcaattatgcgataactaaagatacaggtattgcacgaagtatagttccagaactttgggttgagaaggacggaaatactttatattactttggatatacatttacgggaagttggatccaagcattagagcattgcaaggcgcttaatatggatttagttagtatagaaacgagcgaagaaaatgagtatctttatgaccagatgaagggattttttggtggtcgggaccaatactctttttggacatcaggaactacattggcttacggcaaatgggcatggatggggacaggccgtccaattttgtataataactggtcagcaaaaccatctggtacaaaagacacgttctgtctagaggctaaatacgaacccaataataaaggtcttcaatggaacgaaaataaacaagatgcgagtctgcatgcaatctgtgaagctaaaattacagaggatctagtaaatataattcctgaattgtgtagttttaaagactttttaagcatagattaagtttgaaacaaacatggattatatttgatgaaataaacgtagccctcacact

SEQ ID NO: 9945 - DNA, 142 bp, Diabrotica virgifera
ggcgggggggggcggggcgggagtgcccgggcggccccccccctttgcgatatatattaattgttattaaaaagctaaaagaatcttttttaggagaacagataggcgagtgctattgagagatgggtagagtagaatcggg

SEQ ID NO: 9946 - DNA, 162 bp, Diabrotica virgifera
  misc_feature (2)..(15): n is a, c, g, or t
  misc_feature (18)..(35): n is a, c, g, or t
  misc_feature (62)..(86): n is a, c, g, or t
  misc_feature (90)..(111): n is a, c, g, or t
  misc_feature (114)..(148): n is a, c, g, or t
tnnnnnnnnnnnnnntgnnnnnnnnnnnnnnnnnnacgtgctaaggtaacctaacccttagnnnnnnnnnnnnnnnnnnnnnnnnngagnnnnnnnnnnnnnnnnnnnnnnggnnnnnnnnnnnnnnnnnnnnnnnnnnnnnnnnnnngtttaaaaccttaa

SEQ ID NO: 9947 - DNA, 384 bp, Diabrotica virgifera
  misc_feature (10)..(41): n is a, c, g, or t
  misc_feature (43)..(189): n is a, c, g, or t
  misc_feature (203)..(268): n is a, c, g, or t
  misc_feature (365)..(382): n is a, c, g, or t
ttaagtccgnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattttaatgaggnnnnnnnnnnnnnnnnnnnnnnnnnnnnnnnnnnnnnnnnnnnnnnnnnnnnnnnnnnnnnnnnnnggtgtttaaatatatctaattgtttaaagaataaattaaaattgttgattagcaagatatttataagaatatatttttatagaacaaatatgatatnnnnnnnnnnnnnnnnnnat

SEQ ID NO: 9948 - DNA, 956 bp, Diabrotica virgifera
  misc_feature (517)..(556): n is a, c, g, or t
  misc_feature (859)..(859): n is a, c, g, or t
  misc_feature (877)..(877): n is a, c, g, or t
caattataaacttttcacgatgacacgttccacaattaaaatcacattccacaattggaacttcccttgttgcagtgttctcgtacatcggagtttgtccgactagacaccgttgagctattaataggttttcagcttgccgttaataaacttttttttggtgcacggtatccaggcctataatatttatgtttttctatcgctttcaagtaacatgaagataactataaaataacattaacattcagatcattactaattaaactttcacataatgttttttcacgacagtcttttccttcctagtactttctttccctcgatattttgtttcactattagttgagcatattggtacttattatttctcagtatgtggcctaggtatgatcttttctaagtttcactgtgttgaaaagttcatattggtccgctttcttctaatcatccatcatccaaatttctatgtgttgccagtttacatacataatatgtacattatcaaattgttacgtannnnnnnnnnnnnnnnnnnnnnnnnnnnnnnnnnnnnnnngtatgttgattcctactgtaagctattccaaacgacaaaaccaaatagtcatttatcattagttatatatcagcctaaggtatctattgcattttatcttgcatcatagtcataccaagagttgcctttggtcagtagaagtacgttatttgtttataattctgtgatattttttatcaattgactagttttgtattccaagaaacatcgttgataataaaaataacatatagaatgatactgctttttagaaagattttttgcagccgtccaaaagtttttattagaatattagaaaggctntgaggtattttttattanaaggtaaaaacgatcaagggtaaaaaacggatcaaatgagccggtgaaaatgaaagtggcataagtcaatttaaaccat

SEQ ID NO: 9949 - DNA, 965 bp, Diabrotica virgifera
  misc_feature (900)..(900): n is a, c, g, or t
gtagtgttatatgataaatatttttctcttcaagctacgtgtcccttaggtttcagtgataaagttaggtttgcagtagaacaaagcatttgcggcgagaatggcctgatgccagattgttttcatcttccattaaagatcgtcgaaacagttctggaaaagaactacctaaaaccttttttaacttcccagttgttttataagtatttgtcagatctgataaacacggtacaagtgaatgactttgcgaactttgagcgatatccaaacgcagcttctgactgtagtagcgagaggagctttagtcagagcactttcttagcatttgaaatccctcccagtgcaatcaaaagaggagataagagtgcagatatgaccatcgacaccagggaattgtatgatcctgactctctctggaagagaaagaagtgttacaggctgtcattggggcgagttagtgaaataggcaagtacgaagctgattttgaacctgaacctgataggaagcagtttaggttcaaaagtatattcaagaaagtagttaataacgacgaagaggataggaagagagaagaaatggcttggcaagtagctgaaatgatagttaaggatataactaatgttacgttagggcaatcagacaaatgacttttgtaaatcgattttttagagcaaaacattgtgttgcgatttttctacaagggttaaccagctatagaattttttatactttatttttctgaaatttgattgcaaaacgtgtaatacagtggaaatactacgattagatggaataaaacgtcctatgtcgttttagagcttgtttaatacatttagttaataatgccagggaagacgctattctgtttcagaaatgtacacataaatattattacgttnattctgtgggatcagatattaaattaagcacagtgtgatttaactaactttatttaactcaaaac

SEQ ID NO: 9950 - DNA, 1138 bp, Diabrotica virgifera
  misc_feature (132)..(151): n is a, c, g, or t
  misc_feature (913)..(956): n is a, c, g, or t
  misc_feature (1007)..(1038): n is a, c, g, or t
  misc_feature (1046)..(1076): n is a, c, g, or t
  misc_feature (1114)..(1137): n is a, c, g, or t
ttgcggccggatacctgtcacacgtcattaaagcttccgctttttttagatttaaataagtatcagagaaacacagatcaagaattgagtcatactgactaatttagctgtcagttttaaacggtaactgcnnnnnnnnnnnnnnnnnnnncgaagaatatggataagtgaatatttctaattgtgtaagaagcaaaaccaaaaaatctatgatatctgatttaacaaagaaacaaaagatgaaattttgagtatgccacttttgctttaaaatattggtctctttttagatacctatattttgagtcaatttaacaagataactttaattatgcattttttgagttgtgtcacttttcttccggatgagcgatatgcaaacggatcgtcaatatcattgaaataattgatttggatgaaagttagtgctagatcttctcattagatgttatagtgttaggaaaattcaagttttttgtgctatctagatggtatacaatatggagacattcccctctaatatattactttcttctgcttcgttatacttttttttaacagggttacttactttatttttattggcattttttgcagcttggcacatatatgtagttgctcaaattgttttaattattgctctattttcatccctcacattcacttcttcccttcacatctatcccttttggttttctttcaatatgacattcattattgatataatatatcaataatgaatatatactgtatattatattatactgaatataccccaggaaacaaagccgaaaaatcacttgaaagccaaaaaattactggaattttttcatatttgaaacccttccttccctgggggaatatttttactaaaaaaaagtctgttggcttatccacttttaaagaaattaannnnnnnnnnnnnnnnnnnnnnnnnnnnnnnnnnnnnnnnnnnnaaatttcttattacccctccctttattaacggagacaaattgtttttggcnnnnnnnnnnnnnnnnnnnnnnnnnnnnnnnntattggcnnnnnnnnnnnnnnnnnnnnnnnnnnnnnnnaagatgttttaataaagatttttttttataccccgacnnnnnnnnnnnnnnnnnnnnnnnnc

SEQ ID NO: 9951 - DNA, 663 bp, Diabrotica virgifera
  misc_feature (379)..(395): n is a, c, g, or t
cttacacagtacttgtaatgattttgcaagtacttattgaaattataatgcccaagcagatagatgtctggattttctgacgtacctacatgtttaagcccaaactacatcattagaatacaagtttatgttatatatcataaatgttgtaaaaatggtaggtattaaggtttacttcagtctataggtatcattatgttcatgttcgctaaagatacatgagtcattttcgtcaggatatttcccgcatcataatgttttgtctgcagatttttgatggctcaggtagctaaaacggagagccatggaagtgggactacttttacgcatcatctgattgaggaccttatgtgctttatacacgaggggactgaagtcnnnnnnnnnnnnnnnnncatagtgagtctacttgccatgtatatccaacaagtttttacaagatacttttcttataatttcttcttgaattcactttatcctgagatatacactggtctcactacgcttgggatgtgtttttttggaaattgacttgactagtcaggtgaatctactgtagttattgagaactggaggaatgaatctaatacttctctcaaaaaatacccactggaaagaaaaagactgttggaatttgcaacctgctttcaatgtcatggcgat

SEQ ID NO: 9952 - DNA, 951 bp, Diabrotica virgifera
  misc_feature (802)..(802): n is a, c, g, or t
  misc_feature (816)..(816): n is a, c, g, or t
  misc_feature (893)..(893): n is a, c, g, or t
  misc_feature (908)..(908): n is a, c, g, or t
aaatagtgcaaatatttctattattcgatttcataattttttaagataatggcgttatcagaaactgaaaagaagtctgataaaaaggaaaaaccgttgaccaaagtaattattcgtcgtctacctcctacaattgaacaggaaacatttataaaacaagtatccccaattccagactatagttacatctataccgtgaatggggactttagtttgggagaaaacgcattttctagagtctatattaactttgtgcatcacgacgatgtgtatagcttcaaggaacggtttgataactatgtgtttcttgatgccaaaggtagtgagtatccatgtgtggtcgaattcgctcctttccagaagatccctaagaaacgtgggaaaacaaggatggatcccaaagctggtagtatcgagtcggatccctattatctagatttcctggaaaatttacagaaaccgcaagaggtcgatgagaaacctgagtatactcttcaactaacaagctcaagtgagaataaaaatgatgttacgactccactgcttgagtatattaagagtaaaagggcacagcgaatgagaatcagagaagttagaagggaggaaaggaaacgaagggaatttgataaacggagagaacattttgatgatagagatagagatagtagagataaaaagaaaatttctgaagaaaaatcacctacgaagaaatctcattcaaaatcagaaaatccaaaagcagaaaagactgaacctgaggcatctgcagtggaaaagcccgagaaagaagagagatactatngaaaatcgtactancagaacaaagacagaagatatgacgatagaagatttgaagataggcgtaaggaaccaaaaccaaggtatcccagaanaagatatcctgactnatagagtgatgaacgcaaggataaaaatatgagtacagcaaaa

SEQ ID NO: 9953 - DNA, 508 bp, Diabrotica virgifera
  misc_feature (13)..(13): n is a, c, g, or t
  misc_feature (18)..(18): n is a, c, g, or t
accttgcggccgnttcgnttgaatattttattctgtaacattacttttcaaatttaaaaacagatatatctacaaaaaatagaatgtacagtgaaataactaattaagatatcacaaagaaaaactaaacactactatctaagattccaagtataaaaagtattattgcaagaaaataatgaaactaaagcaccattaagttaatattgtgtgagttccagttctcgaaaataggtttcagtacataacataccaggataattcgtaaaaaaatgttccctatgccgccgagaacgagtgcggcgtactgggagaaatctggcaacactgccttacacataaactctcccgctctcttatccaactactttcgcctcgctgtattgctcagtgtcggtctagcagcctttgaagatggaggtcgcagtcacagttatcgctaatgtgaaattaatgccgtgatacgaaacttgttgatgcatattcgcaaggaagaactggtgacatc

SEQ ID NO: 9954 - DNA, 72 bp, Diabrotica virgifera
  misc_feature (21)..(65): n is a, c, g, or t
cgatagttaattaagtattcnnnnnnnnnnnnnnnnnnnnnnnnnnnnnnnnnnnnnnnnnnnnngaccttg

SEQ ID NO: 9955 - DNA, 181 bp, Diabrotica virgifera
  misc_feature (2)..(18): n is a, c, g, or t
  misc_feature (36)..(57): n is a, c, g, or t
cnnnnnnnnnnnnnnnnnattgaaaatatgttctcnnnnnnnnnnnnnnnnnnnnnngctttgtgttgccgatcttactttcagaatatgcagatgatgatagtgcctcttattcagattcgctattcttatatgacgaaaacaatataatagtatgttgtttgcctactgctatctattc

SEQ ID NO: 9956 - DNA, 920 bp, Diabrotica virgifera
  misc_feature (821)..(821): n is a, c, g, or t
ctccaaaccgtggagatattgatgattcattaggaaatttttcgttaactttaatcgacacattagatactcttgctatttttggagatctcgaagaattcgaacacgctgtcaaattggttatcaaagatgttaattttgataacgatgtcgttgtttcagtttttgaaaccaacattagagtcgttggcggattactgtcagcacacatcctgtcggaatatttgcaacaaagagatgggataatgccttggtataaaggagaacttttaaacatggccaaagatgttggataccgtttgttaccagcttttaatacaactaccggaatacctcattctagggtaaatatgaaatacggattgaaaagcgatcgactggaatccgctagggaaacatgcactgcttgcgcgggatccatgatattagagatggcagcactgtcacggttaaccggagaacccatattcgaaatgaaagcccaaaaagctatggatgagttgtggaagatgcgtcatcgtagctctgatctcatgggtaccgttttgaacgtccattccggcgactgggttcgtagagattctggcgttggagctggaatagattcctactacgaatattgcttaaaggcgtacatactactaggagacaacaaataccttaataggttcaacagacattataatgctgtcatgaagtatatttctcagggaccaatgctattggatgtacatatgcacagaccacatacgaattcccgaaactacatggacgcattactggcgttttggccaggtctttcagtcctcaaaggagacatncagccagccgtggagactcacgagatgctgtaccaggtgatgcagcgtcataagtcattccagaagcttcactaccgatttccaagtccattggggcac

SEQ ID NO: 9957 - DNA, 433 bp, Diabrotica virgifera
  misc_feature (25)..(25): n is a, c, g, or t
  misc_feature (277)..(304): n is a, c, g, or t
  misc_feature (307)..(408): n is a, c, g, or t
ttaaagccgagaaagtaatctacgntttattagatgttccctattaataatccacatgatagaaatattagaattgtgaccccctatcctcttgttccttggaaaggttttttttttctacctagagcatcgtagattgttcactaataaacatatcttaagtatttgcagactgcttaggatttgaacgattatacaccatttattgccaaatctgtattataattacttttattgttatgaattgctgttcgatcatacatatatctaattgtcnnnnnnnnnnnnnnnnnnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgattatataatttccttatttt

SEQ ID NO: 9958 - DNA, 302 bp, Diabrotica virgifera
  misc_feature (129)..(147): n is a, c, g, or t
  misc_feature (176)..(197): n is a, c, g, or t
tttagaggtgtatgtggtttttagatctctagaaactcaaatggtgcctgattgcctacatgataaacccctatttatagagtcatgataaagtgaataattgagaattcgaagagtttatgatatttnnnnnnnnnnnnnnnnnnngaaatggcaaaagtaatggaattcctacnnnnnnnnnnnnnnnnnnnnnngcaactaaaaaaaacggccgtgatagatggtaaacgacgaaatgtttttggatcaaatcccccttcacatggtctatcgcttacctcgacctcaaacgttttttt

SEQ ID NO: 9959 - DNA, 517 bp, Diabrotica virgifera
  misc_feature (18)..(18): n is a, c, g, or t
  misc_feature (24)..(494): n is a, c, g, or t
aataaaatattttttagnaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaattaatacttcccaatgg

SEQ ID NO: 9960 - DNA, 892 bp, Diabrotica virgifera
  misc_feature (2)..(18): n is a, c, g, or t
  misc_feature (20)..(789): n is a, c, g, or t
  misc_feature (794)..(828): n is a, c, g, or t
  misc_feature (839)..(840): n is a, c, g, or t
  misc_feature (852)..(874): n is a, c, g, or t
  misc_feature (877)..(877): n is a, c, g, or t
cnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatannnnnnnnnnnnnnnnnnnnnnnnnnnnnnnnnnnattatatatannattatttattgnnnnnnnnnnnnnnnnnnnnnnnctntttttatattattat

SEQ ID NO: 9961 - DNA, 928 bp, Diabrotica virgifera
  misc_feature (193)..(226): n is a, c, g, or t
  misc_feature (325)..(344): n is a, c, g, or t
  misc_feature (526)..(556): n is a, c, g, or t
  misc_feature (569)..(587): n is a, c, g, or t
  misc_feature (828)..(828): n is a, c, g, or t
  misc_feature (907)..(908): n is a, c, g, or t
aacaaatatattcaaattcttgacaaaaactaacaattctggattatacttatggcttttggtattcgatggtaacttcttgatgttgaatggtactgctgtggactcctcttgacctgggcagatgttgtggccctaggtcagtgcagctacggtcttgatggtgtcgtatttggatgttggatgctgctgnnnnnnnnnnnnnnnnnnnnnnnnnnnnnnnnnngccttagtgtcatcgccggcgataggcttttttgaagctcccagagggacgacggtgatcttatccaaaaaactagaatagtaaaatacatatcaacannnnnnnnnnnnnnnnnnnntgtgccgtctgccatcctaatcgtcagaaagagtagcagatgacaagaataaattaaatgaaatttagatgaggagaatagttaaaattttgattactaaacgtgcatacacgtaaattagaaagaaatatttaaaactaaaatatcaaaacacatggtttgacattggggttaggttagannnnnnnnnnnnnnnnnnnnnnnnnnnnnnngatgtagaaatgnnnnnnnnnnnnnnnnnnngaattttcttaccacaagagagcgatgatttgaataaaaatgatttcattttcaaattacatgcctatttaaggaataatttttcccttccattttgtgtcttctggtagggatgaagtgaactcatgacagtgcgacttttgaaatgacaaccaagtactagttcagtacaggcatgttccgtattgaaaaacagatactacagagtaggaatacggagtatgttcagttgatgatttanataaaagggatataggtacatattaaatagaagataataaaagagggtaataaaagaggataaataaagtggataatannagagggcgccaacgagtttt

SEQ ID NO: 9962 - DNA, 776 bp, Diabrotica virgifera
  misc_feature (2)..(720): n is a, c, g, or t
  misc_feature (728)..(766): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatannnnnnnnnnnnnnnnnnnnnnnnnnnnnnnnnnnnnnnatatataatt

SEQ ID NO: 9963 - DNA, 871 bp, Diabrotica virgifera
  misc_feature (582)..(602): n is a, c, g, or t
  misc_feature (793)..(814): n is a, c, g, or t
  misc_feature (829)..(829): n is a, c, g, or t
cgaatttattggacctagtattagaacaaatcgtaagaagatcaaatacactaagcatcagaattgacgtaccactttaaagatgggacatttttgatgtctcgtgtttcctaaacctgttgtccgatttgagtgattttttactatattatagctttattcttccaaactttgaggaggaacacactatcattgttgcacccggtatacagtgatacttatctgtttggcgacgatattattacatcgatattattgaagaatggaactataacattagggaaatcactaaaatcggacgacaggtttgggaagtgcaggacatcaggaatgtcccatttttggggtggtgcgttgattttgatgcttaatgtatgagtacaaacaactattttgaatagcaaggaacagtgcataggacacgcggatgatggggtgcgaaatcgagaaaacgaaaagtttttcagaaattttaagaagaggcgaaaagatacatgacacaaaatgaaatgagaagagacaacaaatggtttataaaccaacagcaagaacagaaaaaaaagtactggaaaagaaagttgnnnnnnnnnnnnnnnnnnnnnggaatactaactgcaaagaatatttggagaagaccaacaaataaagaaataatgagaatgtattctggaaaaacaataattacggcaaacatacgagcccaaacagctagatgcttgctgaaatgtttaaacaatactgaacgaaggagatgtgaggaaaaaagaagcggacgttcaaagaagaaatggtnnnnnnnnnnnnnnnnnnnnnnggtaaaacggacggngaaaatggagggaaatacaaactttttggaacagatgctaca

SEQ ID NO: 9964 - DNA, 499 bp, Diabrotica virgifera
  misc_feature (11)..(11): n is a, c, g, or t
  misc_feature (22)..(22): n is a, c, g, or t
  misc_feature (24)..(24): n is a, c, g, or t
  misc_feature (52)..(52): n is a, c, g, or t
  misc_feature (54)..(58): n is a, c, g, or t
  misc_feature (61)..(64): n is a, c, g, or t
  misc_feature (66)..(66): n is a, c, g, or t
  misc_feature (73)..(76): n is a, c, g, or t
  misc_feature (83)..(83): n is a, c, g, or t
  misc_feature (93)..(93): n is a, c, g, or t
  misc_feature (98)..(116): n is a, c, g, or t
  misc_feature (118)..(120): n is a, c, g, or t
  misc_feature (124)..(125): n is a, c, g, or t
  misc_feature (129)..(130): n is a, c, g, or t
  misc_feature (136)..(138): n is a, c, g, or t
  misc_feature (140)..(140): n is a, c, g, or t
  misc_feature (142)..(142): n is a, c, g, or t
  misc_feature (145)..(145): n is a, c, g, or t
  misc_feature (147)..(148): n is a, c, g, or t
  misc_feature (153)..(153): n is a, c, g, or t
  misc_feature (160)..(160): n is a, c, g, or t
  misc_feature (174)..(174): n is a, c, g, or t
  misc_feature (180)..(181): n is a, c, g, or t
  misc_feature (184)..(184): n is a, c, g, or t
  misc_feature (187)..(187): n is a, c, g, or t
  misc_feature (195)..(195): n is a, c, g, or t
  misc_feature (199)..(199): n is a, c, g, or t
  misc_feature (201)..(201): n is a, c, g, or t
  misc_feature (214)..(214): n is a, c, g, or t
  misc_feature (216)..(216): n is a, c, g, or t
  misc_feature (225)..(225): n is a, c, g, or t
  misc_feature (232)..(232): n is a, c, g, or t
  misc_feature (237)..(238): n is a, c, g, or t
  misc_feature (249)..(250): n is a, c, g, or t
  misc_feature (256)..(257): n is a, c, g, or t
  misc_feature (280)..(280): n is a, c, g, or t
  misc_feature (286)..(288): n is a, c, g, or t
  misc_feature (290)..(290): n is a, c, g, or t
  misc_feature (303)..(303): n is a, c, g, or t
  misc_feature (316)..(319): n is a, c, g, or t
  misc_feature (322)..(322): n is a, c, g, or t
  misc_feature (326)..(327): n is a, c, g, or t
  misc_feature (329)..(330): n is a, c, g, or t
  misc_feature (332)..(333): n is a, c, g, or t
  misc_feature (337)..(337): n is a, c, g, or t
  misc_feature (340)..(340): n is a, c, g, or t
  misc_feature (361)..(361): n is a, c, g, or t
  misc_feature (366)..(366): n is a, c, g, or t
  misc_feature (371)..(372): n is a, c, g, or t
  misc_feature (375)..(376): n is a, c, g, or t
  misc_feature (379)..(379): n is a, c, g, or t
  misc_feature (382)..(384): n is a, c, g, or t
  misc_feature (387)..(387): n is a, c, g, or t
  misc_feature (390)..(390): n is a, c, g, or t
  misc_feature (402)..(403): n is a, c, g, or t
  misc_feature (425)..(425): n is a, c, g, or t
  misc_feature (436)..(436): n is a, c, g, or t
  misc_feature (441)..(441): n is a, c, g, or t
  misc_feature (445)..(446): n is a, c, g, or t
tcagggccggnaaaggccgacnanaacgaacaaaaccccccttttaggcggnannnnncannnnanaacaagnnnngaaaacngaaacaacangaagnnnnnnnnnnnnnnnnnnncnnnggcnngcanngcaggnnnanangcnanncagcncaaaggngcccaccaagaacngaacannccnaangaagggancganangcacaaagaaggngngcacaaaangagaggncaagnngaagaggaacnnaaagcnncaaggcaaaacagggccaggggngcccannncncgaaagacaccanaaacagaccaggnnnngcngacnngnncnncgangcngccagcgaagaaagagaacangccancaaannganncanaannngcncangagaggagaacnnacatccaacccgagcgaactcnacaaaagaaancttgngccnncaagcaccacttgggacaatggtgtaagtgccttaaaaacaagctcttcagct

SEQ ID NO: 9965 - DNA, 567 bp, Diabrotica virgifera
ctagatatagaacgtaccccggaacaactaccattagtgccggctagtttattcctcatttttaacaaaagaataccgcataaaatcgcaattactcaaagtaagatagtgatggtcattaaaatttattgagcaaagcaaaatgagtgctgaaaattccagccctgctttgagtgtggaaaaatccattggtatactgctggatgtcgccggaacaacaacttctaacacgtttttaaaagataccctttactcttatgtaaccaaacaagctgaaaccttcctgaaggagtcatgggaagaacaagaagtaaaagatgcagtcaaacttatcaaagatgatcttgatcaagaagcagccattccactcattaaagagctgactgagaaaaacagtgataatgaaggcttgaaaaaagtacagggactgatttataaaaaaggctacaagaatggtgaattgaaagcacatgtatttcctgaatgtgtccctgctttggaggccctgggcccaatccccgtaaaacgctatatattccactggggagctaaaaacccaaaaacccc

SEQ ID NO: 9966 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 9967 - DNA, 482 bp, Diabrotica virgifera
  misc_feature (178)..(198): n is a, c, g, or t
  misc_feature (271)..(292): n is a, c, g, or t
  misc_feature (415)..(432): n is a, c, g, or t
acaatagaaaaaaagatttttcttgccagagcaagcggacaatgcacaacagaaataataataaatatgttagtttcggatatacaataactaatacatgcaaatcatgattatcccatatcaatatgaacttatactccgaaaaagaaattttcttcgtttataattacttctaaannnnnnnnnnnnnnnnnnnnntaatttagtaatactatatatataattaaacatttttataatactaataataatagatctctaagcataaccnnnnnnnnnnnnnnnnnnnnnnattctaatttttctcaccatatcacgtatcaaaattctcttagtttaaaatacgacattatttatttttacatatcatattagcctatactatataaacgtttgattaaaccatacacttacnnnnnnnnnnnnnnnnnntcattataatattattatcttaaatctcttttcttacgaaaaagaaatag

SEQ ID NO: 9968 - DNA, 319 bp, Diabrotica virgifera
  misc_feature (13)..(44): n is a, c, g, or t
  misc_feature (46)..(281): n is a, c, g, or t
  misc_feature (284)..(296): n is a, c, g, or t
cccttcagggccnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnntaaatacaattttattaagattt

SEQ ID NO: 9969 - DNA, 722 bp, Diabrotica virgifera
  misc_feature (200)..(238): n is a, c, g, or t
ctgaatattaaccggtagtgccaggtgacagtgtttaattaaatatccagaaaaaatgccaggcccttcaagacctctgtggcaagtagccggaaagcgtgatccagaacaagaacgcgaagctcaagcatggatagaagctgtcacaggaatgaggtttcctccaggagttccatacgaagattgccttagggacggtnnnnnnnnnnnnnnnnnnnnnnnnnnnnnnnnnnnnnnnatcatccaaaaaatcaacacatctggtggagactataaaatgatggataacttgaaccaattccaaaaagcttgtgtgaaatacggtgttcccgatgtagatcttttccaaacaactgacctgtgggacaggaaaaacatcgttttagtcacaactaccatttttgctctaggtcgcacctgttacaaacaccctgaatggcgcggtcctttcttgggacccagaccatctgaagaaaacaggagagacttcagcgacgaacaattaagagctggtgaagctattattggactccaagctggccaaaacagaggtgccactcaagctgggcagaactttggtgcttctagaaaaatcattttgggaaaataaacaaacattcgaagagacatattgaatctataaaaatagatgttatgtacctataaaaataacttgtttgaaatttacaataatttgattatacaaataaaatgtttacctg

SEQ ID NO: 9970 - DNA, 131 bp, Diabrotica virgifera
  misc_feature (9)..(109): n is a, c, g, or t
  misc_feature (113)..(130): n is a, c, g, or t
cgacaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttnnnnnnnnnnnnnnnnnna

SEQ ID NO: 9971 - DNA, 570 bp, Diabrotica virgifera
  misc_feature (170)..(189): n is a, c, g, or t
  misc_feature (346)..(372): n is a, c, g, or t
  misc_feature (486)..(510): n is a, c, g, or t
  misc_feature (518)..(544): n is a, c, g, or t
tccgtccgtatttgtataataatatcaagaagtatattagtttcaagataagatatagatatgatttcaatgtcatggttattatctattagtaatagcaatatctatatttttattcttaaaaaattctatttttactacccggagcatgaggctctagtaactaaacnnnnnnnnnnnnnnnnnnnnctattttccaatatataagagataaagaattatattgttccatagacacttaaactaattatataatactgatgtgttaatcggttatactatttctaatatatcaagaactatattaaatttattcattaacattcaatggacatataaatatacnnnnnnnnnnnnnnnnnnnnnnnnnnntaggttgttctaaggaggaagctttaactaaaacttaaattagaaatacaacttacaatcaaaaattatcatatcaaattacacgcaattaactataagtaaatatgaatattnnnnnnnnnnnnnnnnnnnnnnnnncaaaagannnnnnnnnnnnnnnnnnnnnnnnnnngtaatgtgaatcttagtattgatgat

SEQ ID NO: 9972 - DNA, 311 bp, Diabrotica virgifera
  misc_feature (2)..(132): n is a, c, g, or t
  misc_feature (138)..(241): n is a, c, g, or t
  misc_feature (247)..(287): n is a, c, g, or t
  misc_feature (292)..(292): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgannnnnnnnnnnnnnnnnnnnnnnnnnnnnnnnnnnnnnnnnaatantttttttgatccatttttt

SEQ ID NO: 9973 - DNA, 87 bp, Diabrotica virgifera
  misc_feature (15)..(86): n is a, c, g, or t
aagacgagaaacccnnnnnnnnnnnnnnnnnnnnnnnnnnnnnnnnnnnnnnnnnnnnnnnnnnnnnnnnnnnnnnnnnnnnnnnng

SEQ ID NO: 9974 - DNA, 287 bp, Diabrotica virgifera
  misc_feature (2)..(15): n is a, c, g, or t
cnnnnnnnnnnnnnntgatcatttacaaatagggttctggaaattcgaaggttacctctctaccagtaagcttcttgtaaactgaagcaaaagtatcaaccttatgttcaatagtagtttgttggtttttgtccaaatgtactttgatgagttgtgatccatctaaccttacacgaatcctcttgcccacgatttctgcaggaaatacaagatcttctaagatagcatcatatactgaagtcaaagtacgagaccttggtcttttttgtttgatgtccgcacgcgtt

SEQ ID NO: 9975 - DNA, 693 bp, Diabrotica virgifera
  misc_feature (4)..(118): n is a, c, g, or t
  misc_feature (127)..(142): n is a, c, g, or t
  misc_feature (144)..(156): n is a, c, g, or t
  misc_feature (159)..(185): n is a, c, g, or t
  misc_feature (187)..(281): n is a, c, g, or t
  misc_feature (296)..(349): n is a, c, g, or t
  misc_feature (356)..(417): n is a, c, g, or t
  misc_feature (420)..(454): n is a, c, g, or t
  misc_feature (503)..(521): n is a, c, g, or t
  misc_feature (576)..(594): n is a, c, g, or t
  misc_feature (613)..(642): n is a, c, g, or t
atcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcggcannnnnnnnnnnnnnnngnnnnnnnnnnnnnagnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttttaatctatcnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnnnnccttagggggaaaacaggggtaatttttttttgtggaaagttcacatcnnnnnnnnnnnnnnnnnnngtcccccccaaggtttgggaataaaaaagttattaaaatggggggggaggcagannnnnnnnnnnnnnnnnnnctcttgtttccccacttcnnnnnnnnnnnnnnnnnnnnnnnnnnnnnnggggccgttttaaaaaagagggagggggggagagagaaaggggggtggggt

SEQ ID NO: 9976 - DNA, 718 bp, Diabrotica virgifera
ccgtaaaaggtgtctttttgacccaggagtgtattttcagacacatgtttaacatccagtcacaattagtaggaaaaatggtgtcgagactgttcagagaatcaacattattgaataaaaatcatacactcaactttcaaaagcaaatgttctggacaaaattttattgaggacttcgtaaaacgcgtagaaattttttaaaagtgacacatgacgtcttgcgtgtaatgacagatgtcaaaactgagagtaattcgttttcacgtaacgccatctatgaacgcctaaattaacattaagctatattttgaatgtatatgtatataatgtgtatttatatgtatattttggatttctgtttgaaacaaattcatttgttaagattatcccggtatctatccatttttgttgacttattacattgtgatttactaagtagaaaaatctaagtactttgtactaatctagctaataaacaaggcaactgtatgttacttttgatggtcaatgttttatgtattgtgaaatatctgccgaacatttaatagactgatttactcgagatccaagaaagttttaagtttcatacttcatagaggtatgtcattttattattttgtaatgtttgataatttattgtcatattagttataaataataaattacctactactaaacattaaaatattctattaaattttcgaaaaaaaaataacaa

SEQ ID NO: 9977 - DNA, 1130 bp, Diabrotica virgifera
cgcatcgctaccatgttggctgtgaatacttttaaacaaacatgtgtaaatcaagcgaaatatttacatatctatcgaaatttattacgaaaagtgtcttttaaattatccgatattggtgaaggtatcaaagaggttacagtgaaagaatggtacgtaaaagaaggtgacaaagtttcccagttcgataatatctgtgaggtacaaagtgacaaagcttccgtaactataacaagtagatatgacggcgtgatttccaaattgtattacaatgtggatgataccgccctagttggaaagcctttgatcgatgttgaagtagagggcagcgaacatatagaaaaaaaatctgaagaggaatctttacgagagatatgagtgtactcaagatctgacatcaccgcaaatagcctttgcataccctcagtaagacgattagcctaaagaacgtagactatatctaaaccaagaccagggactggtaaaaatgacaaatccataacaggatatgtcaataccatagagatcatctaaaatccttcattctgactcaaggaatgtttttgaggaaagacccgagggcgattatggaaataatgaaagagggaagggagcaattaaatcctaagaaatagagcaaggcacttgacatgtttaagtgccgcagaaggcatcaaaaaactacgccagaattcggaatggtctttagtgcctacctggaaaaacgccaactaggcccccctgctcccaaaaactgccctataaaaacaaaacaataaaggccgccggctgcacgatgcctctccagtctctaactttcataacgtcgggcccccttttcgggttttcatcgggcccacaacccttttttttagattggatgacgtggataaggatattacttacatttctcagttggcctctttgtgagaaaggcctatggcttcttactgataagcgtggaacacctccgtttcctttctcattaaacaaatcttcctcctatttcgacccgggttttttttctctcctttcttataattaagattttgaatctccttttaaacaacctaatttacccccccctgccatgtggttcaatctcattatacgccccccgccacaccctt

SEQ ID NO: 9978 - DNA, 970 bp, Diabrotica virgifera
  misc_feature (803)..(803): n is a, c, g, or t
  misc_feature (907)..(907): n is a, c, g, or t
tcacttagagcatatcgaaagataataaagttaatcacaggtataaaactttttttcatgaaatctgtaaaatatttagcactaaactatttgtttttgtgagagttacaagtgagagggtgttttgtaaatgatgtggattgtttgatacccttaaaaaacatcaaaaatggctacgagaaatctatgtttatgtatgcttatttggatgccactctttgagggcatagttggcgacgtcgcctttggcattgcacaaattcctggtggtaaggcaacagtagaagatttgaaaaaagggaaatacttacttaacatggaagaaaataatcatggcggcgtaataccaactccactttttactattacaggggtggacaacactgattgtcctaacttgaatgttgaatttactcaaggcatgaagtttaagttttcgattaatgaaagttgtatattctatgctgaacagacatttgactacgaatcgaatgaaagatcatacaatttcagaatttcaaagtccgtaaatgacgagatagatattgcattcagtatcaaaaatatcgatgatgaacctccacaattaggaacgtttaaatgcaactttaatgaacaattagactatagtcttgatgacacaccatgcaatactacattgcatgatcccgacggatggctggcacaagagaaaattttaatattcatcgacactaaggatgaagatatattcgcaattgatttgcgaaagcctctaccaaatgatactgagacagacacctacgtttttatgtatctcttanagcaacttaattatgaggataccaatttttatcagtttacagtgcaagcaaatgattctggaggtaatctttcacccacaagaagtgctgtgggtaatgttatncacattagaagtagacctccaaatggtcaaaaataacatttattgatcaatttgacgaactga

SEQ ID NO: 9979 - DNA, 788 bp, Diabrotica virgifera
  misc_feature (677)..(698): n is a, c, g, or t
ctacctaggccggattcgtattatccacccgtagacacaaacacttaggattactcagatggatactcgagctctgaatatatgactaacagttacaaaactccagaaggctacaaagtgaatacgtacaaatacgaaagttatcaagcgcctccacagcagacgtattcttctagcagcgaaaagtactacaccagtgctccagctgttatttctccaatttctcccagagacaaaaagacgttcgaaacgttcaaaaacggtgcagattcacagtactcgactcagtatgcaacgaacgttgagtatattaacaaacctattatctatttagtcagattccgtttagtctatttatccagtcaaacagattccgttatttgtttcggttttcgtttattgcatcagggatttatgatgtattaaaaatgtttctttttatgtaaaattattcctttattttaacgactcaaagcatgtatgtataaagtttgaatgtttctgtgtggatgacgatagtacaatgaaatcaatagaactgcttaggttggtgatattttcattggttatttttttcttgggacatttgatgattggtttggacttgatttagaagaatacgtacctgctataattttagaatgcattggcggtactacagtgaggctgtacttaannnnnnnnnnnnnnnnnnnnnnctatacacacacaggtttaaaaattgaaatttgcagatgtatacatgaacagatttttctttaaacttttcttgcgacacgggtatgtaa

SEQ ID NO: 9980 - DNA, 702 bp, Diabrotica virgifera
  misc_feature (269)..(269): n is a, c, g, or t
cggacgcggggagggtcatttttctttttcttagtgtgacgtcacaatctcgcgagcatattttctgtatctctttcatatatcatttgtgaggatagcgggcttctttgtccccatgttccatgccgcctttctgatgaccttctattcgaatgcatgttttatatcacctgtcaaatattgccactgcgaataagatgagacggatttaggtgccatcatcctatatgacctactctctcgaggagaccatcatgcgaataatgcanatccaacatatactaccattattatatcgtgtccgctgggagtgactcgctgaaattacctgagcaccctcaaatactgctacttactgtgactgcgactagtaacaacaggtgatctaagagtgtgactggtcccaagtctgtgctctgttattaatgctagacttgctgagatactcaatttaaaagataccccactctgtagatgttcataaatgccaagccaattgaaaacctgccagaaacacaactcttacgagtatcgtcttactgaaatggcagagatgtactacgtcctctgatgcattacttactgtccactgaacccattcaacaatgcttcgaaagacactttgcgagagaccttcatgacttctgcttacaaaccaactgcagtgtttctgtcaagatcttcctgaacgctacttgtgct

SEQ ID NO: 9981 - DNA, 781 bp, Diabrotica virgifera
  misc_feature (12)..(55): n is a, c, g, or t
  misc_feature (57)..(141): n is a, c, g, or t
  misc_feature (150)..(199): n is a, c, g, or t
  misc_feature (201)..(222): n is a, c, g, or t
  misc_feature (224)..(274): n is a, c, g, or t
  misc_feature (280)..(441): n is a, c, g, or t
  misc_feature (445)..(543): n is a, c, g, or t
  misc_feature (545)..(584): n is a, c, g, or t
  misc_feature (693)..(740): n is a, c, g, or t
  misc_feature (759)..(778): n is a, c, g, or t
agaacaaagggnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnncaccttgcnnnnnnnnnnnnnnnnnnnnnnnnnnnnnnnnnnnnnnnnnnnnnnnnnngnnnnnnnnnnnnnnnnnnnnnngnnnnnnnnnnnnnnnnnnnnnnnnnnnnnnnnnnnnnnnnnnnnnnnnnnnatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnntattatataggtataataaaggaattccgcaacatttttctgctcctgattattaagaacatgtcttttagtattaaagataacagctcgcctgcccgctgattaatgnnnnnnnnnnnnnnnnnnnnnnnnnnnnnnnnnnnnnnnnnnnnnnnnattgttattgagagctgcnnnnnnnnnnnnnnnnnnnncag

SEQ ID NO: 9982 - DNA, 689 bp, Diabrotica virgifera
  misc_feature (2)..(44): n is a, c, g, or t
  misc_feature (52)..(164): n is a, c, g, or t
  misc_feature (173)..(680): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaact

SEQ ID NO: 9983 - DNA, 926 bp, Diabrotica virgifera
  misc_feature (842)..(842): n is a, c, g, or t
caacacccggagctcctggtgtctaggatcacgtcatcttctggaatttcggcactaaattgatgcaaacagattacacgagggattttcgggctcgctgaacacgaatacgccatcaaaggaacacctgttgaccacggtcactaagaaggcacgtcatcttctggagtttagaaagtgttcggccttgaatgcatacaaatagattaacaggcaatttttggggtcgccgaaaacgaatacgcaatcagaattggcccccggacgatctggtgcccaaggtcactgctaaggtatgttatctttttagttcggagggtttttgtgcaccaagtgcaccgggggttctgatagcatattctgattcagcgaccgcaaacacccccgagtaatctatttgcatcaagcaaatatacgagtcttggcaatatacatcataattgttttatggatgtctaaaaggagatgtttatattaatattcattagctgatcacctctctttacagttctcgtaaaatcttaataaatacgtagaatcaaattttgtatcaatagatttagataatttcctgtgagccatacacgatttgtctagacaacccgtcgatgtcgacaacctggcttgtttctttactacttctggaaaaaactaatgttacttttttaatagtatttctgttattatttactgggcatctttaggtctccagtacgacaaaattaaatgatgccgatacaaggaatattcttaactcgttcagcgctcacaccgatagtgtgtcggcacgagggtctcatcaaacgtgccgacgacgcacgagtgttggcggtggtactgcngttctaaataaaccattacaagcttgggcaccctcagtgaggtcgaacgtagacagcgaacgtatatgttatcatacttaaagc

SEQ ID NO: 9984 - DNA, 398 bp, Diabrotica virgifera
  misc_feature (14)..(31): n is a, c, g, or t
  misc_feature (80)..(113): n is a, c, g, or t
  misc_feature (116)..(139): n is a, c, g, or t
  misc_feature (166)..(187): n is a, c, g, or t
  misc_feature (202)..(232): n is a, c, g, or t
tcccctccgtccgnnnnnnnnnnnnnnnnnngatagattttagtaggaccacagaaagaatgttattagatgatgattgnnnnnnnnnnnnnnnnnnnnnnnnnnnnnnnnnngannnnnnnnnnnnnnnnnnnnnnnncgtgtcagtgatgattaattaataagnnnnnnnnnnnnnnnnnnnnnnttaactgagctgagnnnnnnnnnnnnnnnnnnnnnnnnnnnnnnnttagttagtatgtcgtttgggatggtattgggatttgatatatctaaatgttttgtatataagatagatggataaattacctatagattttatattatgtactataatatgattattattatataattatatggatgaagttaggaatattattggattgagattt

SEQ ID NO: 9985 - DNA, 711 bp, Diabrotica virgifera
  misc_feature (7)..(53): n is a, c, g, or t
  misc_feature (67)..(133): n is a, c, g, or t
  misc_feature (135)..(167): n is a, c, g, or t
  misc_feature (176)..(611): n is a, c, g, or t
  misc_feature (613)..(710): n is a, c, g, or t
aatgggnnnnnnnnnnnnnnnnnnnnnnnnnnnnnnnnnnnnnnnnnnnnnnnggggtatcagggannnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnggaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 9986 - DNA, 593 bp, Diabrotica virgifera
  misc_feature (2)..(45): n is a, c, g, or t
  misc_feature (53)..(84): n is a, c, g, or t
  misc_feature (86)..(167): n is a, c, g, or t
  misc_feature (177)..(540): n is a, c, g, or t
  misc_feature (556)..(585): n is a, c, g, or t
cnnnnnnnnnnnnnnnnnnnnnnnnnnnnnnnnnnnnnnnnnnnngtacctcnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacacgnnnnnnnnnnnnnnnnnnnnnnnnnnnnnncgcccacc

SEQ ID NO: 9987 - DNA, 684 bp, Diabrotica virgifera
  misc_feature (10)..(24): n is a, c, g, or t
  misc_feature (26)..(38): n is a, c, g, or t
  misc_feature (59)..(96): n is a, c, g, or t
  misc_feature (111)..(130): n is a, c, g, or t
taaatttacnnnnnnnnnnnnnnngnnnnnnnnnnnnnatagtattaaaacactgtacnnnnnnnnnnnnnnnnnnnnnnnnnnnnnnnnnnnnnngcacatttttttccnnnnnnnnnnnnnnnnnnnnctttttggattaaaaataagaatcccccgcccccctgattagattgatggacgggcattttggccccacctaaggaagatagaccgatattgtattttgttaaatatggaccgaaaggggggaagaaaaaaacagggggcctgcattcacgcaaaaaatagcctaattaaaaaaataaaccaactaagagcgcgctttgaagaatgactaatcccacataccttcgcatcgataacggccaggccccctccccccttattcgatgagcccaccccccaatggtttttgaatggcagggctgtgagtaggagatccaactatgattttcttacttcacacttcacgcttacaaacccttttccgcattccccccgaaccgcccatcatcaccacacattaataccccctcacacaagacaccctcccctttatttctcccgcgactattgtccctccccgattcaatttcaaaaaagtgcacctcctgtcacatcaatattcaaacccccactcatttgctacaaacaacatcacccccccccctcttctactcc

SEQ ID NO: 9988 - DNA, 637 bp, Diabrotica virgifera
  misc_feature (467)..(500): n is a, c, g, or t
  misc_feature (508)..(532): n is a, c, g, or t
accacgcgtcctatccgatgaaatgcttcacgaagccctccatgaagcaaaagctggtgacaatgttgataacgacgctgagaatgactctgttaaagaattgcgacctggatacacaactgaagaccccaccaaaaacccacccaaattagctgcccacttcactgccctcgaccttgctctcaaccaccctgaccaaatctcccatggatatacctgtgtactcgattgtctcgcctgtcacattgcctgcatcttcgatgaaatcgaacaacaggctgaccgtagctctgataagaccactgaagacaatccctcaggcatcgaatctgttgatgccttcattgccaccttggcactcaccgaacacatgtgcgtagaatcattcccacaattcccaccccttggacgttatgttgtccgagacgtgacgcaaaccgttgtagtaagagtcatcttcagagatnnnnnnnnnnnnnnnnnnnnnnnnnnnnnnnnnnaagctgcnnnnnnnnnnnnnnnnnnnnnnnnncctatatggactccactacttaaagaattgtgatatgtattgattcttatagaaattactattggagtatcaatgcatttgtactaattactggacttattactt

SEQ ID NO: 9989 - DNA, 78 bp, Diabrotica virgifera
  misc_feature (8)..(31): n is a, c, g, or t
  misc_feature (42)..(61): n is a, c, g, or t
agaaaatnnnnnnnnnnnnnnnnnnnnnnnncgctgcccttnnnnnnnnnnnnnnnnnnnntctaggtgccttcgaaa

SEQ ID NO: 9990 - DNA, 319 bp, Diabrotica virgifera
ccccccccccccccgcgccttccgctgcagaggagaagacctaaattagtagaggattgacatttattggcgtggagactgtgcattaataccccgtgagctgtgtttctgcgtgagacttacagtcgcgtcgcttgatccttgctcctcagtacccgggcatccacgttaacacttcatcgtcgtcaaccttgcaacaacgagccgataccattatcaaaaccccagtcgttagggcagtagatctcttggacagcgttgctattccgaaagggtatgcggtaagaggctggtcaagacttaaaagatgaatcaccta

SEQ ID NO: 9991 - DNA, 204 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttacaattttacatgatctgagtttaaaccggtgtgagccaggttggttnnnnnnnnnnnnnnnnnnnnnnnnnnnnnnnngaaaggaccag

SEQ ID NO: 9992 - DNA, 306 bp, Diabrotica virgifera
  misc_feature (2)..(205): n is a, c, g, or t
  misc_feature (217)..(241): n is a, c, g, or t
  misc_feature (247)..(247): n is a, c, g, or t
  misc_feature (269)..(294): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttttagnnnnnnnnnnnnnnnnnnnnnnnnntataanattattaataagtccttttagnnnnnnnnnnnnnnnnnnnnnnnnnncatttactcggc

SEQ ID NO: 9993 - DNA, 709 bp, Diabrotica virgifera
cttcccatgggccggaaaaacatacaactcaaataaacaatatcgtttaagacgatacagcaactaaaaaggacgttaaaactgttcaaaaatcccacactgatgttgcaactgatacaaaaacgcttcagaatggcaatgttactacgacaataaaaacaacaacagtaacaaccaaaggggcgcaagaagctagtcagcattccgaacgtcacctaaaacagactaatgtaaacgaaatccaaaaatcttcgtctcaaactcacatccataaaacgaatattcacaaatcttcacagattttcaatgaccaagtagatcatgcgcactctacaactaataaagaaatatctaataaaacttctcaccacaaaaagagttctgtgacatctgaggaaatcaataatcaaattttgcatcgtaaaggtattcatacctcttcggaagctcttcatgccactagttcttcagcactagacatgcgtaaatctgtttgcaatatccatgatcaaggcagaactgtagtcaatacagaaagacatagtttaagttcaatgcataggtctaatcaagaaaccaacaacctgaatagacgaagtcatcaacaacaaactacttatcaagttgtagaaaggccagagaagatagtaagaagggacaatctttcagtgggtggacatttttatggacagtcagaagctaagtctta

SEQ ID NO: 9994 - DNA, 694 bp, Diabrotica virgifera
  misc_feature (352)..(366): n is a, c, g, or t
atcatatttttatgcgagggatcgtatactggtcgcgcattccgcgagactttctttagcggaaatttccttatggccttgatgtacaataacaggtgcatccggatcacgcccgcccttgaccatgagtacctggtctgatctactgttctttattcactactatcattggctggtatcattgatgtggccaccatgtgacaaaccttaaatgcgcggagacaacgacaaatgcccaggaactactgtattacaatcgtatcagctgtactatctatgttcttctacacatatgatccacatttggcgcacatgaccatggctaacatttctgatattcaggtgctattgnnnnnnnnnnnnnnngttgactcgcctgcacccaatgatgtctcataactggtaccccctgtgccttaggccattgctgcggacctggtcgtatgaggacgtttatctcattgtcgtgtacatactgaaactggactccaatgctatattgccaactgtatattgcctattttacttctgactggatgtgaaccgctacctgttagaattacaattggactctgtctaactatatcagacttttggacagattggtgaaaacgtcaacattatttattgcctgctacaaacatgattcactgccacatgatcgtctactctacattgcccacctactcctcaa

SEQ ID NO: 9995 - DNA, 802 bp, Diabrotica virgifera
  misc_feature (185)..(185): n is a, c, g, or t
  misc_feature (724)..(759): n is a, c, g, or t
ccgctccagacgaccccggctcgcgtgcgctgtgattgtattctacattaactcatactattatttgtagcactaagtatcagattcacttgtgtactttcagtgtatacgatcaatctatgtacttcggtgaagaagcacctagttctgtatatctcctatcatataatacaacacattgtatntcttctttgccaccctttgtcgcactcgctggatgtatataagtctaaataagttactcatatctcgattcatctcctctcaccttatcagaatgacgctaaaccatgatataggcatatttgtatatcgcagccctagtatatgtttcaataattttctttgtaatgggaggttattcgcttttagatctatccacttgtctacgacctaacttccgctcctttattatccatatcttcatttctcgacattttcatcttattaccactacatatttttatggatgagctcctttataaaatcttattaaagttttatttttccacaacccctaagatcatgaatattcatatgttacactatgtgattattcatcctgatatattattattcttactttttataaagtattcattatcatataaatgtacactatttccattcagtaacgacgctcatatctatctcagactattcgttatatatataaaatatataggcgataatcaagctattcggcaacatttgtttcacctgnnnnnnnnnnnnnnnnnnnnnnnnnnnnnnnnnnnncgctcgcctgcccgctgatcaattcgaatggacgcgggatttt

SEQ ID NO: 9996 - DNA, 462 bp, Diabrotica virgifera
  misc_feature (2)..(263): n is a, c, g, or t
  misc_feature (270)..(307): n is a, c, g, or t
  misc_feature (327)..(340): n is a, c, g, or t
  misc_feature (343)..(365): n is a, c, g, or t
  misc_feature (373)..(395): n is a, c, g, or t
  misc_feature (425)..(456): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 9997 - DNA, 173 bp, Diabrotica virgifera
  misc_feature (2)..(44): n is a, c, g, or t
  misc_feature (52)..(165): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgt

SEQ ID NO: 9998 - DNA, 601 bp, Diabrotica virgifera
  misc_feature (6)..(518): n is a, c, g, or t
  misc_feature (520)..(561): n is a, c, g, or t
  misc_feature (566)..(595): n is a, c, g, or t
ctaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnaaggnnnnnnnnnnnnnnnnnnnnnnnnnnnnnntactgg

SEQ ID NO: 9999 - DNA, 894 bp, Diabrotica virgifera
  misc_feature (2)..(17): n is a, c, g, or t
  misc_feature (19)..(61): n is a, c, g, or t
  misc_feature (69)..(182): n is a, c, g, or t
  misc_feature (191)..(769): n is a, c, g, or t
  misc_feature (779)..(844): n is a, c, g, or t
  misc_feature (853)..(853): n is a, c, g, or t
  misc_feature (860)..(892): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagannnnnnnnnnnnnnnnnnnnnnnnnnnnnnnnnnnnnnnnnnnnnnnnnnnnnnnnnnnnnnnnnntaattattntatttgnnnnnnnnnnnnnnnnnnnnnnnnnnnnnnnnnat

SEQ ID NO: 10000 - DNA, 1268 bp, Diabrotica virgifera
  misc_feature (490)..(569): n is a, c, g, or t
  misc_feature (571)..(608): n is a, c, g, or t
  misc_feature (610)..(637): n is a, c, g, or t
  misc_feature (639)..(675): n is a, c, g, or t
  misc_feature (714)..(737): n is a, c, g, or t
  misc_feature (750)..(833): n is a, c, g, or t
  misc_feature (856)..(928): n is a, c, g, or t
  misc_feature (935)..(1000): n is a, c, g, or t
  misc_feature (1002)..(1037): n is a, c, g, or t
  misc_feature (1057)..(1075): n is a, c, g, or t
  misc_feature (1091)..(1120): n is a, c, g, or t
  misc_feature (1130)..(1149): n is a, c, g, or t
  misc_feature (1165)..(1184): n is a, c, g, or t
  misc_feature (1194)..(1223): n is a, c, g, or t
ctcagcaaaattcagctggttagtatgctatttggggggtgaaatctctggcaactggactaaactgtcaaattttgacttaaatctttactaaaagtcataaagaaatacataaaagattaaggaacttttaaatcttataagtagaattacttaagtaatacggagtaacacatacgatgataacgtaaatatttcaagatagagggcgttgctaaacgtcgaatgagtgttcttttttaattggcacacttttatagtccactttttcagtaaattaataaatgtgacttccggataatcaatattcttgtctatcgatgtaaacgtagtctacagagtacacacagactggatctctcactgcgtcaccataatgtgcaagtaatgcatttgtttaaattatataagcgatttaatccatcataacacaaaaaacgttattattgattctgatatatgaatatctttattctttataaatttatcnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnntatgggcgcggtattttgaccctgctaatgtatcatcannnnnnnnnnnnnnnnnnnnnnnnggactgaatgacnnnnnnnnnnnnnnnnnnnnnnnnnnnnnnnnnnnnnnnnnnnnnnnnnnnnnnnnnnnnnnnnnnnnnnnnnnnnnnnnnnnncgaagaaaaaccctattaaaggnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnctttaagggaacaaaaaccnnnnnnnnnnnnnnnnnnnaaaggttccaaaaccnnnnnnnnnnnnnnnnnnnnnnnnnnnnnngggtgggaannnnnnnnnnnnnnnnnnnnggggggagcaaccccnnnnnnnnnnnnnnnnnnnnggtctccccnnnnnnnnnnnnnnnnnnnnnnnnnnnnnngagattttaacaacccgggggggggaggcccacgggtcggggttg

SEQ ID NO: 10001 - DNA, 733 bp, Diabrotica virgifera
cttacagaagactctaaagaacctctagatatggttgaagataatgcaactgaaaaatcagaagtatttacagaagaacctgaagaccttttaaatgaggttaaagatgatgcaattgaaaaaccagaagtgcttacagaagcttccaaagaccctttatacgtagttgaagatgatgcaattcaaaaatcagaagcagttacagaagaacctaaagaccctttgaatgtggttaaagatgatgctgaaaaatcagaaatgcttacagaagattccaaagaccctttcgatgtagttgaagatgatgcaattcaaaaatcagaagcagttacagaagaacctaaaggccctttgaatttggttgaagatagtgcgattgaaaaatcagaagcagttatagaagatcctaaagactctttgaatgaggttgaagatgatgcaactgaaaaatcaaaagcatttacagaagaacctaataactcatcataagtggttgaagatgccgcaattgaaaagatagaactaattacagaagacttctcagatcctttaaaagtggttgaagatgatgctaattcaaaaatccctatccactaccaaaagaacgttcggacccttcccacgtgtgtaaagatgccgctcttcgagaaagatcagacgctaaatacttctactaactctcccatctcaggaggtatttgattgatctaaccacaactgtttaaatcagttc

SEQ ID NO: 10002 - DNA, 499 bp, Diabrotica virgifera
atcttgagttaattgatgataataaaatattcctttaagaaaaccagagaacgattttatttaatgctcgtgaattaatattgagggagaacacttaattgttatcaaaaaaatctctattgttagcacctcgcctgtcaagggtaattaggtagccgtcatatatacctctaccgcaagcaaacgtgatgttgaaatcgcaaactattagtgcgaagcgaagcgtcctgataattcatcagtactgttctgcaacgatccagccctcgcaccgaagattgctccgcttcgcgcggggacctgagatacccctcctctgtgcgtccatacgttcctaattcgacacgtgttgtgtcgtttacgattagagctcgatagggaggcccccccgttagaggatccgcattaggaggtaactgttcaacccacccctaggatcatgagtagccagatggttaagtgcgcgatccatcaccctgatacatctattcttccccct

SEQ ID NO: 10003 - DNA, 326 bp, Diabrotica virgifera
cgtatcagagattgtgaaataggaaatatatgtactgctaaggattcaatgattagctcatattctagatagcataggcggctatccagatcgatatcacgtggaagatgtaggtctcgatctcgatatccacgaaataattaaccttccgcctcgtattccgctagatctaaaccatcactatattgtcatgcgtcacctccatgtcatgaataacttccaccggtgcagtacaattgatatgcatgctgcagaacagattcctgccatataatagctgataagcactcaagctgctgtacctgcatcaggatcaagcataacaa

SEQ ID NO: 10004 - DNA, 706 bp, Diabrotica virgifera
cgtgcgcaaacaggatgatccgagcgtcatgaattatctgaggtatttatttctgtctccgaacaattatatttacgctactcgccaataatactgcgaaaaagttttcccggaactcgcgaaaataataaacctacttcgctatgctatacccccgaatcatacaccgccgggtacctccctcttcaaccacatactctgaataatctactgcgacccatccctccttcacttcatcatggtgtctgactgatgtatgtctgctcataggggtgtgcccgtctatctcgaaaacctcatctcgacctattgatagggtatataaatataaacattaccatcaataccttttgctctacatgacctcgaccgagcgcttattagagacagcatcatgaatgccgtaatccatgctccatatctgcttacagctcaactgtgcactagagtacatcatctgtgccagcatgactcttcaactacatggacacagattgttcaccaaatcaacgactacttatcaaatccagacaccgactcatacctctcccactttcctatgcctttatctaccactaaagaacttctgatatataacagctgtataaatatgccctctccatgtagataatatgctcctacttcctcttctctacctgttaaaagtcagatgattacctgacacatctatacctgcagcacttct

SEQ ID NO: 10005 - DNA, 160 bp, Diabrotica virgifera
  misc_feature (66)..(109): n is a, c, g, or t
  misc_feature (135)..(158): n is a, c, g, or t
atctaagtgtggtgtgtttcttatataattccaatgaacacataagaaaaggtgtacttatatgtnnnnnnnnnnnnnnnnnnnnnnnnnnnnnnnnnnnnnnnnnnnngctttaccatcacgcgactcaaaagnnnnnnnnnnnnnnnnnnnnnnnnat

SEQ ID NO: 10006 - DNA, 966 bp, Diabrotica virgifera
  misc_feature (361)..(378): n is a, c, g, or t
  misc_feature (522)..(534): n is a, c, g, or t
  misc_feature (536)..(549): n is a, c, g, or t
  misc_feature (575)..(588): n is a, c, g, or t
  misc_feature (591)..(605): n is a, c, g, or t
  misc_feature (607)..(622): n is a, c, g, or t
  misc_feature (631)..(664): n is a, c, g, or t
  misc_feature (814)..(814): n is a, c, g, or t
cggacgcgtgggcggccgggcaaacttcaagatatggattaattccaatatttactgtcaaagcacctgcaccactttagctttgcttgaaataatagcatgtaaatgcaccaaaggatgtacaaaaaaatgcggttgtaggaagataggaattagttgttcaatattctgcaaagggtgcatgtgcatgggtactaattgtgggcactctaagataactgaggtgtcagaggaagatattgaaggtaatgctaacgaagagatggactttgattttgaagattttttaaatgtcaacgtttaaatttttaactaaagtgatgttttctaatgctaatgtttatgtaatttttgcaaaagnnnnnnnnnnnnnnnnnncaggaaaaaatatcaaagaatcactcggtttccattacatatttaaatatagatgatacaccattttaaaaaacagaaagtaagccctctttattgagcaatatatagtatattcatgtacaagaaaaaaaagttataatgagnnnnnnnnnnnnnannnnnnnnnnnnnnagaaaatcgtattttttatatcgggnnnnnnnnnnnnnnacnnnnnnnnnnnnnnncnnnnnnnnnnnnnnnnccgtattannnnnnnnnnnnnnnnnnnnnnnnnnnnnnnnnntactagatgacccggtgaacttcgttgcaccttagatagtgtgtcataattagataatgtgtcataattttactcaaaatcaactgctcgaaaatgaattgctcgacataaaaattgattgaaatacaaattcctcgaattaaaaataanattatatgtctaaatatttattcacaataatgcaaaatttgtaggtatataaaaaaagtacatttaataagacaattatatgatatttcgaaattagaaaaaaatagacagaaaggtaatttataggacaaatatgtgaaattcatattttg

SEQ ID NO: 10007 - DNA, 788 bp, Diabrotica virgifera
  misc_feature (162)..(179): n is a, c, g, or t
cgtttatttttgcgtaaaaagaattttttggaattctattgtgcaattaattatttaaaatgtaccgacaattatcgagatttcgaaaagctgtatcagttttattcaacgaaaaaacaggctttatacggattcaacctttaagtagttatccagaagagnnnnnnnnnnnnnnnnnnggcgatttcgaaggcagaccgctatatttagatgttcaagctacaactccactggatcctagagttttagatgtaatgcttccatatttaacaaattactatggtaatccgcattccagaacacatgcttatggttgggaaaccgaagaagctgtagaggaagcacggaaacatgtagcagatgttatcggagcagattctagagaaataatttttacttccggagcgactgaaagtaataacatagctgttaaaggtgtagcccgattttacaaagaaaagaaaaaccatatcataacaacacaaacagagcacaaatgcgttttagattcttgtaaggctttagaaagtgaaggatttagagtaacatacctcccagtaaatcccaatggtattatatcactagaagaaattgaacaggctatgactccacaaacatcactagtttccataatgacagtaaacaatgaaataggtgtaaaaacacccatggatgctataggagcactgtgtaagcagaagaaaatctttttccatacagatgctgcacaagccgttggtaaaattcctctagatgtaaacgctatgaatattgatcttatgtccatt

SEQ ID NO: 10008 - DNA, 176 bp, Diabrotica virgifera
  misc_feature (2)..(157): n is a, c, g, or t
  misc_feature (160)..(172): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnaata

SEQ ID NO: 10009 - DNA, 818 bp, Diabrotica virgifera
  misc_feature (2)..(51): n is a, c, g, or t
  misc_feature (53)..(807): n is a, c, g, or t
cnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatttatat

SEQ ID NO: 10010 - DNA, 172 bp, Diabrotica virgifera
  misc_feature (9)..(96): n is a, c, g, or t
  misc_feature (100)..(142): n is a, c, g, or t
  misc_feature (144)..(169): n is a, c, g, or t
aagacgaannnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnncnnnnnnnnnnnnnnnnnnnnnnnnnntcc

SEQ ID NO: 10011 - DNA, 207 bp, Diabrotica virgifera
  misc_feature (15)..(52): n is a, c, g, or t
  misc_feature (72)..(85): n is a, c, g, or t
  misc_feature (88)..(110): n is a, c, g, or t
  misc_feature (118)..(140): n is a, c, g, or t
  misc_feature (170)..(201): n is a, c, g, or t
ttcctcgtccgcagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10012 - DNA, 500 bp, Diabrotica virgifera
attagagaaagttgttatgaaaccatttaaaatggatccagctcagaataattctcaacaagaacttgtcacagaagataatgaaaataatccacgaggaatgcgaaatgttactttccgcgagtgggttgttgttggtattttgtggttcgtacctttgctaataaataatcactattccatgtttattggtgatgtacataaggacagaaatatgaaaaattgatttggcgggatccctgtggaaggaggaggtcttatctactgaagagaaaactacggttacgtcttctgttattactcaaccaaagctcgtagcttcgacttcaacagaccaatccacgaaaatctgcttgagcgaagtacaataatatatactgatctgaagagattccttacgaaatatagacctgatgggacgtgtactgatgtacctccctctggattgaacacactattgaattcgaccacaaccagctcaaccgccaacaccattaaat

SEQ ID NO: 10013 - DNA, 722 bp, Diabrotica virgifera
cagacgcaattgttcgtcctaaaatttggttcatctcatgtttagaatcttttagcgaaccagagcttattaacaatttttatagttcggctgttcaagagaatgttaccgcaagaaaaacaactaggttgtcatcatttcctgattatttggtaattcacctcaaaaagtttatgttgagggaagattgggtcccaattaagttggacgtttctatagaaatgcctgacgtattagacgtaagttctcttcgtggagatggacctcagccaacagaagagttactaccagaactccaagtaccaccaccagctccgtctatggatgaaggagttattagccaattaatggaaatgggttttccaatagacgcatgcaagcgagcaatatttcaaagtggaaatgctggcgtagaaccggctaccgcgtggattatggaacatatcgcagatgcagatttcacagatcctttcgtgcctcccggtaccgaaaatactaaatttgtcccaaatccagatgccttagctactattgcctctatgggattcactccagaacaggctacgaaagctctaaaggcaactgaaaataatgtggagagagcgatggattggattttttcacatcaagaagagttggataacataaaatcaccacctcctcctacattcagagatggagaaggaaaatataaactcgccggattcatctcccatatgggc

SEQ ID NO: 10014 - DNA, 553 bp, Diabrotica virgifera
  misc_feature (2)..(282): n is a, c, g, or t
  misc_feature (284)..(354): n is a, c, g, or t
  misc_feature (361)..(398): n is a, c, g, or t
  misc_feature (418)..(431): n is a, c, g, or t
  misc_feature (434)..(456): n is a, c, g, or t
  misc_feature (464)..(486): n is a, c, g, or t
  misc_feature (516)..(547): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10015 - DNA, 931 bp, Diabrotica virgifera
  misc_feature (13)..(44): n is a, c, g, or t
  misc_feature (48)..(894): n is a, c, g, or t
  misc_feature (897)..(897): n is a, c, g, or t
ccctcccgcgtgnnnnnnnnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntanattacccttagggataacagcgtaatttttattg

SEQ ID NO: 10016 - DNA, 189 bp, Diabrotica virgifera
aggagtgactgtccggtcagcccatcgcacaaaccgcgggtccaaaaccatcgtttccaatacgcgattgatgaattttggtccctattttttttaagttagattagcgcacatagttgatgctacctcttatcttaattttatctttgtaacgactgataacactttttggtcatttataatttttag

SEQ ID NO: 10017 - DNA, 775 bp, Diabrotica virgifera
  misc_feature (17)..(47): n is a, c, g, or t
  misc_feature (55)..(691): n is a, c, g, or t
attaataagctcatccnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttaaggataacagcgtaattttatttggagagctcaaatcgataataaaagattgcgaacctccatgttggattaaaagtt

SEQ ID NO: 10018 - DNA, 736 bp, Diabrotica virgifera
  misc_feature (334)..(353): n is a, c, g, or t
  misc_feature (534)..(534): n is a, c, g, or t
  misc_feature (630)..(630): n is a, c, g, or t
  misc_feature (681)..(681): n is a, c, g, or t
gtcagtgggaaaatagcagcttttcttatccttaagattaacaaaatcaagaatgtctggatttggagacaattttggagttgccgacgaagacccagcggcagaattcttggcacgcgagcaagacgaactagcaggccttgaagatgaagtgaaaccggccgcagttattgctccagttcttaatggtgatatcccagccgattttgatccagataaagaatacagggaaagagtgtccccacttacaataagacaagaagatagagtagaaccagaaaagatcaggttatggagggaagagcaaatcaagaggttggaggaaaaagatcannnnnnnnnnnnnnnnnnnnaagaattgagggaagtagcaaagaaagaattagaagattggtacaagaatcacgaagaagctatagccaagacaaaagctgctaataggaacgctgaaaagcagttcgtagccgaagatgacgaactagaaccgggaaccgaatgggaaagaatagcaaaattgtgtgatttcaatcctanagcaaaacaaggcagcaaagacgtttctcgaatgcgttccatcgttctgcaaatgaaacaaaacccagttccaatcaagaacaaggcttaatgtgntaattaataaataatggtttatgtgtactatgtttcagaaaatttggcagnttggctaatatttttgaaatgtaggtgtaaacatttctggacattctgcaatttt

SEQ ID NO: 10019 - DNA, 530 bp, Diabrotica virgifera
  misc_feature (2)..(320): n is a, c, g, or t
  misc_feature (327)..(364): n is a, c, g, or t
  misc_feature (384)..(397): n is a, c, g, or t
  misc_feature (400)..(422): n is a, c, g, or t
  misc_feature (430)..(452): n is a, c, g, or t
  misc_feature (482)..(513): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggaccaaatatat

SEQ ID NO: 10020 - DNA, 411 bp, Diabrotica virgifera
  misc_feature (2)..(285): n is a, c, g, or t
  misc_feature (293)..(410): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 10021 - DNA, 873 bp, Diabrotica virgifera
  misc_feature (455)..(470): n is a, c, g, or t
  misc_feature (841)..(841): n is a, c, g, or t
agagaaactcctgaagcacaaaatccagaaaaagtggctagaaaatcaaaaccaaaaggagataaagaaagtggtggtatttttggtatctttaaaagaaaatcagaatctatcgaaaaagactttaaagatgaaactcaacaaattaagcaagacttaaaggaatctggtgaaatcgttaaaactaaagtaacaactactattaaaaaaatatctccagaagaaactaaacccaagttgtcggaaacgaaacttaaagaaatagatgatagtaacaatttcctaaatttggaaattgaaaagtatcatgatgttaaacctcttcctcaaaaagattcatcaaaaacaataacaataatatcagcacctttactagaacaaaaggtaatagaaaaagatcaaagtcaaactattacagaagaaatatcaaccagtaccactgacaaattacttgnnnnnnnnnnnnnnnnaactcccaaaagaacagtaactacaacaataactaaagaagaaatacctcatggtgaaagagttaccaaagtaaaatcagaagtagtaactggtacaatacaacttacttcggatgtcttaacggatatagaaaaattagaaaaagaaattaatgaaaagctacaagatttgggaaaagaaactgatccctcaaaagatattagtaccgagatagtaaaggaatctgcacaagaatatcagaaagtaacagaagtagatatgcctgctgtaaagatggatatagctattcccaaagaagcttccaaactttcagaatcagtcattgagaacattgataaaagcaacaaattcctggacacccgaatcgatnaataccacgatgttcgacctattataatgaca

SEQ ID NO: 10022 - DNA, 543 bp, Diabrotica virgifera
gggccgggccggaatggccggcccccccccccttaggcggggatcgcgcgtaaagaacaaagacaccacgcccctctttgtaaagaaaaagctatatgcaaggtaagaaaagtagaaatgggagagacattccgtttaaaaaagggaataattttgtcattgtacctggggagccagggaatatcaaatagaaataatatattaagaattgtcgacaagacaatgactacaaattcaacactcataatggacaagaaccaaatgaaaatgatgtctgggaaaggatgggataagcaggaaagaatatacacgtcgctgagataaaataaaaagatgtggacaactataaataagttatcataaattatgatataaataaatagattagatagactcagtctgaagaaatcgatcacaaaatatgaaacatagtattgtaataggagcaagaatgacaagatcaagatgaagaagaggacatgaaccataaacatataggttatagaaaggagctgaccaatgtttatttgaacggaaaagtaa

SEQ ID NO: 10023 - DNA, 768 bp, Diabrotica virgifera
  misc_feature (13)..(739): n is a, c, g, or t
  misc_feature (741)..(767): n is a, c, g, or t
tcttcgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnng

SEQ ID NO: 10024 - DNA, 859 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(457): n is a, c, g, or t
  misc_feature (475)..(495): n is a, c, g, or t
  misc_feature (633)..(682): n is a, c, g, or t
  misc_feature (687)..(769): n is a, c, g, or t
  misc_feature (771)..(797): n is a, c, g, or t
  misc_feature (800)..(845): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnncaacccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnccnnnnnnnnnnnnnnnnnnnnnnnnnnnnnnnnnnnnnnnnnnnnnnctcatcccctaaaa

SEQ ID NO: 10025 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacatgacctgagtttaaaccggtgtgagccaggttggttnnnnnnnnnnnnnnnnnnnnnnnnnnnnnnnngaaagg

SEQ ID NO: 10026 - DNA, 719 bp, Diabrotica virgifera
  misc_feature (598)..(619): n is a, c, g, or t
aggcgtttgcgggtccagggggaagaatgcccttctagaggaaccggccagccgggggtaagagagtagtattggaaagaggagatggtattgttgaaaaggacataagccaatatcaggagcacttccgcaacaacgacagattaattggtaactaggcatgaagttcatttctaatatatgagacctctaagtgcaaaggcagaatggaaacatagaacttgaaagtacaacgatctggacagtgaggccaggcgtgtactaggatatctggtactcccacgacattgatgaggagttcttggattcgtatatggtgatcgatacagttgtttgcattgttactagtgcacactatgttggggggggagtgagcgcagagttgtgttcaaaagatcgtaggtcagtgagcggcgtggaggggtcgccggaacatcgttagagccgttgggggctgtgtcggtatataaagaggggtagttctcacacagatgtaattaagggatactgtgccaattctttaaatcctggagtggggataatattattactagacggttcgtgttttctgtagaatgatgcatgtcttttttttctnnnnnnnnnnnnnnnnnnnnnngttttcttaattatgtgtatgattcttattctcttcctttgcgtgttgtcgcatgtggtgaccagacgagggttctgtccgctgtcgcgtctataatctg

SEQ ID NO: 10027 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(186): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnttagtacgaaagg

SEQ ID NO: 10028 - DNA, 330 bp, Diabrotica virgifera
  misc_feature (33)..(75): n is a, c, g, or t
  misc_feature (77)..(116): n is a, c, g, or t
  misc_feature (208)..(229): n is a, c, g, or t
  misc_feature (292)..(324): n is a, c, g, or t
cttcatataataaatctatttaattggcttgannnnnnnnnnnnnnnnnnnnnnnnnnnnnnnnnnnnnnnnnnncnnnnnnnnnnnnnnnnnnnnnnnnnnnnnnnnnnnnnnnnacccttagggataacagcgaaattttattgaagagttcaaatcgataataaagattgcgacctcgatgttggattaaagtttataattgggnnnnnnnnnnnnnnnnnnnnnnctgtcgacttttaaaattttacctgatctgaatttaaaccggggggagccaggtttgtttccnnnnnnnnnnnnnnnnnnnnnnnnnnnnnnnnnagggac

SEQ ID NO: 10029 - DNA, 1142 bp, Diabrotica virgifera
  misc_feature (9)..(814): n is a, c, g, or t
  misc_feature (816)..(917): n is a, c, g, or t
  misc_feature (941)..(963): n is a, c, g, or t
  misc_feature (1046)..(1063): n is a, c, g, or t
  misc_feature (1100)..(1134): n is a, c, g, or t
tcttgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaattaccttaggcataacaggnnnnnnnnnnnnnnnnnnnnnnntcgataataagaatgccacctcgatgttggattaaagtttataattggtggaaccactttttttattaagttgggtccgattnnnnnnnnnnnnnnnnnnttgggtttaaaaccggggggggcccaggtggggtttnnnnnnnnnnnnnnnnnnnnnnnnnnnnnnnnnnngggaccaa

SEQ ID NO: 10030 - DNA, 685 bp, Diabrotica virgifera
  misc_feature (7)..(564): n is a, c, g, or t
  misc_feature (566)..(611): n is a, c, g, or t
  misc_feature (613)..(658): n is a, c, g, or t
  misc_feature (660)..(678): n is a, c, g, or t
ccctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnncnnnnnnnnnnnnnnnnnnncctgatt

SEQ ID NO: 10031 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (172)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctttannnnnnnnnnnnnnnnnnnnnngaaagg

SEQ ID NO: 10032 - DNA, 495 bp, Diabrotica virgifera
  misc_feature (167)..(192): n is a, c, g, or t
gtaataacctgaaaatttagggaagaaagatatttgttttataagttttcacacacattcatagaagggtacttgtgaggaaaaagactacaacacactaatccaatagataaaagaccacccgcacagcgccacgtgtgggcgctgacgatgacggactcaatgcnnnnnnnnnnnnnnnnnnnnnnnnnncgagggaatgctgtccaccgtagagtaaaaaagaccatgatgcgagaatctatcataggggcggatcgagcacttccgtgcaccggaagagatcatgtccagggacaagggcaatgttgcttttgatgtgacccgaggcgagcttgatgatatatatacacgagctatggatgaacgttaagaaaggccctgctagacagatgacattgctcgtttatctggcatcattcctgcccgttacagtgttttgttcgctgagagtacgcgttcttacaagcttttaatatccccacctagatttcc

SEQ ID NO: 10033 - DNA, 173 bp, Diabrotica virgifera
  misc_feature (2)..(44): n is a, c, g, or t
  misc_feature (52)..(170): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgt

SEQ ID NO: 10034 - DNA, 116 bp, Diabrotica virgifera
  misc_feature (3)..(3): n is a, c, g, or t
  misc_feature (36)..(36): n is a, c, g, or t
  misc_feature (41)..(42): n is a, c, g, or t
  misc_feature (95)..(112): n is a, c, g, or t
tanattaccttagggataacagcgtaattttattgnagagnntcaatcgataaataagattgcgaccctcgatgtggatttaagttataattggnnnnnnnnnnnnnnnnnnaagt

SEQ ID NO: 10035 - DNA, 867 bp, Diabrotica virgifera
  misc_feature (62)..(81): n is a, c, g, or t
  misc_feature (811)..(811): n is a, c, g, or t
  misc_feature (819)..(819): n is a, c, g, or t
  misc_feature (821)..(821): n is a, c, g, or t
ccctcaactatttattaaaaaatgatgtcgtatttcggtggagtaaagatcaaactgcagcnnnnnnnnnnnnnnnnnnnncattgatcaacgcaccctgtctttcttactttgacccaactaaaaaggtaattgtcagtggagattcgtcttcatttggtttaggggccgctctgatgcaaattaatgaaaacaatgaaacggaaatagtagcatatgcatctcgaacactttctcctactgaatgtcgctatgctcaaattgagcgagagtgtttgagtttaacatgggcttgtgaaaaatttcaggaatacataacaggaatttctgtaattttagaaaccgatcataaaccacttctacaaatattacagacaaaaaatcttgatgatttgactcctcgtctacaaagatttcgtctcagacttatgagatataattatactgtactttttactcgagggacagacttaaaagtagctgacgctttaagtcgtaatccattgcaggtgtcacacaatagtgaagaacttacttcagaagtagatgcacatgttcgtctaattatacaaaatttgcctataaaaaatcattttcttaataaaattcttaatgaacaagagttagatcctatttgtaggaatcttaaacaatattgtatttcaggctggcctgacaaaaaacatatattgccagaaatgtgcccttattttcaatacaggtatgagattagtcttaatgagaactttcttacaaaaaattccaggttaattgttcctcctgccttacaattacaaaccctggaataccnttcatcangncatcaaggcattgtaaaatgcaggaaagggcaaaaatgtctgtctg

SEQ ID NO: 10036 - DNA, 935 bp, Diabrotica virgifera
  misc_feature (751)..(751): n is a, c, g, or t
  misc_feature (783)..(783): n is a, c, g, or t
  misc_feature (789)..(789): n is a, c, g, or t
atacctcatttggatggacacaaagtcagtatttccatcgtgaaaccagtgagagcatcctgtaaactaatggttatatttgtatacaagtcatctccccttctttcacgatggaaatacctcatttggatggacacaaagtcagtattgttagagataaaatcacatggccaggtgcacgcattcgtaagaagggcgaaggtatgcccaattatgacaacaataatctacatggtatactttttatcacctttgatgtggaatttcctaaacaagaactgactgaagaggataaagaagccctcaagaagatcctcaaccaaagctcaaacaacaaagtgtacaatggtctccgcggctattaggatacatatccctctacatttttgggacctctgtataaagtatttaaattcggtttccattttacttaatttatttttgattcctatttatttaagtgaagagaattgtgtatatacaaaaggaattttttgaaatataccagtggtatctatggacaaattttatctaaaaacccacgtgtgttaagtcaatatcaatatacatacatgtatatgggaagagacagaatatggtaatgaagtaatcaacagtcaaatcaagataaacttgaaattggtgaatcacatatactgttaaattgattctgtttagtgaatttattgctattagtgctttgaaattaacagccaaatattttcagccacaaggacaagcttacacttanatatattagtttatgtttgatataatgtgttncactanagtccgttgtatctcatacaattttttgaacactataacgtaaattaataaattgtggacatcagcacattgtttttacaatgttttagtggtgagatcattcaaatgacagacagtcgacatttcgaagcagctcacaaaagtct

SEQ ID NO: 10037 - DNA, 911 bp, Diabrotica virgifera
  misc_feature (2)..(44): n is a, c, g, or t
  misc_feature (52)..(165): n is a, c, g, or t
  misc_feature (174)..(890): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatttttgatcccatttttt

SEQ ID NO: 10038 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10039 - DNA, 51 bp, Diabrotica virgifera; identical to SEQ ID NO: 9123
  misc_feature (2)..(44): n is a, c, g, or t

SEQ ID NO: 10040 - DNA, 750 bp, Diabrotica virgifera
actttaaatacatccatttgctgttctagcttcaagtggccaacgttttcagtgtgctattatcatctttgtctgaaaagttattcttaccagcaaaaagttaacacaaaacaaaaactttaacaggtagaatttgtcgaaataacataaaattaaaccacaattgattataagaattaaatttcacatttttttaatgtgaaactctatttcacattaatatttctattttcaaatcgggaaaatattttcaaaaagcgttattggatttaacctgtcaatggtttcgatcttatgggcaaatagccattttttgagtgaaattctgagatgtgttgttgtaccctaagattgattaaattttgatctttctatggttacgtagttaaatatagatgatgtgtccctggcctattaactaattaaggggatgggtacgtattttctgctgcaatgctattcaaatggggatttatttttttcgaatcctgagaagactaataagtatttttgaaaggtttgaacgcagaatgaaagattacgttattagcgagggccgaaagtccctgagaacttctataatgtttattttaataagttacaggggtgaaatactatgaaaaaagttagtgttatttttaatttcaaatagctcattcaaaataaactttttatttattctaaaggactttcggccctcagtaataatttagtctttcattctaagtttgaatttttgaagcatattta

SEQ ID NO: 10041 - DNA, 657 bp, Diabrotica virgifera
  misc_feature (40)..(40): n is a, c, g, or t
atctttgtgttgtgaagtgtgtgacgtggttagaaatganggtaccttattcttcgtgacaaatagattgtgtctgcgtatgctacatctatccaccttatatgatatacatttgatgtaaacccttcctggaagatcttttctctacgcgaaaatgcttacctcttccaagtgatctctcctgcccccgcaatattgaaaatctctatgggataacccatattgaagttatatccttcaacttgaattttattcattacgcatataatactccttaatgcttctaggatacgcttgactcccaactcattccctctcctaaactgcacttcacatcccgctttactatgtgaccctcgattgcctgttccacagacacttgtctgaagagaaattggtccttttgctcccattatgtaccatctgacatgatattatagttggtatttcagagcaattgtagctcttgaaggacaacagacatttcttgacaacgaactaaataaactgtctgcccaacttttagaataatgatccacagagtactactgtgaatgatgcttagttgttctacccccttgcgcatatgactactttaaataacacagcctctcttttccgcccgcgtgctacttttccgcactcgaggtactcttc

SEQ ID NO: 10042 - DNA, 185 bp, Diabrotica virgifera
  misc_feature (6)..(76): n is a, c, g, or t
  misc_feature (81)..(175): n is a, c, g, or t
aaagcnnnnnnnnnnnnnnnnnnnnnnnnnnnnnnnnnnnnnnnnnnnnnnnnnnnnnnnnnnnnnnnnnnnnnnnatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttga

SEQ ID NO: 10043 - DNA, 371 bp, Diabrotica virgifera
  misc_feature (31)..(52): n is a, c, g, or t
  misc_feature (54)..(282): n is a, c, g, or t
aatagaggtagagagtgaaaatttgtattgnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgattaatttcgatgatgataaggttcacatcgagactccattgactaaaatgtatgtctaggaatggtactatggctcatccggagag

SEQ ID NO: 10044 - DNA, 51 bp, Diabrotica virgifera; identical to SEQ ID NO: 9123
  misc_feature (2)..(44): n is a, c, g, or t

SEQ ID NO: 10045 - DNA, 653 bp, Diabrotica virgifera
gtcaagcgaatccccggaggggactattgctgacattatattagtttacctctctttatatctatgaacatgccgcaagagccgattcacgtatccgaaactgatagccgccggccagatcgcatactccctactgcacatgagctgcaagggagatgtcttccgccccgaccgctgcttaagcctccgcctattgtatatcccacccatgatgagcgagacataaggagtcgtactggaacacgccaatagcgcccgtccacttttatgagaaaccattccaactgctgatccccctgcctgatttaatgacgaatgagctgcgttccttggacgagccatgcccagaaaagaacgtctgcaacggactgatgtactccctggcaacggcactgtcttaggagaacaacgagaagctctacaccatcacaccatgacaaatgtaccaagcattagaccgtgatactcctgccaacaccaatgctctactgtgctctacatacactccctccattccagaagacaatatcacagctatgaccagaatggacctcaactgagcacaggcgcagattgacccatcagacatgtacatatatacatattgtaaaaaaggtactattttaactattttattacagaattctttttgt

SEQ ID NO: 10046 - DNA, 690 bp, Diabrotica virgifera
  misc_feature (2)..(44): n is a, c, g, or t
  misc_feature (52)..(164): n is a, c, g, or t
  misc_feature (174)..(362): n is a, c, g, or t
  misc_feature (364)..(534): n is a, c, g, or t
  misc_feature (536)..(550): n is a, c, g, or t
  misc_feature (552)..(581): n is a, c, g, or t
  misc_feature (590)..(689): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10047 - DNA, 842 bp, Diabrotica virgifera
cccacgcgtccgaatgaaaataggttcgatttggcgctaagataacaaaaatttcgcctaaaaacatttatagtgcattcttcctaaaagtaattaagtaaataagtcacgggaacactatgaaaacatagaatctaacctcagtgtaaacaagggaccagtgaccgttaaggccgttagtgaccgttggtacaatggaggaagacgaagcctttgtggacgaaaatgtcccccgcagatctctacgtatagctctcattgaactcaatgaacacatcccagatactccaaaatctacaaaccctgaggagatgctggttatccaaagaggacccaggaagaagcccatcacttggtctccggtagactatcataaaataggtagtttactagctccctccagagacagaacaccagagccagtggtaacaaagtctgagattaatcccaggctcaggagaaggttgatcatgagtccgtcgaagagcccttcgcaggaaatggatgttttcatagccaagaagttaagggcgttaaaaaacatttctctacagtaaacataaggatctataggttaatgtttagtttatattttcaaaacgcttactttaaaaaataatgttagttgatacagtcttaaatgactctttctgtttggtctctagtagtagaaaaatttgtaataggtaaattttacactaagtactcgtttataaagattataagtaaatatttttagtagttttattagttaatttgagcttagccatgattgcaattcattttgaaatggccatagttttcgtagtttcttgtttctattttttttttcaatgattgct

SEQ ID NO: 10048 - DNA, 893 bp, Diabrotica virgifera
  misc_feature (567)..(582): n is a, c, g, or t
  misc_feature (781)..(781): n is a, c, g, or t
  misc_feature (810)..(810): n is a, c, g, or t
aaacatcgttcataacaatataacccaacttttttaaggaataatatgtataatctgtgatattttgttgtaatttatagttttgattattggtgcatataaaatatatgtgtaaaataggaataagtgacctttacactttattaccactacctcaaattataaactccagttgatggtacttaaccctgaactaagataaaaaaatatcaattaattcagcaaataaattgctttgtgatatactaaaaagttagtattttcaatactaccaaaatgaccacgaatgtgaagaaaattggagaaattagtatacctgtgccttggggacagctagcagctaaaacatggggtgaaccagatgaccctttaatactctgcttccatggatttttggacaatgctggtacctttaatcggttaataccatacttaccgaacagcttctactacgtctgtatagacctccctggtcatggcagatcatcatactttccaccaaatctacctataaataccttaaattatattttagcatataggtacattagttacattttaaaaggnnnnnnnnnnnnnnnngtcatagttatggagctcagttgggctatctttacactcaggtgtatccaaaagatgtacaaaagttaataatgcttgacacagttacgctatttcctgtgtctgttaggaattttaaaaagtatctttgtgagacaattgataactaccttcaacaggagatcaagatggcttcggggactcgacccacctacacganagaagaggctttacataaactacatacanggaaggagttatgcgcccgattaattagaaggcgcggaggctttattggagagatcaatagagaaactgaggatggtcgatat

SEQ ID NO: 10049 - DNA, 419 bp, Diabrotica virgifera
  misc_feature (2)..(26): n is a, c, g, or t
  misc_feature (44)..(84): n is a, c, g, or t
  misc_feature (102)..(119): n is a, c, g, or t
  misc_feature (154)..(171): n is a, c, g, or t
  misc_feature (215)..(251): n is a, c, g, or t
  misc_feature (266)..(415): n is a, c, g, or t
cnnnnnnnnnnnnnnnnnnnnnnnnnacccttagggataacagnnnnnnnnnnnnnnnnnnnnnnnnnnnnnnnnnnnnnnnnngcgacctccatgttttgnnnnnnnnnnnnnnnnnngggggaccagcttatttaattaaacttggttccannnnnnnnnnnnnnnnnngaatttgagatttaaaccggggggggggcccgggttgggtttcnnnnnnnnnnnnnnnnnnnnnnnnnnnnnnnnnnnnncacaaaaagggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 10050 - DNA, 349 bp, Diabrotica virgifera
  misc_feature (13)..(13): n is a, c, g, or t
  misc_feature (23)..(23): n is a, c, g, or t
  misc_feature (38)..(60): n is a, c, g, or t
  misc_feature (134)..(134): n is a, c, g, or t
  misc_feature (267)..(267): n is a, c, g, or t
gtgttttttggtnaagtagtttnagtgttcttacttgnnnnnnnnnnnnnnnnnnnnnnnatatagaaattaaatagtaaggaatgaatatgtgtgaagaagaagtttttggtttagtagtagagaatggatgnggtatgtgtaaaggtggttttgatggggatgatgtatgtagtggtgtattgagttgaattgttggatgtaaaagatattagggtgtgatggtaggaatgggagaaaaagatttgtatgtaggtgatgaagatnaaagtaaaagaggtattgttatgttaaaatagtatatggagtagggaatagtgagaaagtgggatgatatggagaaaatttg

SEQ ID NO: 10051 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (181)..(181): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggttggtttctatctttaatttaatantatattttagtaccaaagg

SEQ ID NO: 10052 - DNA, 61 bp, Diabrotica virgifera
  misc_feature (11)..(39): n is a, c, g, or t
  misc_feature (44)..(44): n is a, c, g, or t
  misc_feature (49)..(51): n is a, c, g, or t
gggtggatgannnnnnnnnnnnnnnnnnnnnnnnnnnnngattntattnnntagtaaaagc

SEQ ID NO: 10053 - DNA, 841 bp, Diabrotica virgifera
  misc_feature (427)..(448): n is a, c, g, or t
  misc_feature (737)..(737): n is a, c, g, or t
  misc_feature (757)..(757): n is a, c, g, or t
  misc_feature (760)..(760): n is a, c, g, or t
gtatacaatcagttttatttccattatatcccgatcgacaattggaaattactttcaaaaacaaattcgacttcatcatagttggatctggaccatccggatcagcattagccagtagactcgacggaaaatccaaatgttaacgttcttctgttggaaaatggagaacaagctagtatattaactgaaataccacttatagcaggtgctttcggaagtactttataccaatgggggtatttgacggagcctcagcctggattttgtagaggttgtactaaccaccaaattaaatgggaacacggtaatgctttgggaggcagtaccattataaattatatgatttatgtaaggggaaatcgtagagactatgacaactgggctgatcaaggaaatcctggatggggctatgatgatcttttgccgnnnnnnnnnnnnnnnnnnnnnnttcacgttgccattaaggatgacgcttatagaggcactggaggacccgtgactgtgactgatgttgcatggaggacaaaagtttccggagcttacgttcaagcggctcaacaggctggttacagttacgtagattataatggaaaggaacaactgggggtatcttatgtacaagcaacaactagaaatggtagacgagacagtgccgaaaaagcctacctaagaccaatacgcaacagaaaaaaccttaaaatacaaacaaagtccaaagttaccaaagttctcattanagataacgctgctttacggncgntgaatattcccataatgggattagacacaaagtttatgcaacaagggagagttattttgtctgcaggagctttaattctct

SEQ ID NO: 10054 - DNA, 625 bp, Diabrotica virgifera
aaatcgagaatgtctggatttggagacgattttggagttgccgacgaagacccatgcgacatcaattctatggtacgctagtcagatctaactcgcaggttttgacctggaggtgactccgcacgaaatgattgctcctgtcctgagtggggaagagatgaccctgaaggagatataatatgttacggagcagggggggtaggaggtggtattgtggataatgccgagtttagtgatatactattctatagtcgtgtagagagattctatacggaaaagggtgacggatataaagtgtgaaaggtctgtgcaaatgcacaatagagctcatggtagggagatgctggtgaatgaaatggtatgctggaagagacgaacaaatcttgatacgaaaagagataactatgcgcatagagagtaagagtcttaccagtctgaacgaagtgggtgcgcgagggaatgacgtaacatagagatctgtttgtctgtgatttgataattatgttgcagatgaggaagatgtatgttgaataggagagttggacaaatttactggtacagcaaaatatattcaaagaggattggagagacctcctggataacgaaggtgaccctcaatcttctg

SEQ ID NO: 10055 - DNA, 382 bp, Diabrotica virgifera
gtcgttaagaaaatagaagaagaaattttccttgtatttggagttccacgtctgttactatgtgataatggtgtccagtatacttcgggtattttcaagaaattgatggaaacctatggtgcctcagttcgttataatgcgttgtatcatccacagtgcaatccatctgaacgatataaccgaacccttaagacaatgatggcaacttatatagctggcaaccataggaagtgggatgaaaatttggccagactaacaagtgctacccgagctgtataccacgagacgactggtcaagatccctacatgataaatttcgttttgtagatggttaagaatgtacgaatatttttcgctgtatggacaaatccttagaacctgc

SEQ ID NO: 10056 - DNA, 858 bp, Diabrotica virgifera
  misc_feature (2)..(67): n is a, c, g, or t
  misc_feature (69)..(816): n is a, c, g, or t
  misc_feature (818)..(854): n is a, c, g, or t
cnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnngggg

SEQ ID NO: 10057 - DNA, 703 bp, Diabrotica virgifera
  misc_feature (186)..(200): n is a, c, g, or t
ctattgagcagtgatcaagctctaaagtcttcttgttgtgacgactggatgttgcgttctcttgtcgctcacaatggatacggtgtgtgcttagctgtattcctgggaaatgtcataccccgtgccggcttcccctatttcgtcgtccgcccaaggtatcttctggggatgtttgtcatgtgacannnnnnnnnnnnnnnacaagatgatacctaatgaaaatgacgtatcttctccttgtattaccgagttgttaatggttttattgtcaattgggaggtgatggaccaatactggttgtcacacctactggaatgtacattctttattgcattccgatagaacatgctgaaccttccaatatggatctccactcacatacaaggggaatttcttcttgatgacactattctatgtatgtgagcttcaacacacccaatcgggaatgcactcttagctaatagatgtcaccttggacgcctctggtctactatacgtgcttgtattcgcatcccgagatggcataacgcacaccgtatgaatctattaagatgattatcttctccacgcttccctccgttatggaggagagacagccgccactagtgtccactctctcatcaagatcttcatggagagttactcatgatgaaccaccttcgtcagcattacagagtagtccgctacatagaatgaaagctct

SEQ ID NO: 10058 - DNA, 762 bp, Diabrotica virgifera
  misc_feature (109)..(126): n is a, c, g, or t
  misc_feature (303)..(320): n is a, c, g, or t
  misc_feature (369)..(389): n is a, c, g, or t
attagtctttatcttagacgaatgcaatatcttttagaagaagtcaatgccaattttcttttgtgataagtaaatatgatggtgctacaatattttatttttatagacnnnnnnnnnnnnnnnnnnacctttgagtatcaaaggcctagtaattaatcatcctatatgtattattttcgaattcattaaagctaacatatacatatttgatagtgactcctaattatcttatatacctcttattggaatgatacgctttgcgcttttaactatctctcattgtttatcatttaaattccttgnnnnnnnnnnnnnnnnnnccatattcaactatttttatgttattagtactagacatttttatggatnnnnnnnnnnnnnnnnnnnnncttccaatttaacttccaaatctttatgatgatcttgaaattgcacatcctaaggtagggtattattaatttccatctattactgtttttattcttcagaaacttgttattactctacacacttagagtacatatattaaagaatcgggatcatattagtatcaaaatatctgaatataaggatcccatatgtaagtataactcttcaattcggccacataacttgctcctgcttatattttcattgtcgatattgattccatagaatcttctcgccattgccatctgagatactgttgaatgattctcgaaatcttgaacgcgtgatggaactactatctttattgtatgtattggaagctgccatgaacgt

SEQ ID NO: 10059 - DNA, 88 bp, Diabrotica virgifera
  misc_feature (2)..(21): n is a, c, g, or t
  misc_feature (59)..(60): n is a, c, g, or t
gnnnnnnnnnnnnnnnnnnnnataattaccttaggggataacagcgtaattttattggnnagagtcaatcgataataaagattgcgac

SEQ ID NO: 10060 - DNA, 408 bp, Diabrotica virgifera
  misc_feature (13)..(72): n is a, c, g, or t
  misc_feature (78)..(78): n is a, c, g, or t
  misc_feature (84)..(162): n is a, c, g, or t
  misc_feature (186)..(186): n is a, c, g, or t
  misc_feature (196)..(213): n is a, c, g, or t
  misc_feature (349)..(396): n is a, c, g, or t
aagacgagagacnnnnnnnnnnnnnnnnnnnnnnnnnnnnnnnnnnnnnnnnnnnnnnnnnnnnnnnnnnnntaattnatttannnnnnnnnnnnnnnnnnnnnnnnnnnnnnnnnnnnnnnnnnnnnnnnnnnnnnnnnnnnnnnnnnnnnnnnnnnnnnngattattagaataaattaccttanggatacagcnnnnnnnnnnnnnnnnnnagttccatcgaatataaagagggggaccccgcggtggggggtaaaggttttaaattggggggcgccttttttttttaaacgtggtccccttttaaattttaattgtatctgggggtaaacgggggggggcggcgcnnnnnnnnnnnnnnnnnnnnnnnnnnnnnnnnnnnnnnnnnnnnnnnngggggggcgccc

SEQ ID NO: 10061 - DNA, 945 bp, Diabrotica virgifera
  misc_feature (610)..(610): n is a, c, g, or t
  misc_feature (668)..(690): n is a, c, g, or t
  misc_feature (748)..(766): n is a, c, g, or t
  misc_feature (820)..(820): n is a, c, g, or t
  misc_feature (878)..(879): n is a, c, g, or t
gggggatcaatttagtcaattgccccctccttgagacttcgcctggtgtcgcctttttttaagaaagagataataattacgattgaaaataaatagtaagttttgtgtcctgttgacaaactgaataacgggatgaaacataaaacagaattccttctccaacgtacgtgttctcggtcttactgtatggtgtcgagtcttggactgtgaataaaatcgatctacttgataaatcgccttgaggctttcgaaatatggttctataaaagaattttaaaagtatcttgggtgaagaagattcgaaactccacaatactagaacgtctcagtagaatgtaatgagaagtttccaatatagattgctacaaaatattatacaagtgaaaatagaaggcaaacgcagtccaggacgaaaaagcactttgctggttgatttagggtggcagtgaataaaattaagatagctatgatagtaaccaacattctaaaaggacatggtacatgaagaaaaataaagtaacagcccataccgaaaaagaatcctgagtacgcgagtaacgagaaaatttttatttcattgccctctccttgcaaggttgctggatcccgnccgttgttgtagttacaattagaaaactatgatgagatcatgtttttagttgcgctgnnnnnnnnnnnnnnnnnnnnnnnggatatttataactgtatttataactgtattaactcataagaacttggtgatgattcnnnnnnnnnnnnnnnnnnnctgcttttttgtggttttatgtaattaaattgtaggtacataagttttatggtngtagtttggatctcttataccaccacacatggatcccttgccttttagattaataacnnacatacaaaaacacaagagccccgcaaactggaatcaaaagagcacaaatgtaatagataacgagc

SEQ ID NO: 10062 - DNA, 755 bp, Diabrotica virgifera
  misc_feature (373)..(392): n is a, c, g, or t
  misc_feature (518)..(681): n is a, c, g, or t
agctatttggtttgtattaataattgccggttattattaatacaaaccaaatagctaggtaaaagtaataataaccggcaattattaataatttccaattaattatacttaccgtaacatatacataagcttatttgaagtaagtaagatacggaaagagatggaacgttgtctttagaaacaactacgatacaataaattaaacaattacttattatagaaatattttcagttttgttagcatttaataactttagtgcaaaatttagagtccatatagtatagctagactggtatatggttctctctcatatgtgctagacaattaaatgtataacttaccttatttaacttattatatttgcatacaatnnnnnnnnnnnnnnnnnnnnaatgttcatattcaaatttgaaaataaataatttggttttagaattattaagtgtttaggtaagtgaaatatatttaatattgtatataagaaatatttttgtaaccaaataaaggcgatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaagaaccaagtttaaaaaccggggggggggagcttaaaatttttttataggggccccaaaatttatttcc

SEQ ID NO: 10063 - DNA, 944 bp, Diabrotica virgifera
  misc_feature (827)..(827): n is a, c, g, or t
  misc_feature (835)..(835): n is a, c, g, or t
  misc_feature (898)..(898): n is a, c, g, or t
  misc_feature (915)..(915): n is a, c, g, or t
  misc_feature (921)..(922): n is a, c, g, or t
cggacgcgtgggcaaaaaactgcatgcgacaatttttgataatattatcactgctacaatgagattcttcgataccaatccaggaggaagaattctcaacaggttttctaaggatatgggatgtgttgacgaattactaccgaaagcaatattggattcttcacagatgcttttgtctatgtgtggatctctcttactgatagtcatagtcaacccttacttcttaattctgattggcgccttgactgtagttttcggttttatgaggcatgtctacctaaaatcttcgaagaatattaagaggttagaaggaataatgagaagtcccgtttttacccatttgagagctaccattgaaggtttgacaaccataagagcttttggagcccaaagtactcttatggacgagtttgatcatcaccaagattatcattcaggtgcatggtacatgtttatagtttccagtaatgcatttggattttatttggactgtttctgttctctttttttggcagcacttacttttagtttactgttatttggggaggcctttaatctgaagggaggtcaagtaggtctggccatcactcaagcaacagcattaacaagtttactacaatggggtatgcgtcaatctgccgaggtaaccaatcaacttatgagcgtggaaagagtattggagtaccaaaatttggaaaaagaaccacaaccggtcgtacctcagaaaccagcaaaggaatggccccagaaaggacaaatcacttttatagatacttgtttaaataactttgaaggtggaccattggttttaaacatcttgatcttanattcacanaggaaaggggttgggagtgttgttagaaccggtgcaggataatcttcctttaatcagcactcnttagactacccccattngaaggnntcattaaaatcgatgacatcga

SEQ ID NO: 10064 - DNA, 953 bp, Diabrotica virgifera
  misc_feature (596)..(615): n is a, c, g, or t
  misc_feature (805)..(805): n is a, c, g, or t
  misc_feature (823)..(823): n is a, c, g, or t
  misc_feature (855)..(855): n is a, c, g, or t
  misc_feature (861)..(861): n is a, c, g, or t
ataaaattctaaaaatttgtgtgggcgttttttaagcggctatgaacgtatcggtggggttggtatatgcaatttttgtataaaaagtggagtttaaaaacgttgccctcaagtaacattgtccattagtggtataatgagaacgttgctccaaagcatcagtgtcagtttgaggttaaaatttttgcattgtgcaaacgaggaatcactctcaaaaaagtaattttttagggcttacaatatgtaaaaaaagctacataaataagcaaacgtgaactttattacttacacagttacaagaaaaaacaaagataaaaatttatggagagttatggaaattaaagaaacaattcttgcccggtgtaaaacataatctcatgtcacatttttgacacataattgtcatgtagccattcttgcaaaagcggcatcttccttttggtccatagatgggccagtgtcccacgttgtctttcctagtgatgtcatgtggtcgacttttcgtatgagttacaattttttcgaccgtctcgttcagtgaaggccgccccttcttttttattttacctgtttggtgaaaagattcagctatgtcnnnnnnnnnnnnnnnnnnnngcattggttttacttttagctacctatttgtagctatctatttttggctacctatttgtatttcatcatattcatctcccgaatctgcaactaaacactcatccaaatgcttactttcgatgtcctcatcatgggatatactctctgtatctgatacacctgctctaacaggaactatgtatgtagatcngtttttttttttcataanacgtaacagggagggatgtccatatttctgcnaagaanatttagcttagtttttaccattaccacttatattagcgtcaacgttgattctaagcacatactttttaggcaaagtttttgctaaaatactc

SEQ ID NO: 10065 - DNA, 853 bp, Diabrotica virgifera
  misc_feature (734)..(734): n is a, c, g, or t
  misc_feature (773)..(773): n is a, c, g, or t
  misc_feature (780)..(780): n is a, c, g, or t
cagcgaacagtcaacaactctcagctgatagcgctttaaacacaaaatttaaagggaaccatacactacagatgagacaataagtaaaagttgtgatattttttttgaggttaagtgtgttttgtgtgtgtgaattattgcgagaggagtaggagtataaggagaacatggacttgtattgttgcgaaaagccagaaaatgaagttcgagcttacgacgacccgacaattttacatgatagagtacttaaaaatttactcaaaaccgaggatagatacgtgttgccgttcaacgcctctcttgcgaaaactcaaaaagaagtgacggaagagatgcggaagatagttgcggagtggatgatggaggtaagactgaattttcgtttttaaaattttgtgcagcccccaatcatccacctgaactccattgtagctttggtctttccaggtgtgtgaggaacaaaagtgtcaggatgaagttttttcgttagcaatgaactatatggacagatttttaatgtgttgttcaataatgaaaagccagctacagttattaggaacgacgtgtttgttattagcatcgaaattcagggaatccactcctttagctggagagactttagtgtattatacagaccatagtgttacaaagcagcattggtggcgatgggaacttctagtcttgagtcaactaaaatgggatatatccgccgtaacaccccacgatttccttanacaccttttcaacaggctgcctcccttagacgaaaaagngaacatncagttacgagatggtccagaaacatgccaaaaccctcataaccctttgtgccagagaattcacttttttcaag

SEQ ID NO: 10066 - DNA, 903 bp, Diabrotica virgifera
  misc_feature (403)..(421): n is a, c, g, or t
  misc_feature (423)..(436): n is a, c, g, or t
  misc_feature (744)..(744): n is a, c, g, or t
  misc_feature (842)..(843): n is a, c, g, or t
  misc_feature (859)..(859): n is a, c, g, or t
  misc_feature (892)..(892): n is a, c, g, or t
cggaaaactgatgaagtatccgtattgtttttattgtatacttaggaaaagttgttatataagctgatataagttgtgtgaggatacttttcatgatttttccggtaatcagcaaggaagaagaggtctgtttttaacgaaaatcatgtataatcgaatgggtttaataacattggtctaattatagaatatcgataaccaaaaacagctttaatatcattcgcgtataatatctgacgtgtttatatccagatattcggttctgttataagaactcttttctatattataaaattctttcggtgtcatgttttttaccgttaaaatcccataatcgactttaaatttgacttttttcttgctctattcatacaattttcgattaagtgccataaaatatgannnnnnnnnnnnnnnnnnngnnnnnnnnnnnnnngatttttaatgtctccctaagagctctctaaaataatttaaactaaagaaataattaatcaaaatatataaagaatatcgatgagtgtggagagaggtaacaactatcaggagtattatacggaattaaaataatgtgaaatgtttggttttttatatcttattacgaggcctagcgatactggcaattgtgttctacgctgaggatagttttaataatttttagcgtgtgagatctggagaattagagagaaaattatagatagtagagcattgcaaataacacattacttgagcttacgaacaaanatctgtaggtttcccaagaaaaccagaagatcaaacagataagcatgtaaaataatacatagtgaaaaagttgtagtatgtttcttacttattaatannaatcgtcttatgtcanacaatatgtaagaaggaaattttatgtacattntttctttacat

SEQ ID NO: 10067 - DNA, 857 bp, Diabrotica virgifera
  misc_feature (24)..(62): n is a, c, g, or t
  misc_feature (468)..(493): n is a, c, g, or t
  misc_feature (740)..(740): n is a, c, g, or t
  misc_feature (759)..(779): n is a, c, g, or t
  misc_feature (813)..(813): n is a, c, g, or t
gttagataacgacagagaaacatnnnnnnnnnnnnnnnnnnnnnnnnnnnnnnnnnnnnnnnaatagtcaaagtaacagtaaggcggagcgaaaatatggtttacaggaagttaagtacattccagtcgaattagaacaaggtgtacctcttcagcccgaaaatggagttaaaagatctgatactttttttctacagtttacagtcatgacagcattattaatttttatggttggtggaaccataatagtatggacttctccagcgatagttaagatgaaatctaatgatactagtataaatccattaggaagaccaatagaaacgtatgaaatatctaaatttatgggtacagtaggaattctagccatgggcggtgcgctatttttaccgaaactggccgatgtcatcggaagaaaaaaaagtttgtgggtgatggcattttttatgtttataggaattgtaggannnnnnnnnnnnnnnnnnnnnnnnnngatgattatgtgctcgactctaacaagcatatttttctgtggagccatgggaattcttccaatgtatttaacagaaatatgcgaagatcacaaccgcacaaaatatggttgccttatgtcagcctttatacctttaggacaattatatacgtatcttattggtccggtatttagttatacagtttttacaatactaacagcagttccaatgattccgtttctggttttattcctttttgctccaganagccctgtatactctctannnnnnnnnnnnnnnnnnnnntgtttacgagcattaaaaagctacggtctaatanactgaccgagaattagatacgatttgcatacatagtaggctttg

SEQ ID NO: 10068 - DNA, 87 bp, Diabrotica virgifera
aatccaacatcgaggtcgcaatctttattatcgatttgaactctccaataaaattacgctgttatccctaaggtaatttattcttat

SEQ ID NO: 10069 - DNA, 1001 bp, Diabrotica virgifera
  misc_feature (41)..(64): n is a, c, g, or t
  misc_feature (725)..(743): n is a, c, g, or t
  misc_feature (851)..(851): n is a, c, g, or t
  misc_feature (896)..(896): n is a, c, g, or t
gtttgtagtttttcggtttggcgtttggtttacatcttagnnnnnnnnnnnnnnnnnnnnnnnnctcaagaaattcacgcagaacataaagatctcattcacgatgtcgcttatgattattatgggaggagaatggccacctgttcaagtgatcaatttgtgaaggtttgggatcaaacatctgatggaaagtgggtgttaacatcaagttggaaagcacacagtggatctgtatggaaagtaacttgggcccatcctgaatttgggcaagttttagccacttgctcctttgacagaacagcagctgtttgggaagaaatagttggagaattaccaggaccaggcgaaagaggtaccagacattgggtaaggagaacaaatctagtggattcccgcacttcagtaacagatgtcaagtttggaccaaaatctcaaggactccagttagctacttgttcagcagaaggaattataagaatttatgaagctccagacgttatgaatttgagtcagtggacattacagcacgaagtccaatgcaagctgccatgcagttgtttatcatggaatcctagtttgtctaaaatgcacccccaaatgatagcagtgggaagcgacgatccaaatccagcaaatggcggcaaagtgttcatctatgaatacaatgagaacagtagacgatggacaaaattagaaactataagttcagtagtggatcctgtacnnnnnnnnnnnnnnnnnnnaaatttgggaagaagctatcacattcttgctgtcgctaccaaagatgttaggattattaatttgacacctgtaaacgatgaacagagcattcagagtggagtaactanattggatgtagaaaccattgcacagtttgaagatcacaacagttnagtatggagagtatgctggaatctaactggtacagttctgtgttcactggagaatgatgggtgtgtcagaatggtcaaaatgatttacattaactcatggaaaac

SEQ ID NO: 10070 - DNA, 984 bp, Diabrotica virgifera
  misc_feature (557)..(574): n is a, c, g, or t
  misc_feature (826)..(826): n is a, c, g, or t
  misc_feature (872)..(872): n is a, c, g, or t
  misc_feature (910)..(910): n is a, c, g, or t
  misc_feature (929)..(929): n is a, c, g, or t
  misc_feature (937)..(937): n is a, c, g, or t
gcttttgccagtgttgttagtgagctccaatgacttttataaaaaatacaagttaaaatgaatcataataataatatgttacaattgtgtagactgtgtttagttaaggacgaagttaatataccaatttttgaggaacaaggtgatattaggcaaatattcctgaaaattagttcgtgtctaccggtgaaggtttcccgagatgaccaactgcctaaaaaaatatgtgatggatgttcctataagttagatatgttgtatgaattttggaatactagtgcgaatgcagagaaacaattgttaacatggttgggagaggcgggcatgacatctcagatgacagatggaaccatttcagctgtagcacaacaaatcaagccagcagatgcatttgtaaaacaagagacaatagacccgccagatatccttaaggatgacgatgatgaggatgaagaggataaagactatatgaaacaggaagagagctcgaataatgttgaagagcctcctccaaaaagggcgaggcggacagctgcagttaaagctgccatcgcctnnnnnnnnnnnnnnnnnnacgatgatgattcaggagagccaatgactaaggttgaagatgacaccgacgatagtgataatgacgatggacctccgttcgttgatgtaccatcaactagtgcagatgatcaacctggaccctcgggcgttggcaaagatggagtagaagcaccagttattcctaccatggactaccagtgtcggcaatgtagagcaccattttccactgaagcagatttacaaaatcacatagaatgcttgaaagcacacnctcaggtcttttgcaaacactgcttcacattcatcagaactcgaangaagggaaattccacaaggatatcacttattcctgtancatttgcaagagaatactngagagaanattatgccttacacataaatgttttcacgcccaaacctatcaagatc

SEQ ID NO: 10071 - DNA, 149 bp, Diabrotica virgifera
  misc_feature (6)..(78): n is a, c, g, or t
  misc_feature (80)..(95): n is a, c, g, or t
  misc_feature (102)..(121): n is a, c, g, or t
tgaagnnnnnnnnnnnnnnnnnnnnnnnnnnnnnnnnnnnnnnnnnnnnnnnnnnnnnnnnnnnnnnnnnnnnnnnnnannnnnnnnnnnnnnnntcaacgnnnnnnnnnnnnnnnnnnnntaaacagtgtcttattagattaaacata

SEQ ID NO: 10072 - DNA, 705 bp, Diabrotica virgifera
gaaatggtgtccaatcctctttatattactgtttcttctaagataaattcttcttctttattatgataatattggtaataaattattcttctatgatctttactcaagagttcctgggataatctataaattaagattatatattgctactcctattgatgacgacttactcattagatttctccatattccgcattgtggaataatgtatgtttatatagtatgacttgtatctttcatggattgtttattatgctctagatgctatgtatataggttcaaaatcgactacaccattaacataactgaattgcacatctattaaaaatatatatcgaatcgtacctagttttacgtgatggtttttatcacctgcctgttgtaaatgtggctcttagtctcatgtatagcttcacgcctgcccagtgatcagttggatggaacggatactctggaccgagctcacggacgatagtcattttgttattgattgatcgcagtaatgaccgttagtgtgaacagaagattgactatcttacagttatggactcttcctactttttggttcaaatattgatgttacccttctcgacgaaaagatcctataaagcttcctcgaatcagtactgatcatttttgcattcaagatttattaccactctagatacctgcacttgcgctagatcagcaaatagattggatctt

SEQ ID NO: 10073 - DNA, 886 bp, Diabrotica virgifera
  misc_feature (652)..(669): n is a, c, g, or t
tgtacagatcacattccccaagaagggtgacccagaagagtccatcatcataatcaccggatacgaaaccaatgccaacaatgccaaagatgatattatgaagatcgtcaacgaactcaacgagctagtcaaagaagaaatctccatcgactccaatgtccattccagactgatcggcgccagagggcgcaacatcaggaagatcatggaagacttcaacgtcgacatcaaattccctagggacggggacgccgacgagaacctcgtgatcatcactggccaagaggaaagtgtcctcgaagccaaagatcatttgctcaatctagccgaagaatatttgcaagactacactgaactacaaacccgagaaagactccacacgttgagctcccacttcgaaccacctgcagctcaaaaccacaacgcccatcgcaacagggacgaacccaacaatggcttcgtcgtccaaggcggtccatgggaacagcagagagccgccgctcccaacaccgccagcgtaacggagtttccgtccttcagacgcaacacagaagaaccccaatcttctcctgccccggtagctggggcctggggatcccgccgataaaaacgtaactgacgcatcgctctttccctcctacttttcgtcgannnnnnnnnnnnnnnnnnactattgaatgtattcgtttttagtttgatatgtttttgatttggttccttgggttacttttttactaggtcggttcgataagtactcgtctcctttttgctcgatatatttcacatagcgatgctccatcttcattaatccgtctggaaaatatgttttttcgatgtctgcaaagtaggctttgaaaacaaaaagaggtcatacagcgctaaatct

SEQ ID NO: 10074 - DNA, 580 bp, Diabrotica virgifera
  misc_feature (380)..(380): n is a, c, g, or t
acagatcttacttgagggtggcactgatgataaaggatatgaatatccatggttgattgctatgtttataaaattatcaggaaaattcttaaaatgtctgtggcgaaacgttgttcatccgaacaggtgttgcaaccgctgctcattgtgatactgataattatgattatgctcttggtaaaaaatactttcttgtgacttctgtagaaatttacaactccttcgtagaccctctagatagacatgctcaatatataaagatatcaccggactttgtgcatccaggatataaaggattcattcaccgatatgttgctgacttgtatttacttattactcaaaaactattctaacttgaaccaatatttatgccggcgtgntttgataatgttattaccatatatttgaaaaattatcaagtgttagaggtatctgattggggtctataccataatataaatagccctcataacatctcatatatattataataccgtacatagaatgagctacttgctccatagaactacccgaaagttgagaagaacagtataactatatgtactaaatatgtgctgga

SEQ ID NO: 10075 - DNA, 72 bp, Diabrotica virgifera
  misc_feature (5)..(67): n is a, c, g, or t
ggggnnnnnnnnnnnnnnnnnnnnnnnnnnnnnnnnnnnnnnnnnnnnnnnnnnnnnnnnnnnnnnnttttt

SEQ ID NO: 10076 - DNA, 926 bp, Diabrotica virgifera
  misc_feature (188)..(222): n is a, c, g, or t
  misc_feature (497)..(528): n is a, c, g, or t
  misc_feature (772)..(772): n is a, c, g, or t
  misc_feature (801)..(801): n is a, c, g, or t
  misc_feature (891)..(892): n is a, c, g, or t
  misc_feature (914)..(914): n is a, c, g, or t
cacaccaatcgtgttggatccgaacaaagattatgaaatagctcttcgtgcctttcattcctacaacagtataccaaacattgaaaataacaagttttattactacaatgacaaaaaccaattgacaaaatttgattttcccgatggatgttatgaaattgtcgatattgaagaatacatacaaaagnnnnnnnnnnnnnnnnnnnnnnnnnnnnnnnnnnngatatttagtctaaaacctaaccacaacacgttacagtgccaaatatttagcaaatataagatttcgtttaagcaaccagatagtcttggtacagtattgggattttctccggcaatacttcctcccggcaaaacatattcttcggatctacctgttaggattattaaagtatctagcatacgctttgaatgcaacattagtaccggagccttcgacggtaacagacctggtcacacgatctatgaatttgtcatacaatcgaatcctgggtacnnnnnnnnnnnnnnnnnnnnnnnnnnnnnnnntttacccgttgtgccacagcgtgaacttaccaatatcactgtcttggctctcgatcaagaaggacgacctgtaaactttagaggagaagagagcacgttggttttggaacttagatcacgagggaaatggggcctagtaataaggccatctactggctccaagaacgtcattagttgtgcagcagtctaagcggcaacatcttacgttcgcaaacaaattgtttttacaatcacttggttttanactacaaaaatgacaacaatgtatggaanacgagcacgttcagacagcgtagtaatgcctccaatatttgatatttatcgtaagccaatctttgatgaaatcatttcgaagggctgatnnacgacttatgcaccattcatcnaatcatttcact

SEQ ID NO: 10077 - DNA, 231 bp, Diabrotica virgifera
  misc_feature (40)..(76): n is a, c, g, or t
  misc_feature (96)..(109): n is a, c, g, or t
  misc_feature (112)..(134): n is a, c, g, or t
  misc_feature (142)..(164): n is a, c, g, or t
  misc_feature (194)..(225): n is a, c, g, or t
attggagagttcaaataaaattacgctgttatccctaagnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10078 - DNA, 375 bp, Diabrotica virgifera
  misc_feature (2)..(286): n is a, c, g, or t
  misc_feature (290)..(374): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10079 - DNA, 858 bp, Diabrotica virgifera
  misc_feature (414)..(429): n is a, c, g, or t
tcgttatctaaccaactttgtttttaagtgaaatatttattacaatataacgattttacactgtgattttggaatcaaatatattgtcgtttgataataccaataattgatatttaatagcatattgaagacgtagtgttgcatttttagacctataatgacgtttaaagaaattagtgtagaagaagtttatcagaacgacaataaactgaaaaaacaagatgttttagctttggaagaatggatgaagaagcaaccacacttaccaaaagccacagaattacaactcgctattttcctccatagctctaattacagtaacgaaatggcaaagaatgtgatagagtcttattttacgatgaaaactctatgttcggactttttaggaaaccgtacacttcacgatgatgtatnnnnnnnnnnnnnnnntacttatgtattttcagtccttcctaagcaagcacttggaggagaaaaagtagtaatatcaaaacttatggatactaatttaaatagttttactccattgggaatgttgaaattaatggatgttgttttggctttatttacacatgagaatggtcccccatgcggtttccagttagttttcgacatgcaaaactctagtcttgcacactttcttaaagtgaatcccatgcttataaaaaaattcatctactatttacaggatgcaatgccaatcagattaaaacatatacatttcatctacccagcatttttcctagataaaatttttagtttaataaagcccatgatgaagaaagaactgtttgaattgtttatagttcattctgatttaaaaagtcttttttgaatatgttccctcaagatattcta

SEQ ID NO: 10080 - DNA, 106 bp, Diabrotica virgifera
  misc_feature (2)..(100): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttt

SEQ ID NO: 10081 - DNA, 900 bp, Diabrotica virgifera
tgaggatggtttcagcatgctgtaaaatgcatgatatatcagcagaaggcattacattggttgaagatattatgaagaaaagggaaccgcttggtaccatggaagctgtgtacttgataacaccttcagaaaagtcagttcatgctcttatgaatgactttgaaccaccaagacagatgtacagaggggcacacgtgttttttacagaagtatgcccggaggaactgttcaatgagctctgcaagtcttgtgcggccagaaaaattaagactctcaaggaaatcaacattgcgttcttgccgtatgagtctcaggtgttctcattggattcaccagacacgttccagtgtagctacgatccatcattttccgctgctagaaacgccaacatggaaagaatggcagaacaaattgcgacactctgtgcgactctaggggaatacccacacgtcagatatagaactgattgggaaagaaatgttgagctggctcaactaattcagcagaaattggacgcctataaagccgacgaacctaccatgggagaggggccggaaaaggcgagatcacaattaattatcctcgaccgaggtttcgactgtgtatctccccttcttcacgaacttactttccaagcaatggcctatgacttactacccatagaaaatgatgtatataagtacgaagcatcggctggtgttatgaaagaagtccttctagacgaaaacgacgagctttgggtcgatctacgccaccaacacatcgcggtggtgtctcagagcgtcaccaagaatctgaagaaattcaccgactccaaacgcatgacccagagcgacaagcagtcgatgaaggatctctcaaccatgatcaaaaagatgccgcaatatcagaaagaattgt

SEQ ID NO: 10082 - DNA, 511 bp, Diabrotica virgifera
agttgatctaggattgcttcaagggacgagaataatacgggtctctattgtctccactgtatcgattcttctcgccggtgatgtaacatcaaaggatggggtcgcctatcaccaatatgaattacaaactgtagagcttctacgtcctgtctattctatagacggttttgtttggttgacccggattttgctggtagcttaaaaagaactctctccgaatatatgttaaggggtgtacgcgaccccgagaccaggtaaaacctggggtatgagattatggtctaatgctcggatatgccccgatatgccatggagagaagtagggaacatcaccgagcctgcatcgccacgacagaatatctccatcgcgagattccagatgatatgctcaatgtagcgggttcagagtcgactcgaagacactggtcatccgcagaataccctttccaacgtggcgcgagcattcgtcagatagtactcacatctgctcgttcgctcccagccggcgaac

SEQ ID NO: 10083 - DNA, 885 bp, Diabrotica virgifera
  misc_feature (62)..(74): n is a, c, g, or t
  misc_feature (76)..(96): n is a, c, g, or t
  misc_feature (256)..(287): n is a, c, g, or t
  misc_feature (787)..(787): n is a, c, g, or t
  misc_feature (814)..(814): n is a, c, g, or t
  misc_feature (840)..(840): n is a, c, g, or t
  misc_feature (842)..(843): n is a, c, g, or t
gcttcaattcataaaatatgacgtattattaacgttatttttaacttttggtattattttannnnnnnnnnnnngnnnnnnnnnnnnnnnnnnnnnggtacaattaaaatgtttaaaaaatatgtttcgttgaaatcataaaaatagaagtataatttcttacgtgcgtgcaaactacaagcactctgtttttttatgcagaaacgtactttttttatctttaaaacgtcttaatacacttaacttttttgagtannnnnnnnnnnnnnnnnnnnnnnnnnnnnnnncaggcaactgtgagcctaatacaaccttcgccaccctcaacggacaggataatcttgtgccaaaatcgtactggctcatctgaaaagagaaagattttacggacattttatgtaggtggcacagatagagcttattgcacttttaatatacgtttaaatgagactatttgtgccctgctcaagaaggaggatctactatttactataatattgtttttaaaccaagaggagtgattcaaatttacctagctgtgatgcttgtttgtaattagtccaaccgcaggcaagtttactcgctgttataaaattttgacactagtgacatttataaaattttgacacattggcatttcataggttaatttttagatttttagtatgcttttatataaaaagcagtttgatttattaaaatgtaaagtagcaactccttggaatatactatatttattatcacttggttctgtagatgtatacaactctttaattaactttttaanagacagcaaattatcattataattccncttaacatttttaattatacctttgngnnagtagtgttttagctgttaagcttagtggtacttaatacctt

SEQ ID NO: 10084 - DNA, 94 bp, Diabrotica virgifera
  misc_feature (2)..(50): n is a, c, g, or t
  misc_feature (52)..(93): n is a, c, g, or t
gnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnng

SEQ ID NO: 10085 - DNA, 242 bp, Diabrotica virgifera
  misc_feature (2)..(240): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 10086 - DNA, 881 bp, Diabrotica virgifera
  misc_feature (759)..(759): n is a, c, g, or t
  misc_feature (780)..(780): n is a, c, g, or t
  misc_feature (787)..(787): n is a, c, g, or t
  misc_feature (807)..(807): n is a, c, g, or t
aaaggcgccagcgccattattactacatggaaaatctgcagtatgcactggattttataagaaagtgaatcgtcgtgttcgtaataaaacaaaaatcgttaattaaactggcagaactttcaaaagaaaacactaatttcaagttactatcgttagtgcgtttaaacataaaagtgtttgattatttgtgttttgtataggtagttttgattatgtcttttggtaaacaaggagctagtttaagtgataactggaaaataatgaaattttaaggctgattttgttttggaagttacttattcaaactgtctaagacggctgaagaaatggtcaaaagatcggatggcaccgaatctcccattttagaggaaacggagagtgccaattcagaaaaaccaaaacttgttaaatatggagaactagtcattttaggatataatggatttttacctcaaggtgacagggggaggaggcgaagcaaattcgttttctgtaaaagacaagttgccaacggcgttaaacggttacgacactacgtagttaggacaccacattcaacacaagccattttagatgccacccaacattcgatttcctacacattatcgagaaatcatgccgttattgtagaatataccaatgatgaagataccgatatgtttcagattggtagatcatcagaagcccccatagatttcgtcgtaatggataccatagccggcgataagacgggagatacgagagttaaccaaagacggnatatcgaggtttgcctgtagngatattnatgtgatagaaataatccanaaatagctaggatatacgccgccggcttcgatactctagaaatatattttttagggaaaatctttaaagtggca

SEQ ID NO: 10087 - DNA, 239 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(232): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnntaatatt

SEQ ID NO: 10088 - DNA, 826 bp, Diabrotica virgifera
  misc_feature (788)..(788): n is a, c, g, or t
tgcgtatatttgatttcacaagtttaagtctacctttgcaaataagaggtgggggtgagtgggaaccttcttatggaaaaatggctagaagtccggttctgctaaatcgaattttgcatacttggacttgttgaaatcagctcttttttgtcaatgtaagtgtcttattttcgaaaaaggctaataagtaatatccaagctaggaggcgttatttaattgttttcagtaatctagttttctttggaaaatattaaatacaagtatgcatttttaatcctgtattacaaaattagatcaaattagcaacataataccgaaaaccgcatgtcgataccttttttctatctcgagatatcttaagaaatgtataaattctaaacataactcaccggtaaacgaggttaaggaaaagtagtgtgctatggaaaaaacaaataaacattttccagatgtaaacgtatataattaattaaaataacaataagacaaacaacactataaaatataacaaagaaataaagcaactacttacttagtcttagcgactgcctaaatgttcaaattgttgcccatcgttttcgatgcaagcatttactcttacaagagtgggattgcatagcaatcaacagatttaactggtttagacttttatttatggggacggattaaagaccttgtttttgccgctaggcccactactcgagaaaacatgatctagaatctagagaatacgaaacgccattcaaagcattgcgaaatcagaaattaagacagtggactcaatggngctgggtgatggtgatgatgtcgtatattaataataaa

SEQ ID NO: 10089 - DNA, 700 bp, Diabrotica virgifera
  misc_feature (3)..(16): n is a, c, g, or t
  misc_feature (25)..(501): n is a, c, g, or t
  misc_feature (508)..(545): n is a, c, g, or t
  misc_feature (565)..(578): n is a, c, g, or t
  misc_feature (581)..(603): n is a, c, g, or t
  misc_feature (611)..(633): n is a, c, g, or t
  misc_feature (663)..(694): n is a, c, g, or t
acnnnnnnnnnnnnnnttactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10090 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggggtgagccaggttggttnnnnnnnnnnnnnnnnnnnnnnnnnnnnnnncaaaaagg

SEQ ID NO: 10091 - DNA, 859 bp, Diabrotica virgifera
  misc_feature (401)..(420): n is a, c, g, or t
  misc_feature (614)..(631): n is a, c, g, or t
  misc_feature (808)..(808): n is a, c, g, or t
aattagtattaaatgaaagctgctaattttagttttattgttgaatttttaccagttgaaatttaaattttttgacaagcattaataaacgtgtatacccgacaattgttgatgtcaacaacaatgccaactttgagcttcacattttaaaattcattagaatgttacagggtgttcgataacatcgtggcacaccaaacttatgtttttttaaatgaaacaccctatattttatcttatattcgaaatctccttaacttccccattacaaaaatgtaaaggtctgttatgttataccaggtatttacaaagttataaccaattttttatgaaaatcgtaacaagttcagctccctgtataaataaaaatgatgacagcggtaatggtttattgttgaagnnnnnnnnnnnnnnnnnnnntcaaaattgttaaaaatgattgacattgctaattttcgttatatcgaatacagggtgagtccaaacgcaagtacattattttctcagtaattttaaatggaacaccctgtattttatatcactattgaaaagtactattttcgtactttaatttgtatactactttctccatgagtaaatttattagtttttgnnnnnnnnnnnnnnnnnngtggaccagtagcgtggccacccagatcaccaaaactgatttttttgggcgtacgttaagaatgaagtttataaaatgcctccaacaacaagggatgagatgaaaaatagaatacaaagtgtacttcgaagtgttaatttacaaatgcttcatagtgcaaaagcagcagccatgttncaatcacagtgtctgactaatggatttttgattatcacggaatgcactcat

SEQ ID NO: 10092 - DNA, 864 bp, Diabrotica virgifera
  misc_feature (216)..(234): n is a, c, g, or t
  misc_feature (376)..(393): n is a, c, g, or t
gtaaatttagtataggtaacattaaagaaagacagactagaagattactctaagaacctcctgcattaaaaaagactgcaattcccgcagtagaaaaagaagacccacaaagacaagtaagcaatgtctagaaactatttaacaataaatagaaataacagaccaagaacagaaatatcagcaataaaagacaggatctgagttacttgatgaggnnnnnnnnnnnnnnnnnnnggtgccaaaagtagtctcaaaattaactcggcaaaaacagaatgaatcacggcaagaggaggtggagagaaaagatttaaagataaatgatagcatagtaacaaaactgaacgctaaataataacttgggtttataatgtcnnnnnnnnnnnnnnnnnngctgaacaggaaaacaaagcacaacattagaatgaaataatattataatgtgtgggaacttatgtgcgatatataatactgtgctggatatttgatatacagtgagcgcgtgggggttggaatgaattcattttctcgtgaatggaccattttggaagaaaattccgaaataggtcaatttttgtttttggattgcgactttttggcgtatatatcatgctagtgacctcacccatctggacgtgatgacgtcatctgtgatttttttaaatgagaatgggggttgtgtggtagctcatttgaaaggtggttcggttctctattcagtggtataaacattgacatagttgtttgtacagggcgtccgagggaaatttttttagttgaatttattggcatgagaggggggaatctatgtagattgtttaactcagaataccttgtactgctatcggagaacaggaaagaatg

SEQ ID NO: 10093 - DNA, 661 bp, Diabrotica virgifera
ccctaacggccgagacaaacatggaattataaaaagggacccccttaaaagagtctttcccctaaaataatggaagttcttccacctaaaataaactaatgtttatttatatgaacagcatattttaatgacggacagatgacgttatagtcaggagcactagaattactagtacaaaacaagatagataaaaggaccaaaggaataaggaatgttgattttgtgaacataaaaaatgtccgatagtaaactgtgaaagtggatgtaaaggtctgaagtgaacatgatagaacaaattggatcttcatgatctcatagatactcagtccatatcagaagaatatggtatcccataacattcaatacatacctgttctgagtgtgtagaatgtttcgatacctgtatccttcttaagatcgacctgatggtgcaggacaagagccgatagtgcgttatattggggagagagctatcgccggctccttttacaatctgctcttcctatctcgctcacgacgaaacgggtttcttcgttaagaactaaatcgtaaactcaccttcatggtacgacatatggagttacgtaccgtctaactccaaaaacatgaaaagggtgatgtgtagtaaagagtgccatcgccccggagagacttatttaca

SEQ ID NO: 10094 - DNA, 685 bp, Diabrotica virgifera
tctatatagagagaaggtggcacctctggaggcgagcggggcggtattcccggggccccccacgcccccggtatatccacaataatataactttgaagagatactatatgattaattgttttatctaacttgatatatagatgacattgatgacccctatcatgaattaagtgacttatatcatcagtcctggtggagctatctactatacctcaaagtgtgagataatcacttgcgaaatcgaatgattgattggatgaagaaatgattccttcacggaacgccccatgacttttagagaaagtcaaaagcagacattaccttgttcaataaggctttgagtaccgaaacggttatccatagggaagagaagaacgcataaccataaataccatcctctacctgaggctctaattataggacaaggtgtatatatatgcgacgaccaaggcaaaagatattagttattacttaagaggttattccgctaactattatggtctctgccatccgaaagtcgtcaacagctatacaataccatagagtcagtacttccccacacatccatagaattcttttccaatcgactaggacagtatgcataggttctaaccaagcttcttgggtacgactaggtgctgccgataaataacgagttgaagcgcgacgatactgtctgttaatt

SEQ ID NO: 10095 - DNA, 603 bp, Diabrotica virgifera
  misc_feature (251)..(265): n is a, c, g, or t
ggcaacggcagtctaggaaggagccaggacgcagagcctgaaagagaatcatccaaacgaaggaaagtcgacaactcctcgaagaattccaaacatgaagaaaggaaatctaattccgagcaatttcaagaaaagactgagaaacgagaaagatcaagcaaacttaaagataaaagggataagatgagcgaagaagaaaaagagatgaggaaagaaaggaagctcggaaggaagagggatcgaatggaagnnnnnnnnnnnnnnntcgaaatgaaacgaagaagagacgaagataaagcttccaaaatggtatctccaaacagaagttcgaatggtgaaatcgttgaaccttccatccatgttagagagaagcaccacagaagtacaagggatatctcaccataccagcgagatcgatcgaacgagaaatcagagccacgagaaaaacataggcggggttcagaaaacaaaagaagatagccaacaatgcacgagcataaaaagaagacgcatgtctctattgtgtggtgaataattttatgaatgttgtacgaagaagaagtaggtgtaattattttttatgtaattaaaagatttattaag

SEQ ID NO: 10096 - DNA, 958 bp, Diabrotica virgifera
  misc_feature (858)..(878): n is a, c, g, or t
gttattttaaatgagtttactgaatgaagcccatgtccatttcgttcgtctttttagtttacttgtgtaattgtggactcttcttgtttctaaactttgttctccaagttttcaacgcttcttgtaagtatttatattttaaacataggaaacaggcagcagtcccgtttaaaggctttgtcaactttaaacggacctaagataaatcttcccgatcttgacaactctctatattttgattgtctgggtacctcaaacgaagtctgcgaatacatatctctattttttttgagcatttttgattgctgtttttaggacaaatatattgtccaggcatgatctgtctagggctagttacagaaatttctttaagtttgtacaacctttttacctcctttattatgtattgcgctttatatgctttataatcggtttaaaacgtccttcgacgtcttccgatgcataatctccatgcatctctatcttcccaaaggtcttcgtctaaatctctctctcggatctctctgcctattccttctctccagctctttctgggtcggcctcttattctatttccgtgtggtgactaatctagaatctgtttgggcagacggtgttctggcattctctgcacatgtcgataccacttgtactcttatatcttcgacaatcgtatgtgtgactcccttaatctctcgtatacgttcgttattaattctttcgagttttgattttcctgcggcacgtctccagtagtccatctccgtggcttgtagtgttctttcagtagttgtctttaactgccacacgccacttccatacattactatgctctttataatagtgttgtatattcgnnnnnnnnnnnnnnnnnnnnnatgttgatcccaaataatactatttagttgggatatggcccttcaaccttgaatgtttcgtttttttaaagctgatctga

SEQ ID NO: 10097 - DNA, 968 bp, Diabrotica virgifera
cggacgcgtgggtgttccggaccattttgagtgggaggatagctcaagtgttgttgtttgggttattttcgggcaatttctgcaggggggtttgagtcacctctcaacgtccatctcaaaacagatgcgccctggactaaaacaattttaagtactctcattgttaaaaagttgattcaccacattttcataacgatttttagggcggctgtacacggactgctgaggtcgtttatcactgagcgacatacacggactgctcgagcgatcgttgtagacttctggagcggtccattgttgactacctgagttgtcccttgtcgcattgcaaccgctctcgatctgtcgatagcacgatggaatttcattatgctattgacagcttgaagcggtcttgactgctcgagctgtcgtgtgtatggcaacgaatatacaattataattcaccgcgcaaacgctgcttcaaaaagtcgacctcaactgcttgaagatgtccgtgtacggccgatcttggggtatcttttttactcttatcgggaatatttaagaaccgaaatccctaatgttttccctatttgttccagaatgatatacgtgttaatttccaactgagacttgacggccagcacgaccgtacgacaagacattttcgaacagtaaaatcattagttttagtaacaaatacaaagacagatgggaattcggttctcgatattatgcagagtatttacctgatgatgaacacttattggaggatagaaacgcataatttgcagaactgacttacccatgtaatggacaggtatgatggaaacgtatgtactttaatgttttgttagtatttttacgagagaagctaagtaggtttgtgaagaattagttatttgttgtactcgatactttttattaactcattaattaattaaatcctacaaatacacaacgtaagaagctacatgagcgcgcag

SEQ ID NO: 10098 - DNA, 995 bp, Diabrotica virgifera
  misc_feature (392)..(411): n is a, c, g, or t
  misc_feature (513)..(530): n is a, c, g, or t
  misc_feature (747)..(768): n is a, c, g, or t
  misc_feature (811)..(811): n is a, c, g, or t
  misc_feature (868)..(868): n is a, c, g, or t
  misc_feature (899)..(899): n is a, c, g, or t
  misc_feature (901)..(901): n is a, c, g, or t
  misc_feature (970)..(994): n is a, c, g, or t
ctatactctgcggctgtcatggcggtgtcgaaatgaaattgcgactgtcgaaatgaattagaatcagggcccagttcatctacattagatggtattgcaatccagagggttgaaagcagtgttcaacaaatgagggatgcatcgaaatcaaacggaacattgcactaaaatcaatcagattggcttgatgcatttattttttaaatagttttgatgtacaagtttatttggaaaccaacgtgcagaagtacttataaactgattatgtttcccactttaattattatttttcggtacgttttatcacatctgtaacattctactgacttctactgacttgccgtttttttataccatctttttatttcatcttcataatataattatgcaannnnnnnnnnnnnnnnnnnnggagtggtctaaggtggtatcatactttatgttaccttcatctggcttttaggtctttgtatagttgtttcccatttagaaatttgtcctacctgtacatcnnnnnnnnnnnnnnnnnntgtccttattatctgttttcctatgatttgtttatttgaaatatgcctctttatacgaagcttcgatatattcgatattcaaaactttgtcttgttttctgaaatgctctgtttttaacctcctttctttttctttgaagtttagaaattattgaaaccccttttgagcgtaatgaggacaaaaataggacgaatgttttgttggactgttttgacnnnnnnnnnnnnnnnnnnnnnntaatagtgaatcttgtttatactgaaatatatttctaatgtanaataaatactgattgattgtttttcgagaaaatggggtacaaatatacacaaataanatgttttaatgaattaccctgtatttcatantngttagttaaattattaatagataatcagtcagtatttccgtgactttttagtgaatttgtattttctcnnnnnnnnnnnnnnnnnnnnnnnnnc

SEQ ID NO: 10099 - DNA, 659 bp, Diabrotica virgifera
  misc_feature (22)..(23): n is a, c, g, or t
  misc_feature (130)..(156): n is a, c, g, or t
  misc_feature (171)..(190): n is a, c, g, or t
gcgccctcgaggggcgggaggnngagaagaagagaagaaaggaagctctttaagggaggggaggggaggaagggaaaggaagaagagggagggaagagaagaaggagagagagaagaagaagacagaagnnnnnnnnnnnnnnnnnnnnnnnnnnngggagagagggaagnnnnnnnnnnnnnnnnnnnnggcgagaaagagaaggaaagggaaagaaagaccgcccgcaaaacaacacagaggacaacaaacaacggagcggaggagaatgcgaaatacgagaaagaagggggacaacccacggcagacaaacaggcaaaaaaggcgaaaaatacaggagaccaacagatcgcccacaagaacacacacaacgggacgaccacaaaagcagaagcgcgaaaaaggaccagacagcaaggcaaggccaaggcaaaagggggagctccgcatgctcccagatagatgttgccagaagggagcgaatagatcgacgatcctcatgcagtgtacgttggtcacgattatgtattacgagcagaatttgcaggtatgtacataattctcaccgctgagagaatgctggaaactgtgttggtcgttttcaatgcgaggctgtactcttatcatgttggcatagcgtatgactgaacaggattga

SEQ ID NO: 10100 - DNA, 719 bp, Diabrotica virgifera
  misc_feature (12)..(30): n is a, c, g, or t
  misc_feature (622)..(642): n is a, c, g, or t
  misc_feature (656)..(675): n is a, c, g, or t
cttaaggaccgnnnnnnnnnnnnnnnnnnnatgttaatatattaatattgagagagaatattgtatttcgatctaaaagatccttatttactgacccttgcgtgtcacggcttatctcttctaaattgtctccttattattttcgctgttacgagagctacaacattcaaagtctggtattgacccagaagtatcccacataatttttctgtaatgcatcgcccttccgccttatgtatgtctaatttttaggcccgcaccttatctccatcccttaacaagatctttctgattggatattgttatattaccagtattagatatttttacgcatgggctgaggagtaaacttttattaagaccgattctctagacaacaaccaagattccgctccttcctatttcatcacatgctatctactcattttcatactatattatcgttattttctataacttttttaccacaatataaatctatattatgtaaatctactcctgatgaccatattactattataagatggtgtatctagtaaagatatatcggcctgataaaggaattctcgcccatttttttcacctgctcattacaaacatgtgctttctgtattaaatatgnnnnnnnnnnnnnnnnnnnnncaatttgaatggtnnnnnnnnnnnnnnnnnnnncaagtaccataatcattagattttatattgagagctggcatgaa

SEQ ID NO: 10101 - DNA, 602 bp, Diabrotica virgifera
  misc_feature (4)..(214): n is a, c, g, or t
  misc_feature (222)..(473): n is a, c, g, or t
  misc_feature (475)..(490): n is a, c, g, or t
  misc_feature (492)..(511): n is a, c, g, or t
  misc_feature (513)..(542): n is a, c, g, or t
  misc_feature (544)..(560): n is a, c, g, or t
  misc_feature (574)..(596): n is a, c, g, or t
catnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnngnnnnnnnnnnnnnnnnnnnncnnnnnnnnnnnnnnnnnnnnnnnnnnnnnngnnnnnnnnnnnnnnnnngaacatctgtttgnnnnnnnnnnnnnnnnnnnnnnncttttt

SEQ ID NO: 10102 - DNA, 153 bp, Diabrotica virgifera
  misc_feature (2)..(34): n is a, c, g, or t
  misc_feature (36)..(59): n is a, c, g, or t
  misc_feature (61)..(146): n is a, c, g, or t
gnnnnnnnnnnnnnnnnnnnnnnnnnnnnnnnnntnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnngtttttg

SEQ ID NO: 10103 - DNA, 298 bp, Diabrotica virgifera
  misc_feature (2)..(15): n is a, c, g, or t
cnnnnnnnnnnnnnntgaaatttataattcaataaagaattaaaattatttgaaataggaaatgaagatagtataaatgtaaatatctatagaatgttgagcaagagaagccagtaactaatcaaggacttcgcgcatcaatattatcaccggcctatgaaaaagacgtctttttgtatgcaagtctgaaggctcgcctggccactcgagtcttagagagggcccggcacttcgaccgatttaccgtagcataaacgtcatgttgggcatatcagagagaggaatgcatcgttgacca

SEQ ID NO: 10104 - DNA, 572 bp, Diabrotica virgifera
  misc_feature (523)..(542): n is a, c, g, or t
gacaaacttcgtttcgcagttttccaacaaagctttaaattcagcactggaaccaaacggaaaagtatattgaaagctacttaatataaatcgtcagacaagattatatttttatacagcaaaccctattattttgaaccatgtagtgataatattattagtacttaccagagatatatctattattttcgaatataaaacagctaaaaagtaacgattatgattgtgaaatatgtatcttagagaaatatattctgatgagctgaaatacggatttacgtatacgctaatgactacaataaaagaatcaatttatattataaccaaaatatgtataattacataattttatattattgaaagtcaagatctctgcgttatgagcttaaaaatatggactgcacgaaaactatgatttgtgtatgagagaataggattaaatattttcctatatgaacttatgttaatatttaatactatatcccatcattgtaatgttataaaaaattacgattacaatatnnnnnnnnnnnnnnnnnnnnccggagtggagagactactaggggaataca

SEQ ID NO: 10105 - DNA, 186 bp, Diabrotica virgifera
  misc_feature (2)..(133): n is a, c, g, or t
  misc_feature (159)..(159): n is a, c, g, or t
  misc_feature (163)..(163): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattgggagagntcanatcgataataaagattgcgacct

SEQ ID NO: 10106 - DNA, 719 bp, Diabrotica virgifera
  misc_feature (2)..(44): n is a, c, g, or t
  misc_feature (52)..(164): n is a, c, g, or t
  misc_feature (174)..(362): n is a, c, g, or t
  misc_feature (364)..(536): n is a, c, g, or t
  misc_feature (551)..(580): n is a, c, g, or t
  misc_feature (603)..(716): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacacnnnnnnnnnnnnnnnnnnnnnnnnnnnnnncgcccactggattaatttgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctt

SEQ ID NO: 10107 - DNA, 940 bp, Diabrotica virgifera
cccttctgcgtccgaaaacatgatgagaataaacatacttaaattcttaaaaatatttcaaatggttttaaatcaatagatatgtgtttataattttcacatatagatatggatcctgaggaattaaatttatatcaacaacagttggttcagataaataacgcattatgttcttgctcagaaggaccagaaaagcaagaactactgacgttaaaagccagcattgaagaattgttagaactgactagggaggatagcagtgaaaaattaaaggctggtggtaccaacagcattgatgatgaattcgcagcgtttatggaggaaatggaaaaagaaggggcagtggagactaaaaatattaaggactcaagcgaatgtaataaggaaattaatttagaagagatcgaaggaaagaaatgtagagctccacatcaccatcattggggcaatgttacttaccataatgctatgatttgttcagtggtttctaacgaaaacgaagaacttaaggtaagggtcctttttataaaccccacccaccaagaaatgctaccatgtcctttctattacaactcagattgtaaattctcagaggagcaaaattttctcacggagaaatagtaccctattcaagtcttcaagactatgtagaaccaaattttgaccagctggaagtaggtaattcagtattggcaaaacgaaataacaacttatggtatagagcccgtattaagagtatacatggagataaatgtttagtccaatttgacagtaatcgaaaggaacaagaagtggttttagaacatatttgtccgttggataactgtaatggaagtagtgatgatgataatgatgaagatgatactgaaaatttaaaagaatgaagtattcaggaagatatttatcatatgagcctgactgtcaaaccaatggatcagcg

SEQ ID NO: 10108 - DNA, 635 bp, Diabrotica virgifera
ttcgcgcccgacacgccatttgaaaattccttgatcggtccttatgggtagacatattatttattgaatgatacttcgaaagattctgcgaaaaccacaatagtatgcaataacgaatcacttgtgcctctattagtggatatcattcatactgactatttcataatgtacattgttgtctctgaataaaccgatgaagtttgctttgctctttaaaatataaaatttatgtgatgttgttgtcgtggacggtcacggtctacgagataacacataggcaatatgtcttccatctaagttagatgtaaatgttataatttatgtttatatattttatccatgatgtataatttgatatttcttcttctaaagttgcagcgttgccgaccttatcaattaattgttatggatgtataaagacgaaaagttttagaagtctccgatatgtacaggataaactattatagttattgatatcatgattgtttaatgttttaaaactccataggctcttatacaggaaaataagacaagactatgaatgagagctataacattgtaaatcaagtgccctttttagcctcaatttagagattatgaagggtctctttccatctatggagacagttgttgta

SEQ ID NO: 10109 - DNA, 1102 bp, Diabrotica virgifera
  misc_feature (879)..(879): n is a, c, g, or t
  misc_feature (911)..(911): n is a, c, g, or t
  misc_feature (1049)..(1088): n is a, c, g, or t
gttacacaactaccaaagtcttaacaacaaacaaaggatccgaatcggatcagaacctgatcagagaattgttagctcaaaagcagtcccttttgatggaactaaagcattacgatgtgaacacaaaatataacgaaaatattttttacgaaactgaaagttacgaaaatagtggtgtcattcctgcgaacactagattggagcttgcaattagcaccaatagcactgatccaaaaccacatgtggagctctacttatgcaccaataactccacaataatcagagcaacgataatttttgccgaaggaatatttagtggagagactcatgtgattcaccctcctgtttcaaaattaaaatcacagcttctggtacctttgtttttaccgaaagatagtcctgtagatatacatgtaaaggtattaattgggtatccaaacagttgccaatttcatgtttacgaaataacccgacagctgccaaggttctcaatgtactccttaaaagaacctggccgaaattcaagaagtgacagctacgtggaatttaaaattaacgaacgtctacaaagaatatgcatgtggatcaatcagaattttttgctacccaacgatatcgaatttgactctgggccaaatttaaccttgagtttgaagtgtttaaggaatgacactgatctggatttggtgtttgagatatctggaaaaattactatttataccagtaatatatctctagctgccgatataatacagtctattgctgcgtatcttaacataggaaatttagagaaacgcactaccggatcagtataaagaattaatgactataaatgcagaactaataaatggttataatatcagattgcaaaattataantgaaaggtgtgaaaccatgaaaacacttattncgattatacagaaggctttcagactaagagtgggatcaaagtcgtcaaacatggatcatttttgtagaacctggtttgaataccacagtggccgaagacttcctaaaggtatcaaaactgggggaaatgggaaggggnnnnnnnnnnnnnnnnnnnnnnnnnnnnnnnnnnnnnnnncctaaaatattctt

SEQ ID NO: 10110 - DNA, 714 bp, Diabrotica virgifera
  misc_feature (8)..(615): n is a, c, g, or t
  misc_feature (624)..(624): n is a, c, g, or t
  misc_feature (629)..(664): n is a, c, g, or t
  misc_feature (674)..(674): n is a, c, g, or t
  misc_feature (686)..(706): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaanggggnnnnnnnnnnnnnnnnnnnnnnnnnnnnnnnnnnnnagaattttantttttaagttannnnnnnnnnnnnnnnnnnnnaagacgag

SEQ ID NO: 10111 - DNA, 992 bp, Diabrotica virgifera
  misc_feature (14)..(26): n is a, c, g, or t
  misc_feature (29)..(44): n is a, c, g, or t
  misc_feature (427)..(455): n is a, c, g, or t
  misc_feature (721)..(745): n is a, c, g, or t
  misc_feature (867)..(867): n is a, c, g, or t
  misc_feature (872)..(872): n is a, c, g, or t
  misc_feature (902)..(902): n is a, c, g, or t
agctgataacatcnnnnnnnnnnnnnttnnnnnnnnnnnnnnnnctagtttaagttctgttctattcacttcagtataatgaagaatcagctggtcttttttcttcacataatttttattacgacagttacctcaaagacacactctgttaaagatttaaaaaacgtatttaaagatgagctctgcatagaaggtaatattaatagtatatattccaaaaagacggacactgtggttgtgaagagtacaaaaactgaaggtcttctcaaccttacttctgtaggaacagtacaggagtctgaaaagccagtattatccagactgaatgaactagttggcttcaatcaaattgactattatttcaaacttgaaaatgaagagggtcctccacataataggttgtttacagtagaactaaccttaggcnnnnnnnnnnnnnnnnnnnnnnnnnnnnntcttaaaaaagccaaacaagaggctgccacaaaagctttagaaaaaactgaatatgattttcccgaaataaaaaacaatagccctgaggatatagaggaactcactcccactgttcttctaaataatatagcctctaaattgggtgttggagttacatattatcttctagataaaaataaagaggaaatactccattccaacatcattatgactgacaaaaagaaatcatatttgcaaagactgaatgcgtctatttacaatgacnnnnnnnnnnnnnnnnnnnnnnnnntagagtcaaccaagggtccatttaggctgaaattgaaatttgctgattatacattctttacaacttcacattcaatacagggaggaagacatgaagttgctgtacaggctctggaatacttnggtanaaaacaagacagtctagatatcgcttgttngcaggaaggatctgaagctgaaatgcagcagaataaagattacctgaagtcacctatctcccaagtgtatgaagaagccgaaaaaaggaa

SEQ ID NO: 10112 - DNA, 892 bp, Diabrotica virgifera
  misc_feature (2)..(821): n is a, c, g, or t
  misc_feature (831)..(831): n is a, c, g, or t
  misc_feature (843)..(890): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaattatttnatttgggtgatnnnnnnnnnnnnnnnnnnnnnnnnnnnnnnnnnnnnnnnnnnnnnnnnga

SEQ ID NO: 10113 - DNA, 679 bp, Diabrotica virgifera
  misc_feature (200)..(220): n is a, c, g, or t
  misc_feature (316)..(334): n is a, c, g, or t
  misc_feature (337)..(353): n is a, c, g, or t
  misc_feature (492)..(525): n is a, c, g, or t
cgttgttgtcagttaccacaaaatataattgaaaggagcacggaatttttcattacttattttgtgacgattgcgagtgaattactctcagtgagattatatgtattgttatcagataaaaacgtgtttgtgtgaaccatgtgtgtcagggattataatttattagttatagatttattaattgcgattgtaagagagcnnnnnnnnnnnnnnnnnnnnngtgaaataatgattttagagaattttattgcaatgacctgaaagtctttgttatctatatctaaagatttatgagataaattaactttatttatannnnnnnnnnnnnnnnnnnggnnnnnnnnnnnnnnnnncattaaggatgtctagcgcatgagcttaagaataagattatatttacattttctttttgagtaacaattcggattacatattttcatatgttatactatgttaatatttatttctatatattatgattgcaattccctnnnnnnnnnnnnnnnnnnnnnnnnnnnnnnnnnnatatattgcttaaagtagagactattagcagaatgaattgtatatttagtactgataaatagagctagtagcggtgattcgtttacatttgtttcacctgatgattaaaatcatggcttgttgtattaaatagagcgtcgcgcctgcccattga

SEQ ID NO: 10114 - DNA, 772 bp, Diabrotica virgifera
  misc_feature (511)..(523): n is a, c, g, or t
  misc_feature (525)..(537): n is a, c, g, or t
  misc_feature (544)..(561): n is a, c, g, or t
  misc_feature (722)..(722): n is a, c, g, or t
  misc_feature (734)..(734): n is a, c, g, or t
ggatggggaaaaagcattgagctcgtaatttatttactataagaaattttcgcttctgtcgacactcccacgagtgccttcaatttttttactctctcttggtatttattcaacaagtaacatacataggttatcttactaatagggaagagaaaaatcaaataaaaaaacaacacttgattccatttgaacttggaataacccctaatctgtgtaatttttatatgacttttatatagccactctttctttcaagatatccataagtccatgataattgatatataacatctaatgctaatataacatctcggattagtttattaaatacctcaattggtagatcactagtatgcgagtatttaccccatagcatttctaacactgttcttcacatctgttgttaaaattctataaaaattaatattgagcaattataaacaaatatttataatctatcacttaaatcgtaatacaggcaataaaaactataaaataccgtaagatatannnnnnnnnnnnncnnnnnnnnnnnnngtccaannnnnnnnnnnnnnnnnnatcttacacgcccattttttcctcaaaacctctaacgaaaattataatttgaaaataatttattcagagctttatagtagtaaataaaaaaacacaattgtaacaacatatcataagggcagtagttgacagttaatgagttgcaaaatacactggcctanaagaagggttgncaacaggtctatactccatccgaccctcagctaagcgc

SEQ ID NO: 10115 - DNA, 724 bp, Diabrotica virgifera
  misc_feature (2)..(697): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaacccctatagagtttta

SEQ ID NO: 10116 - DNA, 928 bp, Diabrotica virgifera
  misc_feature (2)..(18): n is a, c, g, or t
  misc_feature (20)..(68): n is a, c, g, or t
  misc_feature (70)..(650): n is a, c, g, or t
  misc_feature (657)..(920): n is a, c, g, or t
cnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 10117 - DNA, 378 bp, Diabrotica virgifera
  misc_feature (3)..(65): n is a, c, g, or t
  misc_feature (71)..(85): n is a, c, g, or t
  misc_feature (87)..(195): n is a, c, g, or t
  misc_feature (199)..(228): n is a, c, g, or t
  misc_feature (281)..(324): n is a, c, g, or t
  misc_feature (333)..(374): n is a, c, g, or t
cgnnnnnnnnnnnnnnnnnnnnnnnnnnnnnnnnnnnnnnnnnnnnnnnnnnnnnnnnnnnnnnngaagannnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnacccttttttttgtggggcccccaaaaaaaggcccccccccgggcgggaatgnnnnnnnnnnnnnnnnnnnnnnnnnnnnnnnnnnnnnnnnnnnngggtacgcnnnnnnnnnnnnnnnnnnnnnnnnnnnnnnnnnnnnnnnnnncccc

SEQ ID NO: 10118 - DNA, 385 bp, Diabrotica virgifera
  misc_feature (25)..(42): n is a, c, g, or t
ggaagtagagaagcatggtgctctnnnnnnnnnnnnnnnnnngaatattaaagtcggtcgcacctccctcgaggggctgaatgaatttcagtctctcggggacaaaacactagcaggaacatcggtagactaacatagggagaactaagagtaatatcgccataataagactaaacgaagaaagcgtgtcgagagggaaatgacccatagaggagaagggaatgagaatgcctattatagaggcacgggagggtccaaaaactccaaaataacacgacaaacgtaagagcaagactaaagctaatattatatattggataacgttattaaacagctaaatgggagaatcataaaaatgctacatggatgcggtgctggagacaat

SEQ ID NO: 10119 - DNA, 134 bp, Diabrotica virgifera
  misc_feature (2)..(46): n is a, c, g, or t
  misc_feature (50)..(72): n is a, c, g, or t
  misc_feature (79)..(130): n is a, c, g, or t
cnnnnnnnnnnnnnnnnnnnnnnnnnnnnnnnnnnnnnnnnnnnnngaannnnnnnnnnnnnnnnnnnnnnngtatttnnnnnnnnnnnnnnnnnnnnnnnnnnnnnnnnnnnnnnnnnnnnnnnnnnnngggg

SEQ ID NO: 10120 - DNA, 629 bp, Diabrotica virgifera
  misc_feature (35)..(53): n is a, c, g, or t
  misc_feature (445)..(462): n is a, c, g, or t
atatttattaaatattatgtaaatagcatgtaacnnnnnnnnnnnnnnnnnnngtaactcgaactagagttatgattacagttatataaataaaaagatcggtaacaaaaaatgtgttcttatttattagacatttataaaggtataaacaagtaattatgtttattctccagtcatcatctccatgaattcatcgaaatctacggttccggaaccgtctgtgtcgatttcttctatcatcatatctaatccttcgtcttatgggtctacccttcgacaagaaaatcttagaataactcatagaagaagtaaatgatgatagatccggtcatctactattccaacaatttttaatgtgtggctgtctaattcatactttgattgaatatgctatccatatgtagcaaaacattttagatcctgtatcgaggatttgcgtagtgcnnnnnnnnnnnnnnnnnncttatgtactccttaaattgaagaaattataaattgtctcagacatataatttctatggatctaatgatgatgtccaagagaccactactaatatagaagattcttctctcgatattaaggaggattgcctatataattgatgctcctaacggcatataaacggagt

SEQ ID NO: 10121 - DNA, 1282 bp, Diabrotica virgifera
  misc_feature (582)..(595): n is a, c, g, or t
  misc_feature (598)..(610): n is a, c, g, or t
  misc_feature (843)..(871): n is a, c, g, or t
  misc_feature (955)..(972): n is a, c, g, or t
  misc_feature (977)..(997): n is a, c, g, or t
  misc_feature (1017)..(1034): n is a, c, g, or t
  misc_feature (1060)..(1086): n is a, c, g, or t
  misc_feature (1089)..(1108): n is a, c, g, or t
  misc_feature (1112)..(1133): n is a, c, g, or t
  misc_feature (1230)..(1250): n is a, c, g, or t
atttgcgttttgactcaccctgtgttcgatgtggggaagtttagcaatgtaaaccatttttgtaggttttggcaatcaacagaagagtatggcaccaataaaccgttgcgttgtgcttatttttgtttatacagggagctgagcttgttacgtttttcgtaaaaaattggtcatacctttgtaaaagccctgtgtagcatggcaaatctttatattttttgtgatgggaaagttaggggaattttgagtatgaggtggaatatggggtgttccatttgaaaaaacgtaagtttggtttgccactgtgttatcgagcaccctgtggcattctgactagtttcgtgatgtgaagctggaagttggctacaatttttgttatcgacttttgttgctgtctattactgtagcggatctactgagctttgtcacactcatcaatcaccctgtatattgaataaaaattattttaggaggaaacaattttttgtcattacttttcaaaccacaaaaatgtctggcaattatagtttatatttctaacaatgtttgaaaagtaatgacaaaataatttttcgtcttacnnnnnnnnnnnnnncgnnnnnnnnnnnnncctgtacaggtgtgctgcgcagtggtgagcgcggcctgtgtcggcggccagatggccggtacggtgttcggggaggcatggggaataatatattgaaagaaccagttttcttaaaatagtttttttttccgacgttgctagctcttggtccataagttatctcgtttatccacagttcttttttcggttgcactttttctattttgcagtttttattatacacaaaagtggannnnnnnnnnnnnnnnnnnnnnnnnnnnncgaaccgatatttgccgaataattgttttatctcattggtttaaatgggcttttctccttaaatccttggaaccaaaattgaannnnnnnnnnnnnnnnnnacccnnnnnnnnnnnnnnnnnnnnncccccgagattattatttcnnnnnnnnnnnnnnnnnnccttttcattatttttaagcgaaagnnnnnnnnnnnnnnnnnnnnnnnnnnnccnnnnnnnnnnnnnnnnnnnncccnnnnnnnnnnnnnnnnnnnnnnatgaaaaaaaggatttttaaacaagggttcttttttcctatacttttttgtgtattttggaaccctctttcctctcttaaaaatttttgttcccatnnnnnnnnnnnnnnnnnnnnnccacaaaaccccccccctcacccacccccccc

SEQ ID NO: 10122 - DNA, 793 bp, Diabrotica virgifera
  misc_feature (2)..(44): n is a, c, g, or t
  misc_feature (52)..(658): n is a, c, g, or t
  misc_feature (665)..(665): n is a, c, g, or t
  misc_feature (670)..(671): n is a, c, g, or t
  misc_feature (673)..(715): n is a, c, g, or t
  misc_feature (728)..(728): n is a, c, g, or t
  misc_feature (736)..(736): n is a, c, g, or t
  misc_feature (746)..(746): n is a, c, g, or t
  misc_feature (755)..(781): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgngaggnngnnnnnnnnnnnnnnnnnnnnnnnnnnnnnnnnnnnnnnnnnnnatttttaagttanaagcttanatttttttanaagacgagnnnnnnnnnnnnnnnnnnnnnnnnnnnaatagtttttag

SEQ ID NO: 10123 - DNA, 780 bp, Diabrotica virgifera
  misc_feature (2)..(44): n is a, c, g, or t
  misc_feature (52)..(164): n is a, c, g, or t
  misc_feature (174)..(536): n is a, c, g, or t
  misc_feature (538)..(631): n is a, c, g, or t
  misc_feature (640)..(657): n is a, c, g, or t
  misc_feature (670)..(709): n is a, c, g, or t
  misc_feature (712)..(738): n is a, c, g, or t
  misc_feature (741)..(741): n is a, c, g, or t
  misc_feature (745)..(745): n is a, c, g, or t
  misc_feature (751)..(751): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaatcacnnnnnnnnnnnnnnnnnngctggatgtgagnnnnnnnnnnnnnnnnnnnnnnnnnnnnnnnnnnnnnnnnggnnnnnnnnnnnnnnnnnnnnnnnnnnntanattnttttanaagacgagagaccccctatagagttttat

SEQ ID NO: 10124 - DNA, 763 bp, Diabrotica virgifera
  misc_feature (2)..(46): n is a, c, g, or t
  misc_feature (53)..(536): n is a, c, g, or t
  misc_feature (538)..(749): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagaaaccc

SEQ ID NO: 10125 - DNA, 916 bp, Diabrotica virgifera
  misc_feature (142)..(159): n is a, c, g, or t
  misc_feature (170)..(189): n is a, c, g, or t
  misc_feature (574)..(613): n is a, c, g, or t
  misc_feature (825)..(825): n is a, c, g, or t
  misc_feature (834)..(834): n is a, c, g, or t
  misc_feature (867)..(867): n is a, c, g, or t
  misc_feature (886)..(886): n is a, c, g, or t
cttgaattcaggatttgattatacatatattaggtattggactatattattggcaaaataatttaattcatatacccatgttagaaattttatttagaaaattagttcacaatattaaatagtaaatactttttgtttagtnnnnnnnnnnnnnnnnnnagatgacccgnnnnnnnnnnnnnnnnnnnnaaatgtaattatatgttaaaaagaaacttatcaaacctgtcgggattgtggcgtaggcccattctaaaccaagcgaatagttactacataactacttcaaaattgctcagagtctgtccaaacttcatttagtagaagtagccttgtttcttcgataaatcgataaaaatcttaatgacaaaccaggaactatataatcaagcttacctacacgtttacacgctaaactgatttgcactgcactatctatgatagaagtaagttagggaataggaagctatattctgttcactgaattcagtcccaactatctaattaattttgtgctacgttacttctactgctactcctgttgcgtactaaatttttacttcaactgaaagtnnnnnnnnnnnnnnnnnnnnnnnnnnnnnnnnnnnnnnnnttattgtaactaaaagtaaaaattattcaaatgcagtttattactaataaaataaaattgcatcaattaaaacaacaaaacaaaggtttaaatttttgaaactttatagtcgtttatagactaatatttaaaaatgcaaattttttaatcaaaactaatgaatatgcattatattattattcataattatcttccttcctttttgaattaangaagcctantacagtaaaagttatttcatctaacttattatnaatttaacccattatattnaatatgagtgctagggatttttatgtatat

SEQ ID NO: 10126 - DNA, 1000 bp, Diabrotica virgifera
  misc_feature (543)..(706): n is a, c, g, or t
  misc_feature (779)..(779): n is a, c, g, or t
  misc_feature (813)..(813): n is a, c, g, or t
  misc_feature (840)..(840): n is a, c, g, or t
  misc_feature (896)..(896): n is a, c, g, or t
  misc_feature (910)..(912): n is a, c, g, or t
  misc_feature (920)..(920): n is a, c, g, or t
agattttgtaaaggtctttataattacaatttaaaaataaaatgaataaaaaaaccttggctgacaaaatttcatcacttttaactaccactcctgatgaattagacccggaagataattacgaggatgataccacggcgaaattaaatacagaatatcctcaagaacatggagaagaaactaatcaagggagcaagtttagaaaagacaacattgatctattagctgacgttgatgaaagatatgccggcaaaaaaggaagcagaaggcatttaaatcctgataatgattctagcgaattttctgaatctgataatgatgtagaaggtaataattatttttcctacatatttaacctgcttgctgccaaggggatatttaagtttcatcctcacataccacggctatttaaattgtcattatatgtagtgtgatccctggcttacgggtgaaacactgctctatgggaaaaatcgatgtggctcatatatgagtagcgaatgtgttaaagtcaaaattaaaacaaatttaatgtggactgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaacccagaattagaagatacatccaatttcgaaactttaaaaactacagatgtttcaactcaagctaaaanaggattatgtgtaaaaaatcagatgcatatttgngagagtcttcttgaaatgagaattcanggttcaaagtgtttattaactgctaacaaatgcccaactatgaaaatataaggagnataagaaagatcannngacagatntagcactactggtgagaaaacaaaaacactgtatctactttacttgacaaatttttatggttacagggatctttatgtgg

SEQ ID NO: 10127 - DNA, 731 bp, Diabrotica virgifera
cccacgcgtccggccagtaaacagacgataacaaatactctaccatattcttttgagaaaagatttaaaagagtatcacgataagcctctcgctgataccgatgactttatcaatgatatcctcgctgcaggtatttccgccgctagtgcaaatacatgcgaacgtccaatcgagcgtgtgaaggtgcttttgctagcacaacacatttccgaggatatcggtgacgatcagaggtacaagggcatggtacactgcttcgaacaaatcccagaggaagaggacggtcttgcatactgcggtgacaacaccggtaacgtcctccgctatttcccaaccctcgcccttaactacgcctacaaagacaaatactagcagatcttcttgagcgaaacacactacaggacacaattctgacgtaacttcttatgtaactgggcctccggaggtgccgccgtatgtacctccctctgctttgaatacccactagatatcgccagaaccaacgtggccgccgacgtcggtgaaggtgacgtcgaaggtgagttctctggcttgggcaactgcttagtcgatgacttcttggctgacgtatagcgaggattatatggagcattaggaggaacaatactcggcatcgttatctaccgcgccgcttactacactgtctacgatactgtcgacgatattatgaccgatcctcataacactcctcgtgtaattgcatggaccg

SEQ ID NO: 10128 - DNA, 831 bp, Diabrotica virgifera
  misc_feature (4)..(678): n is a, c, g, or t
  misc_feature (685)..(685): n is a, c, g, or t
  misc_feature (694)..(733): n is a, c, g, or t
  misc_feature (755)..(755): n is a, c, g, or t
  misc_feature (768)..(768): n is a, c, g, or t
  misc_feature (788)..(788): n is a, c, g, or t
cgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatanatttaactnnnnnnnnnnnnnnnnnnnnnnnnnnnnnnnnnnnnnnnnaattttttgattataagaatanattaccttagggnatacagcgtaatttattggnagagtcaatcgatataaagattgcgactcgatgttggattaaa

SEQ ID NO: 10129 - DNA, 400 bp, Diabrotica virgifera
  misc_feature (6)..(79): n is a, c, g, or t
  misc_feature (257)..(293): n is a, c, g, or t
  misc_feature (300)..(394): n is a, c, g, or t
gtgatnnnnnnnnnnnnnnnnnnnnnnnnnnnnnnnnnnnnnnnnnnnnnnnnnnnnnnnnnnnnnnnnnnnnnnnnnngaataaattaccttagggatacagcgtattttattggagagttcaatcgatataaagatgccgactcgatggtggataaagtttataattgtggagcagctaaatttattagtctggtcgacttttaaattttacctgatctgaagttaaacgggggggggacccgggtgggcttctnnnnnnnnnnnnnnnnnnnnnnnnnnnnnnnnnnnnnggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggg

SEQ ID NO: 10130 - DNA, 949 bp, Diabrotica virgifera
  misc_feature (766)..(766): n is a, c, g, or t
agtgcggaaagtttatggcatatagactatttaaaatattgacattgacatttctatgttccctgtatactttgattttataataaaagacagtcactgtgtgacagttctgtcactgtgttcgtcactcttgaaaataagtttcgttgacgtttaaatttcaaaaaaagccttatttttaactgcgaatatcccttcccctttcattcgacgtctcatacgtcacttgatgagaacctaaaataagatttgacagaccgaaaagaataggcgtgggcctttgtgacgtcattgagcgtcgttctcattggcggacgtggcttgtggagggtggaggttttggtgggcgagtgacgtcatggctgtctatctcaaccgactcatactttgctgactcctactttctccaacaaacacttcaaatctggacccatcactccattgtattgcatcacatcgtgaatgtatacaatctttatgttcttttcgccattttaacgtattttctcttgttgtaatattaaagatggcttttactctgtgtagactgacgttaacagaccttttttagtctcatatgtctgaatgaacagttttattgtcaacaattattttggatagtgtatataaatattaaaggacatagtaagtagtattgtaaatatatataagtataaaaattcctgatcatgcaaatcggtgtatagttgtcggaaatttatagcgtttgtcgtattgatgataatttaatttaacaatgaacganattcttttcctacgatatatacgacatgtaaaggaaaggtctgtgtaattttagtagttcaaaaaagtctaggacaaagactttacgcgactatatttcttttcgcttggttcactcatcattcacttttacctagttttgtataagatggattattaaacgacaatgtccagtcatcatttc

SEQ ID NO: 10131 - DNA, 174 bp, Diabrotica virgifera
  misc_feature (2)..(44): n is a, c, g, or t
  misc_feature (52)..(164): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgt

SEQ ID NO: 10132 - DNA, 529 bp, Diabrotica virgifera
gggaatgcaacaaaattctccctttaaattttcatgagcaggtacaggaggtttggtgagatcagtctcctctgtagtataatatatctatttccggttctaaaggtgaggataggtctttttcatcattatatgattgattaattaaattctaaatttgtattgcgtcatcgttattattgcgattatctatgatgtgtgtgtattggtaaatcggagatggattcattgttattttggattttaagtctaactactaaatcaccaatgaaattataaagaagactaaataaagaaaaaattgctctatatttagtacataattaatagcttagaatatttgtttatgatttagatttagaggatataagtgaagaagttcatcaaaagtattacaagtaaagaatttatgggggcacaaattctgagtacatgaaatgctctggttatatttactaatatatatctccatatatagtcattacaattggatatggaatgtagattatcgtagcaataaagatgatat

SEQ ID NO: 10133 - DNA, 336 bp, Diabrotica virgifera
  misc_feature (32)..(53): n is a, c, g, or t
agttgaatggtggataggtgtgaaaagtattnnnnnnnnnnnnnnnnnnnnnncttgatattattttccgctatagttgtatgtaatgcccaaggtccaactttagtgttactcgacaatcaagttattaaggaaacgcattcaatattcttcagatcattacaagaaagaggctacactctcacctttaaaatagctgatgattcctccttactcttatcaaagtatggagaatacttgtacaagaaagaggctacactctcacctttaaaatagctgatgattcctccttactcttatcaaagtatggagaatacttgtacaagaattctccga

SEQ ID NO: 10134 - DNA, 529 bp, Diabrotica virgifera
cccattttgattgattgaattgttctgaatcttggtggattgagctcggatatctcttgaataaactccctttgatgtctatctaattaattcagaagaatgctcagagtgactcacggcgacgcttatgaagacaagaggatctcgactatggtgtttgttgttgtacaagagatcaatgtaaaggccgaggatgatgacgcaatcgttgaacaagaaatccttatgatgagagactgtcggcctcccaacattagatcgaaattatggagttattcgagaaaggataaaatgaaggataagtctcgaaattgagccggtcattctccatggggaatctaccaagattgtgggtattttaagtgaagatcaaccatggaacatgcgctttgaaacatgactacgattaccttgccgtcgtaacctgagattcatgcatctatacataaatgctgccaagccttcttctgactggatgctatgatgtcttcgtgaacgacatcaccatgaccgctcgccctcctgacac

SEQ ID NO: 10135 - DNA, 975 bp, Diabrotica virgifera
  misc_feature (571)..(598): n is a, c, g, or t
  misc_feature (803)..(803): n is a, c, g, or t
  misc_feature (841)..(841): n is a, c, g, or t
  misc_feature (846)..(846): n is a, c, g, or t
  misc_feature (848)..(849): n is a, c, g, or t
  misc_feature (856)..(856): n is a, c, g, or t
  misc_feature (876)..(876): n is a, c, g, or t
  misc_feature (921)..(921): n is a, c, g, or t
  misc_feature (943)..(943): n is a, c, g, or t
ggggatagctgctgatggatggactgtccgtcttagcctaccgatttttatttctccgcgatctgctatttatagtacatacatgatttatatctgttttagaaatagtttatcatatgtgtcttatacattgttaatttgaatttttgacctaagtttctctctgctcttcgaaatcaaaaccattattttggttttctcttcttttattatgagatctagaagcgtagtattcagtaatttgcgttgatatattaaatacagttaaaattggaaaaactcgcacaggcgcaacgaacaattattttgttctgttctgtctaacaaatgcttttttcaatttttttacaagaaaactgcttaaaaccaactttatataggtttttctctagtatgtgttctcaattgtattgtcaaacaagatttatagctcctctattctctattgtataacacggcttccctcacagtcttttcagtcagtggtatgttgataagaagatatgccagaaagtcattaagaaaatttttcaaaaaattgtctttgcaattccaaaaattttgggatctnnnnnnnnnnnnnnnnnnnnnnnnnnnngattgtagatctaggtattaaaatattggaaagttaaaaaaatacatttatttgttacaatggatctttcagaaagtaaaaaagcacaaataaaaaaaacgcttccacatttttgctcatgtcctaaagcaacatatttgtgtaatgtgcgtgcttccgtcaatccaaaagtattttagctgaatataaaaaaacgcacaattanagcgaaataagtttacttgagtccacgtgtggtagatnaattnanngtgtgtnacctaaatttatatacattntgtaatcatacactggttttcaggtttatagggctgtgatctggngaatattttcttcctgacgttncttatactacagcaggtattaacagtagctga

SEQ ID NO: 10136 - DNA, 946 bp, Diabrotica virgifera
  misc_feature (835)..(835): n is a, c, g, or t
gataaacaacagattgacgaacgattgatcgacgattgacgttgattccgtcatatcgttttcgttagtttgttgccggtttatagaggaaaaatattatattgtagaagtagaatagtagttaatacaaacctgaaagaatattagattataaggatggccgacaaatttgaagagttatatcaaaagtataatcttttatccagcgctaaggaaaacattacagagctttctgatgaatacctggaatgtatagaacatgccaaaggtacagacaaggaaaagaaattagcggcacaaattattgcccaatatttcaaacattttccacaacataatgaaaaagctttaagtgccgtctttgatctttgtgaagatggtgacacatcgatacgaataagtgccattatgttcctgccaatgttatgtaaacattctaaagaaattgctacagtggtagctgatattttagctcaactgatgatcctgttagatcaacaacaagaatttaatgttacttgcaattctctggatcaggtattcaaagagtacccattacaaacattaaaagccttgtttgctcagatatatgcagccgaaccaactactagggaaaatgctgtcaaatacatatacaaaaagatgatcaaattagatgataaagttacagctatatgtactgacttacttatagaggaagggaagaagatactacaggtgtctacagtaacagagtttttaataataattcctttctttatgaacacaaaatattcaaaaacagcaattggccaacaggaattggctaatttaatagcacatagagcagacatanaccaagagtttgatagcaaagatagtttgttttgtgatagacttattatctgcactgaccatgtcttgcctatttttcaatgcacagttgaatcgacagagtatgtaaaat

SEQ ID NO: 10137 - DNA, 633 bp, Diabrotica virgifera
  misc_feature (176)..(192): n is a, c, g, or t
catgtactagtacttatactgaacttggaggagaaggtaaacccaataattttcttactgcatcgccatattttgtaacagtgtaatcattttctccttcattcataagtttgtccaagatcctttcatccagcatcagtccccctcccagtccgtcaaggctatacaaaaaaagnnnnnnnnnnnnnnnnntatgcaaatgctgaactaatcaaaatacctaattttctccacttaacacctccagtaatagaaagacagtgaaaagcattgaagcagatttgtacaccttgggcaagagccttggatacagatgagaaatgcgaaaaacattttccttttgagctgacgataagtgactattgtttctcttctccgtctataaaaaaaccgttggctataatattaacaatgaggtttaaattgaaaactttgatcttaaatcagagagagaatggatgatattataaggataattggatttatgtatgatgaaatctatgggacggatgacaggtattcactgacatttggttcacttggaatgaagaattgtgattatgcataggaataggttacgcctgtccatgattaatttggatggacgcggaattttgaccgggataagatagc

SEQ ID NO: 10138 - DNA, 119 bp, Diabrotica virgifera
  misc_feature (48)..(67): n is a, c, g, or t
  misc_feature (102)..(102): n is a, c, g, or t
cctccccaccctcgttcgatactaccacattagtgattattgctcccnnnnnnnnnnnnnnnnnnnnggatcatgaagactttcattgtactatctttcctntgcgtcgccgctttggc

SEQ ID NO: 10139 - DNA, 173 bp, Diabrotica virgifera
  misc_feature (2)..(44): n is a, c, g, or t
  misc_feature (52)..(164): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgt

SEQ ID NO: 10140 - DNA, 888 bp, Diabrotica virgifera
  misc_feature (365)..(384): n is a, c, g, or t
  misc_feature (446)..(473): n is a, c, g, or t
  misc_feature (840)..(840): n is a, c, g, or t
  misc_feature (849)..(849): n is a, c, g, or t
ataatatccaaattattttgtataaagctataaatttaaacatcgatgaaagaggagtcgttgtggtaataaataaaacccaatagattttctaaatttatttgtcggtttttgcttgacgatatgacctttaaaagtaatattcccttggaagcgggaaataattattgttcgatgttgttgtaaaacctacgctttgattaacttctaatccagaaaatttcatcgtcgttgtaaattgcaacttgaaggtttaatatatcgcccttttccttctgtttgtatatatttataaggtcgtgtatagttaataaataggtatatttaagttctacaaaaacctgtacaaatatttcgagtataannnnnnnnnnnnnnnnnnnncgagaacttaaacatttatatttattgccccctgttaaatgaaatagaacttgtagcgaagnnnnnnnnnnnnnnnnnnnnnnnnnnnncagttgttaatcttgtagtttgttacctttgctcttacatgtaaaagcagtattttataatttttaagtaagttgtagtcataattaaagtaaacagtagttatataatttaaatcatgattaattataaataatagaatttaacaaatacaaaatgccgccataattagctttagaacaatatataatagtgaacattaagcttaaccactacaataacatttttaatataatcacttgaatgaaaattaattactataatcttttttagtgttctacttttagttagacctctatcatttcatcaaagccaaattcttttccaggttttgtcgtttgtattaccatgtaacctcactttctgttntatagaccnagtgtcagttttctgaccatactttatacctcttataca

SEQ ID NO: 10141 - DNA, 760 bp, Diabrotica virgifera
  misc_feature (20)..(44): n is a, c, g, or t
  misc_feature (52)..(162): n is a, c, g, or t
  misc_feature (176)..(286): n is a, c, g, or t
  misc_feature (288)..(353): n is a, c, g, or t
  misc_feature (377)..(537): n is a, c, g, or t
  misc_feature (562)..(582): n is a, c, g, or t
  misc_feature (605)..(629): n is a, c, g, or t
  misc_feature (631)..(659): n is a, c, g, or t
  misc_feature (668)..(704): n is a, c, g, or t
  misc_feature (706)..(752): n is a, c, g, or t
cgtgagagaatcttttcttnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncttttaaaatacgttattatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttattaaaaacacgtcttttggnnnnnnnnnnnnnnnnnnnnncgcccaccgattaatttgaagannnnnnnnnnnnnnnnnnnnnnnnntnnnnnnnnnnnnnnnnnnnnnnnnnnnnnctggaatgnnnnnnnnnnnnnnnnnnnnnnnnnnnnnnnnnnnnncnnnnnnnnnnnnnnnnnnnnnnnnnnnnnnnnnnnnnnnnnnnnnnnaagacgag

SEQ ID NO: 10142 - DNA, 913 bp, Diabrotica virgifera
  misc_feature (54)..(108): n is a, c, g, or t
  misc_feature (169)..(187): n is a, c, g, or t
  misc_feature (266)..(287): n is a, c, g, or t
  misc_feature (629)..(662): n is a, c, g, or t
  misc_feature (843)..(845): n is a, c, g, or t
gtactttctttgagttctttcgttttgtccgctagcgcgaaaacaacacccatnnnnnnnnnnnnnnnnnnnnnnnnnnnnnnnnnnnnnnnnnnnnnnnnnnnnnnncgcattagaccgcgcagcacacaatgaacaactcgccaaagatgccaacctccgcgctgannnnnnnnnnnnnnnnnnncgctccctacaaaagaagatccaagccattgaaaacgatcttgaccaaactcaggaacaactcacacaagtcaatggcnnnnnnnnnnnnnnnnnnnnnnccctccaaaacgctgaatccgaagttgccgccctcaaccgtcgtatccaattgttagaagaagacttggaacgttcagaagaacgtttagccactgccaccgccaaattggctgaagcctcacaggcagccgatgaaagcgaaaggcagcgcaaagtactcgagaatcgttccctggccgatgaggaacgtatggacgccctcgagaaccaacttaaagaggcccgtttcctagctgaagaagccgacaaaaaatacgatgaggtagcccgtaaattggccatggttgaagctgacttggaacgtgctgaagaacgtgccgaagccggtgaatccaaaattnnnnnnnnnnnnnnnnnnnnnnnnnnnnnnnnnnttaagaacctcaccacccgtctaaaggaggctgaagcaagagctgaattcgcagaacgttcagtacagaaactccagaaggaggtcgacagactagaagacgaattggtagccgagaaggagcgttacaaagaaattggagacgatttggacaccgctttcttcgagcttatcctttattnnntcttatgtgttttaataaaccctgtattcgaggtatagtcttgcacgccttggtcagcgactcaaatt

SEQ ID NO: 10143 - DNA, 271 bp, Diabrotica virgifera
  misc_feature (2)..(72): n is a, c, g, or t
  misc_feature (79)..(116): n is a, c, g, or t
  misc_feature (136)..(149): n is a, c, g, or t
  misc_feature (152)..(174): n is a, c, g, or t
  misc_feature (182)..(204): n is a, c, g, or t
  misc_feature (234)..(265): n is a, c, g, or t
gnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10144 - DNA, 221 bp, Diabrotica virgifera
  misc_feature (111)..(111): n is a, c, g, or t
  misc_feature (189)..(210): n is a, c, g, or t
tttgatcccatttttttgattatagaataaataccttagggatacagcgtattttattgagagttcaatcgataataagatgcgactcgatggtggataaagtttatattntgtacagctatatattagtctgtcgactttaaattttaatgatctgagttaaccggggggagccagttggttctatcnnnnnnnnnnnnnnnnnnnnnncccaaaggacc

SEQ ID NO: 10145 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10146 - DNA, 779 bp, Diabrotica virgifera
  misc_feature (2)..(14): n is a, c, g, or t
  misc_feature (16)..(29): n is a, c, g, or t
  misc_feature (87)..(105): n is a, c, g, or t
  misc_feature (110)..(128): n is a, c, g, or t
  misc_feature (260)..(277): n is a, c, g, or t
  misc_feature (342)..(360): n is a, c, g, or t
  misc_feature (576)..(594): n is a, c, g, or t
  misc_feature (775)..(776): n is a, c, g, or t
  misc_feature (778)..(778): n is a, c, g, or t
gnnnnnnnnnnnnngnnnnnnnnnnnnnnggaacattatctgaataattattgattatagagagttagagcaaaaatatgtaaaccnnnnnnnnnnnnnnnnnnntatgnnnnnnnnnnnnnnnnnnntgtgacatatttaagaaatcaagtatcaataatcaaattggtcatccctacacaatgatttggtgtgttaatatacttgatacaatcagttttcaatttttttgaacatggcattaaaatgtgtaaatatgnnnnnnnnnnnnnnnnnngaaaggttgacctacaaaattggtaaatttttgttttaactcttttaattctaaagaaagcatgnnnnnnnnnnnnnnnnnnngagtctgtcatttattccatgacttaaaccaaaccttcattattagagtatacccctaatgacaatatattgtacatatttatagtcaattacttttgatataaaatatgttttctgatagtgatgagattaagttcatattctgttaattacacacttgacctaggattaattagattatggtttgccgtgttcttttggttgatgtaaataggnnnnnnnnnnnnnnnnnnncaaattaatacttgattttcccaaaattgtaagtgttagtatagaaatataatcatggacttaaagaaatgttatccatagctatcaacctctgaacatgacctaaagattacaaaacgtttgacgaattatgatgtacatattctgatgttatttgggaaataaattatgaccaacaccnnana

SEQ ID NO: 10147 - DNA, 351 bp, Diabrotica virgifera
  misc_feature (2)..(32): n is a, c, g, or t
  misc_feature (34)..(67): n is a, c, g, or t
  misc_feature (69)..(93): n is a, c, g, or t
  misc_feature (96)..(256): n is a, c, g, or t
  misc_feature (264)..(282): n is a, c, g, or t
  misc_feature (289)..(307): n is a, c, g, or t
  misc_feature (319)..(346): n is a, c, g, or t
annnnnnnnnnnnnnnnnnnnnnnnnnnnnnnannnnnnnnnnnnnnnnnnnnnnnnnnnnnnnnnnannnnnnnnnnnnnnnnnnnnnnnnnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggggnnnnnnnnnnnnnnnnnnncttttcnnnnnnnnnnnnnnnnnnngtaattttttgnnnnnnnnnnnnnnnnnnnnnnnnnnnnacctt

SEQ ID NO: 10148 - DNA, 197 bp, Diabrotica virgifera
  misc_feature (7)..(44): n is a, c, g, or t
  misc_feature (79)..(101): n is a, c, g, or t
  misc_feature (115)..(115): n is a, c, g, or t
  misc_feature (164)..(190): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntgttcgacttttanattttacatgatctgagtttaaaccggtgtgagcccaggtggtttctannnnnnnnnnnnnnnnnnnnnnnnnnngaaagga

SEQ ID NO: 10149 - DNA, 371 bp, Diabrotica virgifera
  misc_feature (345)..(362): n is a, c, g, or t
acaccagaagctctgtatgtacgacgtcttaaactagcagctctgtttacttgaatatgttctataactagtctatctacatcaagtccactataatcagcattgctttcagcatttcttaagagttgtaaaagaaattctgctgattttttgggccaccttccttgagtagtaccaaactgtttagcttgagaacacctaccaactccaccattgaattatggttgactgaaggagaatctacaccagaagctcccaaaaagtcttcccagaagaaatcggctcttaataaaattaagaaaccaaatgcacctcaagctgtatcaaattaaacagtttgttatnnnnnnnnnnnnnnnnnnctgtattct

SEQ ID NO: 10150 - DNA, 85 bp, Diabrotica virgifera
  misc_feature (2)..(66): n is a, c, g, or t
  misc_feature (78)..(79): n is a, c, g, or t
  misc_feature (82)..(82): n is a, c, g, or t
tnnnnnnnnnnnnnnnnnnnnnnnnnnnnnnnnnnnnnnnnnnnnnnnnnnnnnnnnnnnnnnnnngctggatgaggnntgnatg

SEQ ID NO: 10151 - DNA, 254 bp, Diabrotica virgifera
  misc_feature (2)..(49): n is a, c, g, or t
  misc_feature (67)..(94): n is a, c, g, or t
  misc_feature (108)..(108): n is a, c, g, or t
  misc_feature (161)..(182): n is a, c, g, or t
  misc_feature (219)..(246): n is a, c, g, or t
gnnnnnnnnnnnnnnnnnnnnnnnnnnnnnnnnnnnnnnnnnnnnnnnntaacagcgtaatatttannnnnnnnnnnnnnnnnnnnnnnnnnnngcgaacctcgatgnttggattaagtttaataattggtgtacagtattatttattaagtctggtcgannnnnnnnnnnnnnnnnnnnnnagtttaaaccgtgggggagcccaggttggtttctatnnnnnnnnnnnnnnnnnnnnnnnnnnnngaaaaggg

SEQ ID NO: 10152 - DNA, 894 bp, Diabrotica virgifera
  misc_feature (81)..(98): n is a, c, g, or t
  misc_feature (576)..(596): n is a, c, g, or t
  misc_feature (760)..(760): n is a, c, g, or t
  misc_feature (836)..(836): n is a, c, g, or t
gtcgtgtttctgccgcatatgtcattattcattattggtctgatgactcttttgtaaattctgcttttcatttcttttccnnnnnnnnnnnnnnnnnntattgtttcacttagaaaacctgcctttccttgatctattaacttgatcttccacttctggttcgagctttccgcagctagatagtatgatagtatgacagttttgtaaattctgccttttatttcttttgcgatattcttattttttcatattgtttcattcaggaaacctgcgcctttgcttgatctattcactcgatcttccacttctgattcgagctctccgtagctagatagataaactccattactagttctggtatctaaccctccagctctaattttcatcttataatttctagtttacttacaaaaatagcgtagttgtgtcgttttatattcttccatcgttgtctttactatatacatctcttctgcatgaacgaccattgcattcagtaattacttttatttgatatgtctccaacataaaattatattaatgaatttacacaggttcatgtccacacttctgacnnnnnnnnnnnnnnnnnnnnngtagcaaaagaagtaagatatagagaatacgttattaagtatggcttatggtgatgtaaaatttatgtttgacttatgaaaacagcatagtcgagatctcgcttgccttcctgaaggtagtgtcttgaatgcctcttctagatcacattttttcaattgcttanatttgacaattttcgtagcatttttaagtataaatcatacaattacaaatgttgttatattgttatattattctanaataagcaagttagtcggttcgctgaacacgggcacaactgggtagtgattttagtag

SEQ ID NO: 10153 - DNA, 674 bp, Diabrotica virgifera
gcccgcttacgagatatacaagtccctggcactgtgatctaaactatatctaacaaacatagcctattggacgatacttaaaattgcatttctagagttcataaagagaactgataactctcgaatagaaatgtcaatactacactcctatatcaagctgtgaggaattgaataattactatgatcttgtctgaacatctcttaagttgcttatgagctcatcatctatccaaatgtctgtgccaaatgccggccgaccttctgtaaaaccctatcttttactatgctcccggtgcatctccataagcctctcttactgggatccatcgactcatcgaagaagacttgccaagattcgaagaatgattgtgcacaggtaccgatctcctgtgttgaaattcccatcctgacggtgaccgctcgcgtctgtgacaagtattgaaactcctactccaaccatatgagtaccatatggatcagctctcccaccatactggaccaacgccgtctcttgactgaccactcttaccaccaatctgatgctttatcacgcatacttgccttcttgtgaatacgaaccttaagtatgtgaagaccgtgtcattagaggagcatacaaaatcatagcaactcgaagaaaagctgtgaccaccaccgcgctctctcacatctct

SEQ ID NO: 10154 - DNA, 822 bp, Diabrotica virgifera
  misc_feature (82)..(100): n is a, c, g, or t
  misc_feature (103)..(124): n is a, c, g, or t
  misc_feature (633)..(653): n is a, c, g, or t
  misc_feature (658)..(820): n is a, c, g, or t
gaaaaacaaaaattatgaactgaaatattattgtaacctgattactgaacgaatacacataattaatagtaaaagtaattannnnnnnnnnnnnnnnnnnatnnnnnnnnnnnnnnnnnnnnnncgtgcggctggacgactgcttacgcaagaggctattgagaaaaagaagaagtttatgtgaaatatagaagttacctctgtttttattggctgtgggtttcgtcggtagcgctctctcgcgatttgaaacttgtacttttctgataaaattgttcaaattcaatacacaaaactgccactaacagcgctggcgagaaaactgtcaaatcccctctacttatcggttcacagcgaatagctgtaacaaaaatcctaatcgagagtatctgtcacctgatttaaatatctcaaaactttttgatatgtatttgcaaagtgaagaaccaaaagtgaaggtatccaaattcgtattttcgaaaatatttaatgaagattttaatcttcattttcgttatcctcttactgacacttgcaaacgatgtgacgcttataacatgaaaataaaaagctgtgtaggtgtagaaaaaagcagaatggaaacagaaaaagagttgactacggaaggcagannnnnnnnnnnnnnnnnnnnntgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 10155 - DNA, 453 bp, Diabrotica virgifera
  misc_feature (41)..(60): n is a, c, g, or t
  misc_feature (125)..(173): n is a, c, g, or t
  misc_feature (313)..(333): n is a, c, g, or t
aattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 10156 - DNA, 76 bp, Diabrotica virgifera
  misc_feature (2)..(66): n is a, c, g, or t
gnnnnnnnnnnnnnnnnnnnnnnnnnnnnnnnnnnnnnnnnnnnnnnnnnnnnnnnnnnnnnnnnngggtggatga

SEQ ID NO: 10157 - DNA, 879 bp, Diabrotica virgifera
  misc_feature (760)..(760): n is a, c, g, or t
  misc_feature (781)..(802): n is a, c, g, or t
  misc_feature (846)..(848): n is a, c, g, or t
  misc_feature (869)..(869): n is a, c, g, or t
atattaagtgaggttagaaattgtcggcgacaatttgtcaactgtacccgcgaacgcacctattgggtaaaatatgtgagttttgacttttctctacaactgacgaactgactgacaaaccaatttcagtcatttgttgatgaactacccgcagttgcttttctctttatgagtcgtattaactcaaaaaatggagattatcaacatcaaattttacttcataatttttgatgggctatggccgttgtgtttttgctatattttaataaatcgttatttcttgtatgtcgagtttgagtatttcataaaacggcttcgaataaaagatttcgtatttcgtatgttgtatgttgagtttgagtatttcataaaatggctttaaataaaagagaacgttgcattaaatgggaaagtgaagaaaaagtaaacaaattgatttattttacttataaatgccatgtaaatatgttaatttcagcatattttgaagaatattgtgagagattttctacatattatagaaaataaagaccttatttttcttgtagagtggaggataacactcctcctagcttgttcacaataagtaaatcacctactaagttttctaaaaaccttacatcatctttaggaaacccgatttttattctgcattctttgaaaaggaatttatgctttctttgaaagttttcctttttcgtgtattttccatcatgttaattaaattatcaacttcctcgttagccgcaatacctcttanacagattttttacctactctnnnnnnnnnnnnnnnnnnnnnntctgatgactttgacagtcataaaataggttataccagacttannnacagggtgtggatcggtatanacttggacta

SEQ ID NO: 10158 - DNA, 882 bp, Diabrotica virgifera
gtctaagcgcgcactttatataaaacttttacataatatgcctcccagctagtaacaataataaacaatttaacaataattcatatttgtcttacaatacatattagtttaagaaatataatgcgctaattcaatagtttttctgtaaaactgtgcgtctctctcgaaatttccgagaatttcaaagaactttccgcgattttttacaattttagatcatgtgtgagtgtaggtttattattttttgtgcgattttggtgtcgtatgtgacttgtttcaatatcgaacatcggaattatgcagttttcgaacctgtggataataatagatctatgtttgggttcaccgttgcggttcacaaagaccgaggaaacaggggatggattttagtgggagcgccggaagggcaatcaaggtatcaaaatcccgaaatagttaagagaggtgggacagtttacaaatgtcgatcggatgctgacagtgtttgtgatcaaattccatttgacagaacaaacaatgttggtttcggagatacagcaattgacgagaaaagctggcagtggtttggtgcaacactaagttcatccggacgcatggacggtccagttgtggcttgcgctccacgatacatctggtttaccaaagacttaaatagaagagatccagttgggacgtgttttgtttctaatggagctttcgataattttgaagaatattctccttgtagaacaatgaactggggataccatagacaaggatttgtcaagctggtttaggtgctggtgtgaagggggaaggagatcgtctctacgttgagtttcctggaagttattattggcagggccaatgtattccatagatgcccatgctcattttactata

SEQ ID NO: 10159 - DNA, 218 bp, Diabrotica virgifera; identical to SEQ ID NO: 7300
  misc_feature (6)..(28): n is a, c, g, or t

SEQ ID NO: 10160 - DNA, 754 bp, Diabrotica virgifera
gttggagtgattaaagaatggctacgaataattattttggatttactcatggtggaacgcagtatggagcaaccactggagcctaccaagcgggtcaggctggttacgctgtagctactcctgcgactgcagctgctgcagctacgtacggtacccaaagacccaccagctatgacacagcctatcaggctgcagctgcagccagccaaggcacttatgctgctgtaggaaccactgcaactcccgcctatgagtatggatatggtcaaacagctgcaactggttacacaagtagtgcagctgcaaaacctgcttcctatgccactacttatacacagagaactacctcacagcaggcacaacaagcagcagcatcagctgctgtcgctgctgcggccgtggtcaagcagcctgcacagtacacggccacataccagcccactgcaacagcttaccagactacctacccccaaccagctgctgcacagactacaatagctgctcaacctacaacacaagccaaacagactaattctaccacaacatattcaggatacgatgctgccctgtattcagcagctaccatgtatgtagcccaacagtcaggcactgcccaacataaagctgtcggctggcaaaactacaagaaaccaggtatcggtgcgaaaactgcaagaccaaaggcacccccaaaacctcaacagttgcactaattgtgatgtttgtaaaatcacaatagcggaactgcagagat

SEQ ID NO: 10161 - DNA, 846 bp, Diabrotica virgifera
  misc_feature (2)..(47): n is a, c, g, or t
  misc_feature (53)..(75): n is a, c, g, or t
  misc_feature (266)..(339): n is a, c, g, or t
  misc_feature (344)..(409): n is a, c, g, or t
  misc_feature (427)..(445): n is a, c, g, or t
  misc_feature (454)..(468): n is a, c, g, or t
  misc_feature (470)..(486): n is a, c, g, or t
  misc_feature (489)..(508): n is a, c, g, or t
  misc_feature (523)..(543): n is a, c, g, or t
  misc_feature (681)..(730): n is a, c, g, or t
  misc_feature (737)..(818): n is a, c, g, or t
  misc_feature (826)..(826): n is a, c, g, or t
  misc_feature (832)..(844): n is a, c, g, or t
cnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttactannnnnnnnnnnnnnnnnnnnnnnnnnnnnnnnnnnnnnnnnnnnnnnnnnnnnnnnnnnnnnnnnnnnnnnnnnnnnnnnnntattttanaatatnnnnnnnnnnnnncc

SEQ ID NO: 10162 - DNA, 763 bp, Diabrotica virgifera
  misc_feature (200)..(221): n is a, c, g, or t
caagagtcaacaaatacatatttaacaacaaataaaaacaaaaactgcctttatctaaatacatatttgttcaccaataatgatgtttcacttataacaaaatatagacaatcaaatggacaaccaaacaacatacattgtatctggtttatacaaaaacctatttaatgttgttatgaacctatttaatatcaccttannnnnnnnnnnnnnnnnnnnnncctacagtgcctctaatatttggccagtagggactgtatagcctacggcaaaagaaatttcacagtacctattcgttacttatggaattttttcttgttctccgtttacacattttggtggttttagatctcaaaatttattcaaatacagttaaaaacgagactgccatttgtccaaaaaactaatttttatagctcaactccgaaaactgtcggtaacatgacttattttataaataggtagtcgctgatcgaatcttcaatattacgatactaaaaataatataccttcgaatacggaatcttgtgtatgaaaataaaactgattcttttaatcaattgtgatagagtaaaccttcacaaataaacgtcaatactcaatgaaatatttgcctttaattgtatcactaatctttgattcatataatacctataaaaatgccaaattatgtttttaccatgttacgtacagggtggagtttttatctctgtgagacataagttctaaaatagtttaaaatattgtccacctacctctttat

SEQ ID NO: 10163 - DNA, 954 bp, Diabrotica virgifera
gtaccatcactggaaatccagctcctcatattacatggtacaaaggtgctagagaaattacaagtggttcaaggtatcacatttacagtgaaggagaagtacatcatcttgttatacatgacgtatttggtgaagatgctgatgaatatgtctgtagagcatccaataaagctggtgtaaaatctacacgtgcagaattgttaattatgactgctccaaaattgaacattcctccacgcttccgtgactcggcctactttgacaaaggtgaaaatgttgttattaagattccattcactggtttcccaagaccgaagataacatgggtcagagaaggcgaagtaattgaatcaggaggacattatcacgtcgaagttaaagacagacatgccattcttaccattagagatgcaagtaaattagatagtggaccttacaaataacagcagagaacgaacttggacaagatactgctattattaagattcaaatagctgatcgtccagatccaccacgtttccctgcagctgataatattggtcacgacaatttggcactcacctggaaagcacctgtatgggacggtggtagcaatatcacaaactatcttgtagaaagacgtgaacatccattatctacatggataagagtaggaaacacaagactgaccacaatagcagtaaatggactaacacctggacatcaatacgaattcagagtatatgctgagaacatatatggtcgttccgatgcttcagacctcagcagtattataaccatgaaagataccattaaaaagaaggttgaaaagaggaagtatgaagttgacgaaaatggaaagaaaaacgtgaatccatacagaagcagttacggattatgataaatacgtatttgacatttactctaaatttgtcccccaaccaggtgaaatcaagactaaatcagtatatgatg

SEQ ID NO: 10164 - DNA, 914 bp, Diabrotica virgifera
  misc_feature (802)..(802): n is a, c, g, or t
  misc_feature (868)..(868): n is a, c, g, or t
  misc_feature (876)..(876): n is a, c, g, or t
  misc_feature (887)..(887): n is a, c, g, or t
cggacgcgtggggttgatatgcatcgttaggacatagataacgatggcactttgggctaaagcacaacagctcccaccagggagtctgcaacagatatatggtgatatatttcctattgaagttaggcactacctagctcagtatattgaagaaaattctggtgtgatattgatccacaaccagataatccccaacatgaacaatacattgcaagtttgatcaactctctgatcaaagagatagaaaacaaagcatcagttgtaactgattcagaatatttccttaccaaactaaaacttgctgaagctgcaaaattattcagagaaagatacagctcgtgtcccattcaactttttacccacatccgaaattgtctagcagctgagatgagactggttcaagctgcgggcgtggatagtcttataggtttacccaatctgatgatatcgaacagtggcgcagaagtcttacaaaaagtcaacgtactaaggagtaggacgcagagcacagcagaagatttaaggaaaatggaacaagaattggaagcttttgctctacagtaccatgaatgtcaaaaaattacagcacacttgcaacagatgactacgcaacctaatgctcagatgcctaccaataatggctacgaaactccaaaaacaaaaagaattactagaagcaaatctcaaccaaaagctagccgctttgttgcagttgaggttagcgttaggtcataaattaaaagaaacttttcaattactgggctcagctacaaacgcatggctgggacgaagaacttattanatgggaaacgagagcagcaattggctgggaatgggagcgcatttcaatagtactatattctatacnagaatggntgtgaaagttnggctgaaattatctggggctcatcgac

SEQ ID NO: 10165 - DNA, 625 bp, Diabrotica virgifera
  misc_feature (8)..(504): n is a, c, g, or t
  misc_feature (506)..(612): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggaggggg

SEQ ID NO: 10166 - DNA, 955 bp, Diabrotica virgifera
  misc_feature (510)..(525): n is a, c, g, or t
  misc_feature (565)..(583): n is a, c, g, or t
  misc_feature (788)..(788): n is a, c, g, or t
  misc_feature (896)..(896): n is a, c, g, or t
aaaaacaggtcgctggagctttctgctggtttatgttgtaaagttagttttattacaacaataaaaattgaaaaggcaatattacaaaatgaacagtacttacaacacattcactctcgactaaagcgtaacgcaaacagccttgtagcgtcctgttaatgctgagagagacaaaacggaaatggtaatgacacaggcacactatgcagattctaaaatagctaaattaaatgacactatttcacaatgaaggcaacgcctaaaggaataatcatcatcatcaatcagccatttgcatgcacagctggacataggaaaccttaatgaggaagctggaggcattcgaaatatgggtgtacagacatattctcaaaatatcctggacgactcacaccaccaacgtatagtccaggaaccaaagcttttcacctcgcaatttttacagaatggatcggtttgcttgagggtttgagaataagtggtggatagtccatggatcaaaatatatannnnnnnnnnnnnnnntttaccatgggggtggttgccaccccatctcgggtgtggnnnnnnnnnnnnnnnnnnngaccgcaaaagttgataaaaacatttattttaagcaaagaatgttacatttttttgataaaatggatagtttttgatttattcgttgtcgaggggtgttgtttttatatctgaagaatcaatgtttttcgatggtataatcatttacgattcactcaatttttgccgtagaacaaattttatcaaaccaagttcttgggaattanattacctacaattttatatttaacacattcgcggacacgctgtcattttatacacgtattcttatggagtaaatgacttcatatgcagtcatgactgcgaatgtgttnaacattttttcgtatctctgatgctaatctttctattctgaagaaaatggcatttttac

SEQ ID NO: 10167 - DNA, 572 bp, Diabrotica virgifera
  misc_feature (42)..(64): n is a, c, g, or t
  misc_feature (106)..(133): n is a, c, g, or t
  misc_feature (137)..(200): n is a, c, g, or t
  misc_feature (205)..(267): n is a, c, g, or t
  misc_feature (273)..(302): n is a, c, g, or t
  misc_feature (344)..(385): n is a, c, g, or t
  misc_feature (457)..(472): n is a, c, g, or t
  misc_feature (474)..(519): n is a, c, g, or t
tcccctcccccgcgccccgcctccttcctcatttttccatcnnnnnnnnnnnnnnnnnnnnnnnttacagaattttatttaacgctagttaattactactcgtgcnnnnnnnnnnnnnnnnnnnnnnnnnnnnttcnnnnnnnnnnnnnnnnnnnnnnnnnnnnnnnnnnnnnnnnnnnnnnnnnnnnnnnnnnnnnnnnctacnnnnnnnnnnnnnnnnnnnnnnnnnnnnnnnnnnnnnnnnnnnnnnnnnnnnnnnnnnnnnnngatgtnnnnnnnnnnnnnnnnnnnnnnnnnnnnnntcgatataaattatttctaattaattaaccatacacttccannnnnnnnnnnnnnnnnnnnnnnnnnnnnnnnnnnnnnnnnncgaccttataactaaaattttattacaattcaacttctataccaaaaataagattaaaaattctcctattcnnnnnnnnnnnnnnnncnnnnnnnnnnnnnnnnnnnnnnnnnnnnnnnnnnnnnnnnnnnnnncaatatacttttagattcttgttttactcatgacgtcattattataattaaaa

SEQ ID NO: 10168 - DNA, 51 bp, Diabrotica virgifera; identical to SEQ ID NO: 9123
  misc_feature (2)..(44): n is a, c, g, or t

SEQ ID NO: 10169 - DNA, 614 bp, Diabrotica virgifera
  misc_feature (202)..(223): n is a, c, g, or t
  misc_feature (488)..(505): n is a, c, g, or t
  misc_feature (509)..(580): n is a, c, g, or t
gtataatgtcatgtacactttttgaagatataaatatgtggtatattttatacagttttgattatctcactaactttgaagtagttcttatggtgcttgcgaccagttttaagagttaatttatgagttttagatagaaatgaatcagtgtcaaatgaaacttccgctttttatgtatttaaaagatatgaatcgacctatnnnnnnnnnnnnnnnnnnnnnngagtagattagttcaagttacattcttaaccatgagattatggtgttaaaaaatagatgtttattaggtaacatgattaagatttttatatgtatgtatatataaaatctgtctatgttggacaagaaaaagcttcaaaaagtgtacatgacattaaacaaaatgtttatcggtcgattttaagtttgtatttgttttaaccttgaataaatttaaatattgtttaaattattgttattttatttttggatcccaataatattgnnnnnnnnnnnnnnnnnngttnnnnnnnnnnnnnnnnnnnnnnnnnnnnnnnnnnnnnnnnnnnnnnnnnnnnnnnnnnnnnnnnnnnnnnnngaccagaatcaaaaggatccaagattaaaaacgg

SEQ ID NO: 10170 - DNA, 301 bp, Diabrotica virgifera
  misc_feature (7)..(102): n is a, c, g, or t
  misc_feature (109)..(146): n is a, c, g, or t
  misc_feature (166)..(179): n is a, c, g, or t
  misc_feature (182)..(204): n is a, c, g, or t
  misc_feature (212)..(234): n is a, c, g, or t
  misc_feature (264)..(295): n is a, c, g, or t
caccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10171 - DNA, 890 bp, Diabrotica virgifera
ctagttcagcattaagttcttcttcaattcgatccagctcctcttgcttcaaaacctgcaatgtttcttctacccaaggctcttttatttctgcgagaagcttatccacaaacactttaattttgtttatagtaaagattgatctgatttgtacgtttactattctatcgtcgaaaagagtcaatagtaatcctaaacattctctgtatatgaaaaaaaggactcctgtgaggtaccaatcgttagagttttcagctttggttccgtcataactaaatatgttttcgctgtagtgagatcttaaagaatttaaggtttcccctgcatacaaagaaatattatctgtcttaaaatcatctatgcttttattcaatgacaagatatcttggaaagtcttttcctccaagagactttcaagcttcttcagtatacactttaacatccacaacatgttagctgctttattcttatcttcaactttctttagacttgcgagatactctttttcttctccaggaagcactgaaggttcaatcaactcgtttatgccaaaaatcggtacgtaccgatacaaatatctggtgtctcgttgaaacatcttaaagtaggggattatttgtgctgatgtccatgtcattccaaagtgtttgactatgagaggtagaattatagcagctgttcttctaacagcaaagacgtgatctcctagaaggcttccatagaagtgtttaatattttctgcgaagtactctttcggagcaaacttaattatatgcataaatgtcaccaacaggccctttcttgttctccaatgtgattgagagtaaacgattaatgttcttataaccctcttgatagaagggagagattgatcaaagtctacatctgct

SEQ ID NO: 10172 - DNA, 770 bp, Diabrotica virgifera
  misc_feature (2)..(657): n is a, c, g, or t
  misc_feature (667)..(726): n is a, c, g, or t
  misc_feature (734)..(734): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgaagnnnnnnnnnnnnnnnnnnnnnnnnnnnnnnnnnnnnnnnnnnnnnnnnnnnnnnnnnnnnaagcttanatttttttaaagacgagaacccctatagagtttata

SEQ ID NO: 10173 - DNA, 487 bp, Diabrotica virgifera
  misc_feature (405)..(439): n is a, c, g, or t
gtacgcctggaggtacgggccgggatttccggggcccccccacgcgcccgctgccggtgagatcacagagaggagttattatagataatctggattattatattgagatgataggacttagcgacaaatgaattattatatacgtatatgcgagcttggtaaatagaatagttagaagaaaaaagctgagaattgatggcaaataatttctctacattttatgtcatgaaatgaaattaaaattttcaatatatcttaggttataatgaataagttgatttactttgtgaacgggatgataatactcattaaatgaacttctattattatgattaatgagtgaacaagaatgggctaaaaaatataaaatttatgaatatttggattttctagatatctgagatnnnnnnnnnnnnnnnnnnnnnnnnnnnnnnnnnnntttatgtaagctatgtaataatctgaggtgttttgataaatgattaat

SEQ ID NO: 10174 - DNA, 552 bp, Diabrotica virgifera
  misc_feature (5)..(42): n is a, c, g, or t
  misc_feature (89)..(137): n is a, c, g, or t
  misc_feature (162)..(198): n is a, c, g, or t
  misc_feature (211)..(230): n is a, c, g, or t
  misc_feature (242)..(293): n is a, c, g, or t
  misc_feature (422)..(441): n is a, c, g, or t
ggccnnnnnnnnnnnnnnnnnnnnnnnnnnnnnnnnnnnnnncccccgggggtacaccgggttttaaaagaaataagtgaaatttattnnnnnnnnnnnnnnnnnnnnnnnnnnnnnnnnnnnnnnnnnnnnnnnnntatcccaaggggggggcgtaaattnnnnnnnnnnnnnnnnnnnnnnnnnnnnnnnnnnnnngggaccccagggnnnnnnnnnnnnnnnnnnnngaaaatagggannnnnnnnnnnnnnnnnnnnnnnnnnnnnnnnnnnnnnnnnnnnnnnnnnnntttaaaaaagataaatttattaatgagggggataggagtattaaaattttgtatatggagcaaaaatatataggtcgggggggaggaatttaaacaacatgggggggaaaagcctgggggaaacatgannnnnnnnnnnnnnnnnnnngccccctctgcccactgaggaaaaagaaagaacgcgccatcttgaccgcgctcacgaagcataatcattagtatgggtattgagagctggactgaaggggtggtgaaaaaa

SEQ ID NO: 10175 - DNA, 981 bp, Diabrotica virgifera
  misc_feature (300)..(401): n is a, c, g, or t
  misc_feature (706)..(733): n is a, c, g, or t
  misc_feature (930)..(930): n is a, c, g, or t
  misc_feature (932)..(932): n is a, c, g, or t
  misc_feature (938)..(939): n is a, c, g, or t
ctaaaatccaaaatgccacaacaaaaaatggcggacgaaaacgataacgaaaaaatggacatagatcctcaaaaaaacacggaaaaaatgttttcgttaaaaaaatggaatgcagtggccatgtggagctgggatgttgaatgtgatacttgcgcgatatgcagagttcaggtgatggactcttgtttgaggtgtcaggctgagaacagaaaagattcctacggaaaacaagattgtgttgtcgtctggggagaatgcaaccattccttccattattgttgcatgtctttgtgggtaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttcgagcgccatcatcttatcactcacgttaggagccacaatggagaaagacctttcgtctgtgcagtgtctgattgtgcaaagtcattctatgataaacagaagctacgaagacatgagaggactgtacactgttttaaaatggaacgtagcttgtaaataatccaagtggcacaaatattgtattgcaaaaatgtgtcatattatgtaattctatctttttctgctataaaaaagcattagggagtgaagagtgctaccacaaagttattgttttgagataataatcatagaaactttacnnnnnnnnnnnnnnnnnnnnnnnnnnnntatgtcgtttattgaccaattcttatcaaattttttcagacatagcgatgctttttacttttatgtattacaaaatctaaaactactttatacaactagtgtaattagatcattttcacttggcttctttcacactattgtataaactatctgtcttctattgcctgtctctggcaactcttctctatgctctattncnataaanntttaataattctcttaatttgtcttggtacctaaatctctgt

SEQ ID NO: 10176 - DNA, 217 bp, Diabrotica virgifera
  misc_feature (2)..(215): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 10177 - DNA, 74 bp, Diabrotica virgifera
gctcaataatagtgttatttacatgatagaatccctataatatatattgaggaatttccttagggaattccgac

SEQ ID NO: 10178 - DNA, 580 bp, Diabrotica virgifera
  misc_feature (2)..(40): n is a, c, g, or t
  misc_feature (54)..(68): n is a, c, g, or t
  misc_feature (70)..(108): n is a, c, g, or t
  misc_feature (119)..(166): n is a, c, g, or t
  misc_feature (176)..(196): n is a, c, g, or t
  misc_feature (199)..(225): n is a, c, g, or t
  misc_feature (239)..(319): n is a, c, g, or t
  misc_feature (420)..(438): n is a, c, g, or t
  misc_feature (445)..(463): n is a, c, g, or t
  misc_feature (505)..(560): n is a, c, g, or t
tnnnnnnnnnnnnnnnnnnnnnnnnnnnnnnnnnnnnnnngttttttattgacnnnnnnnnnnnnnnncnnnnnnnnnnnnnnnnnnnnnnnnnnnnnnnnnnnnnnntatttatttgnnnnnnnnnnnnnnnnnnnnnnnnnnnnnnnnnnnnnnnnnnnnnnnnatttataaannnnnnnnnnnnnnnnnnnnnagnnnnnnnnnnnnnnnnnnnnnnnnnnncatagggggggttnnnnnnnnnnnnnnnnnnnnnnnnnnnnnnnnnnnnnnnnnnnnnnnnnnnnnnnnnnnnnnnnnnnnnnnnnnnnnnnnnccttaggggaaaaagaggaattttattggtaagggtgaatcccttattaaaaatgggaaccccccagggtgggtttaaagtttttaattggggggaaagcnnnnnnnnnnnnnnnnnnnttctccnnnnnnnnnnnnnnnnnnngttcggggggtttataaccgggggggggggcgccgggcgtgnnnnnnnnnnnnnnnnnnnnnnnnnnnnnnnnnnnnnnnnnnnnnnnnnnnnnnnngaaggggggggccacccacc

SEQ ID NO: 10179 - DNA, 633 bp, Diabrotica virgifera
  misc_feature (11)..(46): n is a, c, g, or t
  misc_feature (581)..(616): n is a, c, g, or t
acaattcatannnnnnnnnnnnnnnnnnnnnnnnnnnnnnnnnnnntattcatatttaaacttactcttttgattaaaactcttttatcatcttcttcgtcttgactcattttccaatgaatcagtttgaaaggttctttgatttttaagtgttccaaatctccgcttgctttgcacagtggcccagaaataatacaaaatcatagcacggataatacacaacccggatgatccgctgccagataatctgtaggccgggcaatccgcagcccgaataatcacgcacggataatcggggcccaaaattttatgatacgtccatcttgatcttaagtgatttcgatgttacctacaaatatagtattatctgtcactgaaaataagtaataagttttttatattgtaatcttcatctcaacatcttatatgtttttcttgaagcgtttagtttactgtccacaagcacatcttttcgcatcacgtacaatacattctagaacaatcatattgtgtctttgactgttatggtacttcttttgaccaaaagctgtaagttttaataaaatgtaagtttaaatatnnnnnnnnnnnnnnnnnnnnnnnnnnnnnnnnnnnntcttttatgaattgtag

SEQ ID NO: 10180 - DNA, 803 bp, Diabrotica virgifera
  misc_feature (63)..(80): n is a, c, g, or t
  misc_feature (588)..(610): n is a, c, g, or t
  misc_feature (630)..(653): n is a, c, g, or t
  misc_feature (780)..(780): n is a, c, g, or t
gaaatcgaacaaccgcaggaagaaagtgtagaaaaaattatccccggtctggaaatcatcatnnnnnnnnnnnnnnnnnntcctgaagaagtgaacggacctttatctaatgaaatattatctgtcgaaagcgatgattctaaattggtgccagaagctactgaaatgccggaatatgagcaacaagaagcagccgccgagggagatgatgatgacgatgttattttgaacgaggtggctcctatcaaaattgtcgttgacgatgatgacgacgagattgcgggagaaagaacgaatgtagcatcccctcctccagcgatggatacagaagatgatggatttgtggagatcgctggactgcttagtttgccgaatggaaaacatgttaaaattaaagcagaacccgtcgataaagaagacattcctacaacgcccgttgcagaagatctctcaaccctaaccgtggaaagttctgatctggaaatcgtggagcctaaacctacccaacatgacgtcgcctcctcgttagacggcaacgcggatcccttctccggcgttaccgccgtgggatcggcagccctaggcggnnnnnnnnnnnnnnnnnnnnnnngtaaaccattgcctgtgatnnnnnnnnnnnnnnnnnnnnnnnnaggaaatgatttagttccatctgaaacttatatcgatccgttcgagccctttccacccggggaagaaccgcaaccggctgcgctcaagactgcccttagagtgcctaggttgtcaaagcttcctccnggtgaggaaagggaccgagctga

SEQ ID NO: 10181 - DNA, 566 bp, Diabrotica virgifera
  misc_feature (25)..(25): n is a, c, g, or t
  misc_feature (34)..(34): n is a, c, g, or t
  misc_feature (331)..(359): n is a, c, g, or t
  misc_feature (449)..(470): n is a, c, g, or t
gatctaataggtccggggttgtggngaggatatngttttaagctccttcacccccccacaacacacgagaagagcacaagaaaaccgagggaacaacgacgggggaaaagagagcacttccttacaaaaacatatgggatttttatgtcttcctctttggttaatttactgcgaagtttgagtagaccactaaattgtcgaaaggtaaaatgaggtttgctgaagtatgtttgttaatatttttgttactatgagttgatatcgtttattaactctgataaatttttatggaatttcctttgtttatgtattatctgtatattgataattnnnnnnnnnnnnnnnnnnnnnnnnnnnnnttttatagggaagagcttgagaaagtgattttattctagtgagatttgaggagaaattaggattagaaatgttcttatatatgatgaggnnnnnnnnnnnnnnnnnnnnnnagaatgatgattttgatgtgtgatagtattgcacaatgaatttatgtattttaagtatagtaatgttaataataggagtattaaatagttgtatat

SEQ ID NO: 10182 - DNA, 841 bp, Diabrotica virgifera
  misc_feature (2)..(46): n is a, c, g, or t
  misc_feature (53)..(166): n is a, c, g, or t
  misc_feature (176)..(583): n is a, c, g, or t
  misc_feature (585)..(634): n is a, c, g, or t
  misc_feature (640)..(668): n is a, c, g, or t
  misc_feature (672)..(704): n is a, c, g, or t
  misc_feature (715)..(762): n is a, c, g, or t
  misc_feature (766)..(840): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnntaatcnnnnnnnnnnnnnnnnnnnnnnnnnnnnngaannnnnnnnnnnnnnnnnnnnnnnnnnnnnnnnntatttataagnnnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnnnnnnnnnnnnnnnnnnnnnnnnnnnnnnnng

SEQ ID NO: 10183 - DNA, 797 bp, Diabrotica virgifera
  misc_feature (2)..(795): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 10184 - DNA, 487 bp, Diabrotica virgifera
  misc_feature (436)..(453): n is a, c, g, or t
ttttctattagctaaagtacttttaagtttatgtttttaatgctgccaaattgtactgtcacagcttatttccttagtcggcggtctccaataaactccgtgtgctgcgtacagcgttatgccggacgttgcatacagcggttgtcggtcgccggcaacttctcgtagtcactacaaaacatcgggctatgattatcaatatagttgttttgctaatctgagacacggctgtctgcactgagatcacaataaagatgcactaagtatatagaaatattcaaaccaagacacgttgaatgttcgaggatatcgcagaaagtgattagactattaacatcaaattgaactcaaagaacagactctaataactcataacagatttttcacagaactatcctctctactctataacttactatgacatcactgttctacnnnnnnnnnnnnnnnnnnggacgacaaactttgatcctttaatgaatacagt

SEQ ID NO: 10185 - DNA, 63 bp, Diabrotica virgifera
  misc_feature (8)..(44): n is a, c, g, or t
ttttgtannnnnnnnnnnnnnnnnnnnnnnnnnnnnnnnnnnnnttattttatttcgatttta

SEQ ID NO: 10186 - DNA, 899 bp, Diabrotica virgifera
  misc_feature (223)..(247): n is a, c, g, or t
gtttaacggaagaagattcagtatgtaaaataaaacttaacaacaaaacacaaattgtacaaattatatataggtaaatgataacataagctaactagtctctctctctctctttctctctctttcaatttgtacacattgtacaaattatatataggtaaatgataatataatctaactactataccccctctctcctctctacctctttttctctcccccnnnnnnnnnnnnnnnnnnnnnnnnnctttcctccctctcactcctatggcgctacagcctaagtcaggctccggcctccctcagcatccgcctcctaccatccctctccttggctgttctcttccagctatccacactcaatatctctttagcatcggatatcatttcatcataataaccataaccacagtttcactaagcgttctactgggtgttctgttatttttcatacttataagatgatcttcccagttcaatctttgtatttttgcataatttgctatagttctttgtaatactgatataacttgtgattgaaccttattctccctttaccattgtcgcatttttcaatatatttctgtcaaaagtaataatacggtttttatcttttctgtcatgatccatgtttctgtgccatatgttgctattggtcgtatgatgcttttacatattttaaactttacttccccgtgggtgtttttggatcacacacacctgcgacaaagctgtaatctaattacaaatcagtataatactgctggtgatctaacttcgttaatataccttcagtccccaccagtactggggcctgatctatgaagtacgatatgaataggtgtaattaattagccagcattgtgagtcacctcacgaagtctcctcctgaaccctcc

SEQ ID NO: 10187 - DNA, 1228 bp, Diabrotica virgifera
  misc_feature (2)..(90): n is a, c, g, or t
  misc_feature (92)..(678): n is a, c, g, or t
  misc_feature (680)..(874): n is a, c, g, or t
  misc_feature (881)..(966): n is a, c, g, or t
  misc_feature (969)..(969): n is a, c, g, or t
  misc_feature (1149)..(1219): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagtnnnnnnnnnnnnnnnnnnnnnnnnnnnnnnnnnnnnnnnnnnnnnnnnnnnnnnnnnnnnnnnnnnnnnnnnnnnnnnnnnnnnnnatnattaatttttgatcaaattttttgattatagaataattacttagggataacagcgtattttttttggggagtccatcgataataagatggggacctcagggttgataaagtttttaatgggggtacgctatatttttttaatctggttcgacttttaattttaattggattgggtttaannnnnnnnnnnnnnnnnnnnnnnnnnnnnnnnnnnnnnnnnnnnnnnnnnnnnnnnnnnnnnnnnnnnnnnggggcccca

SEQ ID NO: 10188 - DNA, 991 bp, Diabrotica virgifera
  misc_feature (88)..(105): n is a, c, g, or t
  misc_feature (526)..(545): n is a, c, g, or t
  misc_feature (600)..(618): n is a, c, g, or t
  misc_feature (649)..(676): n is a, c, g, or t
  misc_feature (824)..(824): n is a, c, g, or t
ggaagatgatcagtgggaagaccacgaaaacgatggaacgacaacttactagaggcacattgaaaaaacagacagagtcatgtctatnnnnnnnnnnnnnnnnnnaaaatgtactgagatacttaggatatattggtagaagaaaagaagatgttaaaataatgatagtagaaggcattgtagaggaagctctctatcgggattgtcagaccaaataaagaacacgaccagttacttattttcaaaagcaaaataacaagctggttatgatttatggagaaaaccagtaaaattattatacagagaggtagaagaaacacatcgaggaaaatcctgccgtcacaggatagacgtcttgaacaaattctgaggaagctgagagtcacaaggtggagaagagtggctaagcatcgatacacttaaaaggcagatagttggtcaggcccaaagctcctatgagctgtagggaagtagagaaataatacagtaatgagtgctttaggcctacagcatatgttgtgtactnnnnnnnnnnnnnnnnnnnngtatgaaataacacgataaggagtttaagaagcaaaagaagatcgtaaggagacnnnnnnnnnnnnnnnnnnntagatgcaaagataagtcctttttaagaaannnnnnnnnnnnnnnnnnnnnnnnnnnngataactgacgtacagggattcttcatcaaaagtaagcgcacttattttgtactttatcttttcaacaggaaacaaggaaaaattgctaaacatcagagatggaacaaaacatagaaaaaaattttcgtaaagtaaaaactacaatanacgtaacttatggtgcagttttgtcgatcaggttttgtaatgctgcatcgccatagtctcctctcagaaaattgggcgaaaatacgtcctctactgcactttatcgaacaaaaaagtgtgacgtattatttggaagaaaatctgtaaatctagacatacaatttaaa

SEQ ID NO: 10189 - DNA, 61 bp, Diabrotica virgifera
gacagacgtctgggtggtgcgattttatatccagaaaatatcaaatagctgctcttcaaag

SEQ ID NO: 10190 - DNA, 705 bp, Diabrotica virgifera
  misc_feature (2)..(573): n is a, c, g, or t
  misc_feature (582)..(647): n is a, c, g, or t
  misc_feature (652)..(673): n is a, c, g, or t
  misc_feature (675)..(676): n is a, c, g, or t
  misc_feature (680)..(704): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacatgttnnnnnnnnnnnnnnnnnnnnnnnnnnnnnnnnnnnnnnnnnnnnnnnnnnnnnnnnnnnnnnnnnnatatnnnnnnnnnnnnnnnnnnnnnnannttgnnnnnnnnnnnnnnnnnnnnnnnnnt

SEQ ID NO: 10191 - DNA, 771 bp, Diabrotica virgifera
  misc_feature (464)..(483): n is a, c, g, or t
  misc_feature (665)..(665): n is a, c, g, or t
  misc_feature (685)..(685): n is a, c, g, or t
  misc_feature (704)..(704): n is a, c, g, or t
attaccgtgaattacccaaagtgaaaaagtgaaactctagtgattttctcgatatttatggcagtaaattgcagtaagctaattataaaaaaagccagaagttctgaactccttctggtccaggggatttccagttatgaagctctttgatgacatttgagacctcttcagtcgtgaatggttcgtagttagcagtaacgtagtggtgacagttgtgcttcgtatcttctatccagccagaattgttgttaaaagcagctggtgtggaaagttgatttccccaaaactcatgaatttcttcttggcttggatacttctttcgcctgcagtcacagaaacaggtcatatttcaacactttcaagtcacgtatacatatagaattttgaagccgttgaatattaaaggactttccacccatattttgtaagatttaaaatggatgacgaggtgtcttccgaaatannnnnnnnnnnnnnnnnnnncacacgaaagaaaccaacttttgatgacaaaaatgttgtttcaaaattcaatttcgtcctgcctcagcggtggcctggtttgatgtcggtcgatgcagatggagatttaaacgttttacgaaggaattctgcgtcgccaacagagtctattgaaatagaacacaagcagagcaccataatcngacatggttggtctacaaantttggaggggagccctgcnttttggccgattggcttatatataaccatgagaaaattcctaaagattcagtaatcttggagctagg

SEQ ID NO: 10192 - DNA, 228 bp, Diabrotica virgifera
  misc_feature (5)..(50): n is a, c, g, or t
  misc_feature (52)..(52): n is a, c, g, or t
  misc_feature (61)..(85): n is a, c, g, or t
  misc_feature (97)..(116): n is a, c, g, or t
  misc_feature (124)..(163): n is a, c, g, or t
  misc_feature (200)..(227): n is a, c, g, or t
gaagnnnnnnnnnnnnnnnnnnnnnnnnnnnnnnnnnnnnnnnnnnnnnngntatgtttannnnnnnnnnnnnnnnnnnnnnnnnaagacgagaacnnnnnnnnnnnnnnnnnnnngattatcnnnnnnnnnnnnnnnnnnnnnnnnnnnnnnnnnnnnnnnngtgattttaattggcggtggataaaaaataagattcnnnnnnnnnnnnnnnnnnnnnnnnnnnng

SEQ ID NO: 10193 - DNA, 939 bp, Diabrotica virgifera
  misc_feature (838)..(838): n is a, c, g, or t
  misc_feature (857)..(857): n is a, c, g, or t
gacgaacaaatttggagcttcctctttctaacacgaacgtactttcgtcactgagcctgactttttttccactgttcagctgtccagtgctgatactttttacagaaagcttattttatgttgcttttgtaagtataaggacttctttgcagcacgtcgacttgacatctttctcaagccggtgacgaatcgttcttattgaaacgttctgaagaagagcttatttttaagttccgtggcagtgtttgtaagagttgaacattactgcacggctgatgatggtgtcagtcctggatgatgtttttttaagaacttcagaaccaggttttctttccagcactgtccctgaaagcaacgacgcagccgtccgtttcaattgataaattgcctctcttgaaacaccaatatcacgtactacgccatagtgatgttgaaaaagtaactattcgttacaaagtactcgttacttacgaataccgaaagtaacgattactatactgagaggcaaatcgttactttgattactctgattacttcgtaacaatcgtatcagagcgagtaacgactattgtatctagtttgattactctgattacttcgtaccaatcgtatcagagcaagtaacgactattgtatctactttgattacttcgtaccaatcgtattagagcgagtaacgactattgtatctactttgattactctgattacttcgtaccaatcgtatcagagcgagtaacgactattgtatctactttgattactccgattacttcgtactaatcgtatcagagcgagtaacgactattgtatctacaactagtacacttgattactntctagtttatagactgacncggaaatgtggaaatgataatatttctacatttgtatatctgagatatggtatatcggatactatacaaatacctactactg

SEQ ID NO: 10194 - DNA, 550 bp, Diabrotica virgifera
  misc_feature (2)..(44): n is a, c, g, or t
  misc_feature (52)..(169): n is a, c, g, or t
  misc_feature (173)..(549): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 10195 - DNA, 625 bp, Diabrotica virgifera
aactctgcaaagtacgaagagtttgtattttgcttcttcagcggcccacgcgtccgattattaaataactcacaggatggctagtcatcaaagccagggggttcaacaattgttagcagctgagaagcgtgcagcagacaaagttacagaggcccgaaaacgcaaagcaaggaggctaaagcaggctaaagaagaagctcaagatgaaatcgaaaagtaccgtaaagaacgagaacgccagttccgtgaatttgaggctaagcatatgggctctagagaagatgtagcagcgaaaatcgaggtagacaccaagaggaggattgaagagatgaataaagctattatcaaccaaaaggaacccgtcattcaagagatcttaaagttggtttatgacatcaaaccagaagtccacaagaactaccgtcaatagttgacaggtgcaatatgtagttaatagggactaaaatcacttaactgtttatagatgtttcattccattttattgtacttcctttctttttgtagccgttttagactatttacagcaaaacttttgagttactacatgaagatacttatataatgttaaaatgtactaagtgatatattaaaagtattgtgtttt

SEQ ID NO: 10196 - DNA, 51 bp, Diabrotica virgifera; identical to SEQ ID NO: 9123
  misc_feature (2)..(44): n is a, c, g, or t

SEQ ID NO: 10197 - DNA, 903 bp, Diabrotica virgifera
  misc_feature (810)..(829): n is a, c, g, or t
aaagactttcctaaaacctcattgtgtggttccagagggtaacaaacttatttttttaagcctcaatttatataccatttgtagaaggatcgcttccttgtctcacaaaaaattatgccgttgatgttataaaatataaaacaaggtaaaaaatatatttcaacttctttcttttaagcgttttatcaattcactcatccagaagaaaagtgtcccaactaaaaaaaaacaactttttagggggaaaataaacaacaaaaatagattttttatatcttaatttataagttttaaacggtaactgctaaaatttataaattaaaacctaagaatatgtataagtgaatgtttctaattgtgtaagagacaaaaacaacaaaaaaaactatgatatctgatttatacagaaaaaagataaaattttgagttatgtcacttcttttaaaatattggtcacttttttaaaagtaacgaaaaatacccaggacactttttgaaatacaacggtttttgtgataaataacaataagtccacgtcgaatatcagagcataactgaagggtgtcattgttccggaataaaaatattcattttaccgccaacggaataatgacactaccgccatctttcgaagttataagtaaacatctatgtgacatttttcttgataaaagtgtaggatatttggagtcaatttaacaagataactcgattgatgccttttgtggagttgtgtcacttttctttcggatgtgtcatttttctttcgaagtatagataataatatttatgaactttataggtacaaannnnnnnnnnnnnnnnnnnngatagatgtaatatttttactcagtgccttaatagggctacgttgttatttcacagtgcttatataatatgtgc

SEQ ID NO: 10198 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10199 - DNA, 904 bp, Diabrotica virgifera
  misc_feature (537)..(554): n is a, c, g, or t
  misc_feature (884)..(884): n is a, c, g, or t
  misc_feature (889)..(890): n is a, c, g, or t
ataaacttcaaaaaatttatgagtctggagctaatgttgttttgtcaaaattacccattggagatgttgctacccaatactttgctgatagggatatgttctgtgctggtcgtgttcaagaagatgatatgaaacgtaccctgaaagcatgtggaggtgctgtaatgaccactgttaatgacatcagcgattctgtactcggtaaatgtgagctgtttgaagaaaaacaaataggaggagaaagatttaatttctttaaaggctgcccaaatgcaaaaacgtgtactttaattttacgtggaggagcagaacaatttttagaagaaactgaaagatcacttcatgatgccatcatgattgttagaaggactattaaaaatgacgcagttgtagctgggggtggtgctatagagatggaattatcaaaaattttacgggatcattctcgcacaattgccggcaaagaacagcttctgattggtgcaatagctaaggcattagagatcatccccagacaattatgcgataacgcaggannnnnnnnnnnnnnnnnnctcaacaaacttcgacagaaacacgcgcagggtcactgctggtacggtgtggacataaacaaagaagacatcagcgataacttcgaagcctgcgtatgggaaccggccatcgtcaaaatcaatgccctgactgcagccacagaagcaacatgtttgattctgtctgttgatgaaacgataaaaaatcaaaaatctgaggcgccacctcaaatggggggccgtggtatgggaaggcctatgtaactttttaaggtcaagaaattgatcttttgtataaccagtatgcagtgcacctcactaatttatctcttcgtttaatttacttgctgntattnnttctataaagcttt

SEQ ID NO: 10200 - DNA, 717 bp, Diabrotica virgifera
atatagatagtaaaacgggttcgcgaaaatgcttgggaaagcatttctttttttgagtgctctgttggttgtgcgagcagcgcagtctgatttttacagtgaccttagcctcttccatgagctccaacagccatacagggcaaattggaattggcacaatcccgtcgtgaatccaagacgcgcgatcgaagaggaactagcatctgcagaagacgacagcgatgaacgcgaacctctagccaaagactacaaagatccacctgctgccagttcggagcaaaaacctgtcttggtgcctaaaccaaagcccaatctgaaatcgatacccgaaaagcctgaaatttctgatttacctgagaatccagaaagacctttaactgagcttcttccgggtggtgtggtggatgttaattccgatggttttggaggtcctttcaatccttttgggcctaaaccaaagcccaatctgaaatcgatacccgaaaagcctgaaatttctgatttacctgagaatccagaaagacctttaactgagcttcttccgggtggtgtggtggatgttaattccgatggttttggaggtcctttcaatccttttgggccagagtttgacttttcttcgtcttttggagttggaaactcgaagcctttcagcattggagatgtgtttaattacgtccagggcagtctggggcggaagggaaagaacgtctgcat

SEQ ID NO: 10201 - DNA, 449 bp, Diabrotica virgifera
  misc_feature (2)..(444): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagt

SEQ ID NO: 10202 - DNA, 736 bp, Diabrotica virgifera
  misc_feature (2)..(46): n is a, c, g, or t
  misc_feature (53)..(731): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 10203 - DNA, 942 bp, Diabrotica virgifera
gtaagtaatagccatagtagataatattctataatgaataatatgactttggctttagtttttgcgattttatttatcggtggaatatctactgctacaaacaaagaaattgtccaacaattaagacacaatgccctatgtcttcaggctggattttcttgccctgcagtagacagtcaaacatcggtttactttccattagcagattgcaccaagttctgtcaatgttccaacggagttccatatctacacaattgtccgccggggttacatttcaatccaagtcttaacgtttgtgattatcctgcgcaggctggatgtaccggtgaaggggttgtagtaagtacaacaactactactacaactactactaccactacgccggctccaactactaccactacgactaccacaacacctgctcctactactacttcggcgccgaccaccacctctacttcaactactgctcctacaacaacaactcccactaccactacttctgccccagtaaccaccactaggacgaccacaacacctgctccctccactacatcgggaccaattacttcaacaactgctgctacaactataaaagttgataatttatgtcttcagcaaaacatagcttgtccagcagttgatggaccagattccgtctatttctcacatagcaattgttctaaattttgccaatgttccaacggtgtgccatatgaacacacttgtccagaaggtcttcattttaatgcaaaattgaatatttgtgattggccacagaatgcaggatgtagtggaacagatgtaactcaaccgactgttgaacctaccacaattacaactgccaattcttcgacagctacaaacagtacaactgaaagttcaactacagtttcgtctactacgaccacgcaagaaactccctcagacactacaactctt

SEQ ID NO: 10204 - DNA, 847 bp, Diabrotica virgifera
  misc_feature (319)..(339): n is a, c, g, or t
  misc_feature (774)..(774): n is a, c, g, or t
  misc_feature (813)..(813): n is a, c, g, or t
attgttaagatttttgtaggtatttcatccgttcccatggcttatgggatcatggtcaaacctcttggttctattgtctctattctttcgtcgtcttcaaataacccttgtatatattcttcccatcagtttattttgtctgtatttatacttactttgttgtttttgtccaatatgtttctacttctgtttcaactctttttttgtatatgccaactgattctttaattttcctgtttatgttaaagctgtcatgttgtttttccaatcttcctatttctgcatattttgctaatagccagttccttcgtttctgtgnnnnnnnnnnnnnnnnnnnnncgtttttgtattgttgttcgtttttattcttgtatttcgtctttccgatatcaatcactttatttcttgtgttatcccttgtttccttttgggggatttatcgctctccagttgatattgtatgatataaccgcaggatattctccaactctatccatttttctgtagcgttaagttgtccttgtctttgtattttctggacttccttgtgtattttttgttctttgatctgttggcagagatcagcttcttgtcttcttagattaattctagatgccttggtggctgtttttattttctttagtttgaatttcatgtattctaaaacaatgaaagagtaaaaacatacacctaccttggcacgaacgtcaatgaaaattgggaccattctctagaaatcaaatgtagaatagagaaagcaagatctgcatttcnaaaatggactaagctgttcaaatgtcatgatttatcaantccccataaaacaggttaactacgatgttatata

SEQ ID NO: 10205 - DNA, 52 bp, Diabrotica virgifera
  misc_feature (5)..(5): n is a, c, g, or t
  misc_feature (15)..(40): n is a, c, g, or t
  misc_feature (42)..(42): n is a, c, g, or t
gcttnatttttttannnnnnnnnnnnnnnnnnnnnnnnnnantaaattatta

SEQ ID NO: 10206 - DNA, 346 bp, Diabrotica virgifera
  misc_feature (7)..(67): n is a, c, g, or t
  misc_feature (71)..(72): n is a, c, g, or t
  misc_feature (78)..(78): n is a, c, g, or t
  misc_feature (92)..(92): n is a, c, g, or t
  misc_feature (102)..(103): n is a, c, g, or t
  misc_feature (105)..(105): n is a, c, g, or t
  misc_feature (110)..(144): n is a, c, g, or t
  misc_feature (150)..(150): n is a, c, g, or t
  misc_feature (284)..(344): n is a, c, g, or t
atttatnnnnnnnnnnnnnnnnnnnnnnnnnnnnnnnnnnnnnnnnnnnnnnnnnnnnnnnnnnnnnaaanntaattnactttttttatatnattatataanntnataannnnnnnnnnnnnnnnnnnnnnnnnnnnnnnnnnnaccttnaggataacagcgtattttattgaagaggtcaatcgatataaagatgcggactccaggtggataaagttttaaatgggggacagctaatttttaaaatcggtccacctttaaattttcatgatttgagtttaaannnnnnnnnnnnnnnnnnnnnnnnnnnnnnnnnnnnnnnnnnnnnnnnnnnnnnnnnnnnncg

SEQ ID NO: 10207 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10208 - DNA, 880 bp, Diabrotica virgifera
  misc_feature (9)..(325): n is a, c, g, or t
  misc_feature (330)..(330): n is a, c, g, or t
  misc_feature (333)..(333): n is a, c, g, or t
  misc_feature (336)..(336): n is a, c, g, or t
  misc_feature (345)..(345): n is a, c, g, or t
  misc_feature (363)..(396): n is a, c, g, or t
  misc_feature (411)..(437): n is a, c, g, or t
  misc_feature (486)..(486): n is a, c, g, or t
  misc_feature (497)..(497): n is a, c, g, or t
  misc_feature (551)..(551): n is a, c, g, or t
  misc_feature (554)..(555): n is a, c, g, or t
  misc_feature (601)..(601): n is a, c, g, or t
  misc_feature (616)..(616): n is a, c, g, or t
  misc_feature (635)..(635): n is a, c, g, or t
  misc_feature (657)..(679): n is a, c, g, or t
  misc_feature (681)..(681): n is a, c, g, or t
  misc_feature (684)..(684): n is a, c, g, or t
cgaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatanatntanattatttanatttagtaatgatggatnnnnnnnnnnnnnnnnnnnnnnnnnnnnnnnnnnatatagggtttaatnnnnnnnnnnnnnnnnnnnnnnnnnnntttattaaaacatgtcttttgtattaatataagtctcgcctgccctgantaattgatggncgcgtatttgaccggctaaggagctaatcatagttttttattgaagtggatganggnntgatgaaaaaaactgtcttattattataagattttattttaagtanaagctaattttttanagacagagacctataagtntataaatattataagttttagnnnnnnnnnnnnnnnnnnnnnnnantgnggataaaataattaactttttaatatatatataatattttgatcattttttgtatagataatactaagaaacggtatttatgagatcatcgtataaatgcacctcagtgataagtatatgtgacgtattttaggtgtcgtttaatttatgttggtaacggtgggcggtgtctctattttatatttgcaagccaatt

SEQ ID NO: 10209 - DNA, 838 bp, Diabrotica virgifera
  misc_feature (398)..(418): n is a, c, g, or t
  misc_feature (420)..(432): n is a, c, g, or t
ataacaaaataattatcttcatatataatttaatgtacactgtacaaaaagcaccaagtcaaaaaaatgatttgtgtcttttcattgcatataaaaaacaataaatcattttaaccctagaatggtacattggtgtcgcctgcgacaccacgcggtttcgactagatgcagtcagcacatttctagagaggggtggcatatattctccgtaccttcacccctcttagagccggtttcaccaacaacaaataaatttgtgaatagttatttgtcgaataagattaattagtagatatttttattgtgtttaaatacaatgttgatcattttaaggttaagctgacgaattttctttgttacagatatttaaagcgaggttaacttgtcaatttatttgnnnnnnnnnnnnnnnnnnnnngnnnnnnnnnnnnncaagtcttatttgacgttaaccatgtgtcagttttattggtcgaataactttattcatcaaataaaccattcgtcgatggtgaaagaagccattagtttcaaatcaactgtagccgcgactgtttattgggtgctataatatttataagtaatgtgcaagttaggtcatccaaaaatgtattatgtttatggactgcatatgaaatacgattttagataaacatattcagaaaaattcgtgacagtaactcgtaacgccacagttcataactataactgttcgtaacgtcaaaatagaattattctattttatttttttgtgacgtggaaaccaacttttattacagttgcaactgaaaatacgttttatcatttaacgaaccagcatcaggataaacattttaca

SEQ ID NO: 10210 - DNA, 878 bp, Diabrotica virgifera
  misc_feature (501)..(534): n is a, c, g, or t
  misc_feature (841)..(841): n is a, c, g, or t
attgaaacttcaccaaatcacttacaggtttcaaaaagattgttcctgtaacgattcatcgaatttgtttaacgtgtgtataaagtcgttttatgtgtataatgtattatattattctaaatcgcataaactagaaagaatctacgaccgtgaaatctgctcatttttccatttccattccagtttttgtaccatattgatttatgcgactgaaagttattctacccgttgactactatttgtaactaactaagaatactaattaaagaaaatactactacgtaactttaaccaacaatatttaaaaacattacttcttcgtatacttttctaatttatgcgattcttccaaacttagagtattagtagtgagtgtagcttggtgatctcacaagtagtgcaccacaagtatctgcgatgatttttagtctagggtggaccgcctatgtattattttccttgtattctttttgtattgtgtaaaaggcatgttccgcaagnnnnnnnnnnnnnnnnnnnnnnnnnnnnnnnnnngcacctgcacgagagtattaatttaatggtatgtattatagatgtatatgagaaatatattaaataaaaccgtgcaatgaatgagtttttgcattttctttaattagataaattagaagatacacttttttatcttataaaatatggtaaataatactgcaaaaatcagtaccaagtggagcactaacaagagcaagatatcatcagcagtggagctcctcctcctcctctatcttctctccttcacaaggatgtagtggcgtcctgtaatttgtttgaccatttctgtccattatctttctgcggntcatgttgttttgcttcggataatgagtaaccagtca

SEQ ID NO: 10211 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10212 - DNA, 899 bp, Diabrotica virgifera
  misc_feature (652)..(652): n is a, c, g, or t
  misc_feature (775)..(775): n is a, c, g, or t
  misc_feature (806)..(841): n is a, c, g, or t
  misc_feature (847)..(848): n is a, c, g, or t
  misc_feature (851)..(895): n is a, c, g, or t
ataggcgatttcggatcgtaaatattttctctagaaatggcgattattactgatgttgtaaatgatttaactaataagattgatccaagacacgatggctacattacagcatctccatactttctatatggatttttgtttacatatcttttcactattaaaatacttggaccaaaactaatgcaatataggaagccatataatattaaaaatcttctaatttgctacaattttattcaaattatacttaacacgtatatcgtatatgaagccacatgtgtttatttctcaaattcaaattggatatgtatagacacgacagagaaaaatcttgtatcagatacaaggaaacattattattttctaaaaatactcgattgtgttgaaacagtttttttcatattgaggaaaaagtatcagcaagctagttttcttcacatatatcaccatactgctatactctgcggtgctttcttgggctttagatacgactatggagacactacgataataattggaggtttaaattcactaacacatgtccttatgtatgtttactatttattgagtgctatagattccagatggggcaagtatacctctataaagaagggtttaacattagtacagattgtacaactgactacgatcnttattttcgttggcaataataaaacttatgccaggctgtaaatcaatacctaattatagtttatatttatggcttttgcaaaatgtttttatgatcaacttattttgtaagattttacattanatcatatgtaaataagcaaaaaagtgttagnnnnnnnnnnnnnnnnnnnnnnnnnnnnnnnnnnnnctgtanntannnnnnnnnnnnnnnnnnnnnnnnnnnnnnnnnnnnnnnnnnnnncccc

SEQ ID NO: 10213 - DNA, 61 bp, Diabrotica virgifera
gggcgcgcggcccgcccgcggggcggtgagtgggtgggagggggttggcggggggagggga

SEQ ID NO: 10214 - DNA, 647 bp, Diabrotica virgifera
  misc_feature (8)..(505): n is a, c, g, or t
  misc_feature (508)..(537): n is a, c, g, or t
  misc_feature (547)..(646): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnncgcccactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10215 - DNA, 872 bp, Diabrotica virgifera
  misc_feature (206)..(221): n is a, c, g, or t
tattttcagatcttggttgttaattcctgcttcttttagtattaacatcatcttggcgtgttgtactcgatcaaacgccttctcgtaatctttgcgcaattgacgtctctgcatctctggaataagacttgtattgaaaacaaagcctctctcataccaacagcatttatgaacccgagctgattgagcgaaatttgactttcacnnnnnnnnnnnnnnnncgtatggattaccattaggaacaattttaggagatgactcatcaggcttatcgtacggtattcttcgcattttttggctcctggttttttttggaagtgcaataaactcagacttcagccattctgttggtatttctccagagttttatatgttgttgaatatctttgtgattatttctattgattcgttgtttatcagtttaagtagttctgcttgaatattatcgggacctgctgctttgccatcctttagctgtgttatggcagaataaacttcctgctgtaatattcttggtccatcatttactcctccttctagctcaaaggtgttatctatttggtcttcaaatagtttttctagatattctttccacgttctacttttactctgtttctctaagatgatgtttccgtcagaatcagatagatttcctcttcaggatggtcatcagcaaaaacaaaaatatagttaataactcggcagatattagaataaattgggacatgtgcagagagtacaagcatacacgtatttaggttgctgggtaaatgaaaaatggggaaaaaagctggttagactattctctgagtggtttaatcgcatccatgacattcatctctttccaacgctacactttcataaattattat

SEQ ID NO: 10216 - DNA, 775 bp, Diabrotica virgifera
  misc_feature (2)..(44): n is a, c, g, or t
  misc_feature (52)..(747): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagagacccctatagagttttat

SEQ ID NO: 10217 - DNA, 188 bp, Diabrotica virgifera
  misc_feature (2)..(187): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10218 - DNA, 724 bp, Diabrotica virgifera
  misc_feature (553)..(575): n is a, c, g, or t
aggcactctgccgaaacaactgtagtcacatagttataataaattttgtggaagtatagaaaataaacgttttcagtgttttattgttagatattggaattagactgtctagcaatggagacctggagagataagtaaacactaaataaaaacagctaatatactggcaggatgtttaatggaaaatctgacattttaacactgagataaagtcaagaatgtataaagccaatgtaagaccaataatggcgtatgcatcagaaacaagatccgatacagctacaataaaaaagccactagaaacagcggagataacagtaataagaagaatttcaggaaatagattaagaaatcaaaaggggagtgaaaacaacagaaggaaaaaaaatacagtgtatgaacggctggacacataatagaaaacaataatggaatagctacataagcaaattgatggaacaatattgtgtgcatgacaaaatagcaagagataggtaaaggcacgcactactgcctaatgagtatcaatccaccaacgcacatacagaattannnnnnnnnnnnnnnnnnnnnnnaataaaagttttgtagaaaacgaataacacttaatggttaaaagaggaaaattatggagacaactcttactgaataaggtacactacaaagcaaattcctgaacggaatgcagtagaatctggttgcgcatactgaaagaatttgatga

SEQ ID NO: 10219 - DNA, 607 bp, Diabrotica virgifera
  misc_feature (14)..(31): n is a, c, g, or t
  misc_feature (45)..(118): n is a, c, g, or t
  misc_feature (120)..(253): n is a, c, g, or t
  misc_feature (255)..(330): n is a, c, g, or t
  misc_feature (338)..(430): n is a, c, g, or t
  misc_feature (461)..(502): n is a, c, g, or t
  misc_feature (512)..(531): n is a, c, g, or t
cccttaaagtccgnnnnnnnnnnnnnnnnnnctaaatttaaaccnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnattggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatattaaattatgaataagtttatttagnnnnnnnnnnnnnnnnnnnnnnnnnnnnnnnnnnnnnnnnnngtagaaacannnnnnnnnnnnnnnnnnnngatgatattaataaataagtattagagccaattttgttgattgaaataagaacataacggacggataacagagtaa

SEQ ID NO: 10220 - DNA, 983 bp, Diabrotica virgifera
  misc_feature (19)..(31): n is a, c, g, or t
  misc_feature (33)..(47): n is a, c, g, or t
  misc_feature (50)..(876): n is a, c, g, or t
  misc_feature (879)..(941): n is a, c, g, or t
  misc_feature (943)..(980): n is a, c, g, or t
ctaaatttgtaaagatagnnnnnnnnnnnnncnnnnnnnnnnnnnnncannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnggg

SEQ ID NO: 10221 - DNA, 77 bp, Diabrotica virgifera
  misc_feature (2)..(21): n is a, c, g, or t
gnnnnnnnnnnnnnnnnnnnnagactagaagaccctatacgagtatactaaattattgaataagttttttttatgta

SEQ ID NO: 10222 - DNA, 999 bp, Diabrotica virgifera
  misc_feature (130)..(158): n is a, c, g, or t
  misc_feature (292)..(314): n is a, c, g, or t
  misc_feature (720)..(720): n is a, c, g, or t
catttcgcgtccgctgtgatgcgcggtaatcagtgcagttctcatagtggtggaggacgaatgtgttcgttacacgtccgcgaaacggcacgcggtacagtacttgtgatgtaaaaacactgctaaaccnnnnnnnnnnnnnnnnnnnnnnnnnnnnnacagtggcagcatttaaagaaaatatatgcttttcgaaaatcttacgtgggccacaacaaatagcctcgcgggccggatgccgcccgcgggccgtcagttggacaaccctggtctacatggtcaaaccatattnnnnnnnnnnnnnnnnnnnnnnncggttactgtgtgttttaatttcataatctatttgattcttttttatcctattcatcgttgtcacaatctttattaatgtcataatgatcatcatttggctctacaactctatgtgagtcttggccgcgtttaatatttccctccattgttgtcggtcctgagcagctatttcccattgctgtactcccattttgcgtagatcattggctactgcgtccttccacctctttcttgggcaaccaactgaccttctgccatcgggcctttcccagaatttggcgttcagaagtctaaatgtcataatgtctacaaataaatactgatgtaattcacaatgatggctaatttcttttctataacctcggtctgtgaaaaagtggtctactgtggaacttcctgctttanatctcgccttttcttttgcttttttattattttctatctcctagatagtcctataactacccatcatcaaatagttgtttttcctcctagatagagttcctgcagtttctttcctatgctagttttttttgagcgatgattttagcgattttttatgtattttatatcttcattatatcaatagcactttattattttcgtggtgcccccaggaatccctgtacagttaatatatatacacttgtttaaaatattttggtagtttactttcatgctata

SEQ ID NO: 10223 - DNA, 794 bp, Diabrotica virgifera
  misc_feature (2)..(791): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntag

SEQ ID NO: 10224 - DNA, 994 bp, Diabrotica virgifera
  misc_feature (822)..(822): n is a, c, g, or t
agcgaacatatgggtgttatgcaataattagtaataagcatgaattagaaatgaggtgtagctaatagttgagcattataattttattctgtttatgctaagaaacttcataattgctttgattgattcttcatctacgttatgtaaaattgaatatattgttatcggggttggaagtcctttattggcggaaaattgtgtaggtataataatatgtcccttattggacgttggaaaaaaattgtagatatcccagtttggaatggagttaatagggcattcaaaaaatatgtgattaagattttttatggacccacattcgcaatagggattgtctgtcaagttcattctaaatataggcaagttttctttgttagacagtgccctgtacgtaacctaaaaataaaaatttgcttttcacattaacaaacaaacaaacaaaatgatatttgacaccaatgacgtatggtcttttgattacatctgtcaacttcgtaaaaaatctttaacgtttcgtgggttttatgcaacttcgtatcaaaaccataaaaaacaacaaagggagtaatgtttatgacacttttaatggttatgagcattggctgtgtctatatattatacgtcattggtaagtacatactttttaaaagagggcttattattattattctgcagtattagttttttcctacattttttttttagctagctttagatgctaatccagcaaacagacgtattttttacgtggactttttggtgaaagtgattcattttgatggcgattttcgttaaccttaataaatttatctaatgtacttnaaataacaataaatacacaattttagcgtaaagtttactttaaaatatattgtacatttatgtataagtcaaaatccacgcaattttacataatattcatctagctggtctcagtctgtttgctagaaataaatcagttttttggactattattttttactgtttttttttt

SEQ ID NO: 10225 - DNA, 749 bp, Diabrotica virgifera
  misc_feature (2)..(22): n is a, c, g, or t
annnnnnnnnnnnnnnnnnnnnggatgcttgaactgattgttccaatatatgcatgataggcagacccatgaagtaggattccccgctcggatatgtagtctgatgacattattaaatcatagctggatactatatgagtagacaattttctaccacatagtatctaaaaaagtgaactatataaatgatgggattaaagaactatggtatgtaaaaatcaactattattaaaaagagaagcatcatttgtttggtttaaggaaacaatgttattgatcatactaactgactgattggatagaatgcaacattgaccatgactagtttgcaactaaatgacatcttagtcagagagagtttatttattatattgactccaactctttaattgtattatcatatcctattaataataaatgccataagtagatttggtagtcaagcgttaggaggatgtgttcattacctgaacctcggtacaagtacatataataaaacttgatactggtatagatgctgatgttgtttctcctgatgaagttgaagttatgataataatgatagctctaatgagcgacgcatattaagatgctagttatgaattgaggattatgatatgtaatcaaggagtagtatatatacatatcgtgtaatgatgaacatgttgaaaactgacgtataagtaagtttactttcagctaccatgctcaagcatgtgctgcacgttataaaatccttttatgaagag

SEQ ID NO: 10226 - DNA, 228 bp, Diabrotica virgifera
  misc_feature (7)..(44): n is a, c, g, or t
  misc_feature (78)..(100): n is a, c, g, or t
  misc_feature (108)..(129): n is a, c, g, or t
  misc_feature (158)..(189): n is a, c, g, or t
  misc_feature (198)..(225): n is a, c, g, or t
taacagnnnnnnnnnnnnnnnnnnnnnnnnnnnnnnnnnnnnnntgcgacctcgatgttggattaagtttataattgnnnnnnnnnnnnnnnnnnnnnnntgttcgannnnnnnnnnnnnnnnnnnnnnagtttaacccgtgtgagccagggtggttnnnnnnnnnnnnnnnnnnnnnnnnnnnnnnnngaaaggacnnnnnnnnnnnnnnnnnnnnnnnnnnnngat

SEQ ID NO: 10227 - DNA, 927 bp, Diabrotica virgifera
  misc_feature (816)..(816): n is a, c, g, or t
  misc_feature (846)..(846): n is a, c, g, or t
  misc_feature (848)..(849): n is a, c, g, or t
  misc_feature (874)..(874): n is a, c, g, or t
  misc_feature (897)..(897): n is a, c, g, or t
gtttttattgttgtttataacaatgacggaactaaatgagttgggacgaattattactgagttattaagtgaggatgaagaattagaggactctggtgattcttactccccatcataagaaagtttaagcgattaaaatgaagaaattactgacaggcgacccagaaataaagccaagaagcgtgttcctgcagatatttcaacaacggcaaccaaatcaaaaccagcgttgatgcccattgatctcccatcaacttcaaccgctggcgctcactaaactacttcaaatgatgaggtccatttgcctataaatccggttggggaagaatttattattgatcaggtaacaaacactaaacctcctcctgttaagagaagaaaaagggatgtttcttcttggaaaagccagaaacgttatatcagccatcaaaaaggggaatcttatgtgagtcgtagaggagttgtagtgcccgctaaagaagttaaaagtttgaaggactgtttaaatgactgtaaatttaaatgtggggtatctattagtgaaaatgaaagacaagctttgtttaaggcgttttatggcatgaatcaaaatgggaaaacatcaatatatcttgggtaaaaccacaaaacatcagacagaaagacctaaagataggaacagagaatcatacaaaaaattcacttttaggtacttctttaatggtggtaaccaaaaggtacaagtctgcaaaaattttacttaggaacactaagcatcttacaaaaacctgtctatacggttcataataacaaagatgaggtcaccaatacacccanagccgggtggtagggggtaaaagtgcccananngtcagacgcccctcatgagaaatanaagaaactgagaaaacacataanatcttttcccccatggtgagtctcattact

SEQ ID NO: 10228 - DNA, 942 bp, Diabrotica virgifera
  misc_feature (898)..(923): n is a, c, g, or t
gttaagttgttgttattaggaagattattgggaacaagaaccaagaacgtgtttatcattcatagtaacctacctagctctctgcctctggcgcctctgcacctctgtgtttatgttaaatatctttgatgtaaagtgtcagcacagggcagtttaagatttcctcttaaaatttagttatacagtgactgcattttggatgtaaatataaaattgcaattgttacataaaatcaaatttaataatatggaaataaaacaagaagttagtggaaaaacttgtaaaatagaaatagatcatgtcacatgtgttggtcccttggataccttaaaagttgaagttaaggaagaactgaagacagaaactgaataccaggcatttgagtatgtagacttaaatgaattcccagttaaaactgaagtagagcaaggtgaagataaatttataccatttgatgaaaagcaaacaagaaatgaagaaagcattctgagagtttctagatttcaataaacccacagttttgatagaaccaaagaatacatatctcccaagaaccgacacaaacggattatctatgaactaaatttttatgcgcatgtgccagatcggccatttctcaatttgtatgaatagcaaataattttggtgacatttgtcttgtacaggatcggcgtttgttgtcacagttgtttgtttggcttggcgttagtattttgtttttgtatcagtttgtagctcataatattttgtatagatttattttctatatatattttcttatatagcctacaactattaattgttattttcccacatttatacaatttaattctttttgagatatcttgattatgtgaataaataattttaagctttttcatgaactataaactatcgnnnnnnnnnnnnnnnnnnnnnnnnnngggatttcacaaagaattt

SEQ ID NO: 10229 - DNA, 955 bp, Diabrotica virgifera
  misc_feature (495)..(519): n is a, c, g, or t
  misc_feature (565)..(585): n is a, c, g, or t
  misc_feature (594)..(594): n is a, c, g, or t
  misc_feature (670)..(671): n is a, c, g, or t
  misc_feature (753)..(753): n is a, c, g, or t
  misc_feature (813)..(841): n is a, c, g, or t
cacaataatgaattaattaggaacgtacacaaaagtttgggggggtttaaggaaacaaaactcccacaaaatttttatggggtcgacaaatttcgctataattttgttttaagatgctccttccgtgagagtgatacatgtccattttcaatagaaggtctctgatagtttttgatatattgaaaaggatcgattttcattttgtaacttcaaagggctgtaactttttttaggagcacatttgtactaaggtaagttaggttcaatcgaactatttttaactccggaatgtctggtataatttatgaccagtcttttcgggacaccctgtttaattacatccttgttattgaaatattttgaactataaaggtactttacttttgatctaaatttatcttttttgacacacctcgtataaaattgacataggatggttgtattttgggttttagagtaatttagaccatgcagagctttttattacgaatcacnnnnnnnnnnnnnnnnnnnnnnnnngagttattagagttggaattactgagggtaatgttggttgtccatnnnnnnnnnnnnnnnnnnnnnttctattgngagggatgtaattgcatgtgggaatggttggtttttgattccaagcaacttttcatagtggcaattttccagtggnntgtgaggaatagagctactttgctcttgagtgagattcaaactttttgacatgcctcgtgtaatattcataaaattgatatnctgatggtgaaactctataggttttggaaccgtgcagagcttttaatgaagcaatgggcnnnnnnnnnnnnnnnnnnnnnnnnnnnnnttttccattaggatacaacttacagggacatactgtatattagatgataatcttttcaagattcttctatgcttcgatgctgcaagacactggataaacaaaaattttagtatc

SEQ ID NO: 10230 - DNA, 846 bp, Diabrotica virgifera
  misc_feature (344)..(367): n is a, c, g, or t
  misc_feature (617)..(637): n is a, c, g, or t
  misc_feature (755)..(755): n is a, c, g, or t
  misc_feature (759)..(759): n is a, c, g, or t
  misc_feature (772)..(772): n is a, c, g, or t
  misc_feature (798)..(842): n is a, c, g, or t
gtttattttaaagtaaatagagacaaacattattattgaatggataataattccagtagtcttttaaatgctacaacattgttcatacaacgtataataaatgttgactttcagtaaaactccacacagaatctacttatatgcaaccaatattacacaatatttttcaactgttgcggaaatttattgagaaaaaactttggtaggtattacttgaatatatctaacaaaataagcgttttttgtagacgttaatgcaatagcgttaaaaattattcttaattactgattaagttgtatgtaatgtagctaattacataaattctaatgagttcaataataannnnnnnnnnnnnnnnnnnnnnnncgattcaaacattttagttttactttcgaattttattgtaaagggatcttaaggtgaaacagtggcaatcttggaacgcgttttcgctacctgttgatcgctactgtttcctcttaacacaaaccatttatgtattgggacaaagaatgtttataattatgttcttgtaatatataccatatttttccatctctacagcttggtcagcttggacgtaaaggacacattgaagtagattgtttaattacannnnnnnnnnnnnnnnnnnnncttgataatgcccaatttacatacatagtgtttaaagttgttgttttattgtagtaagtgtcacgcttctgtcaagtgtatttagaaaattgggtaggttgttaataaaatattatcnttanatattctttactncatgtgcctgttacttatattaagcnnnnnnnnnnnnnnnnnnnnnnnnnnnnnnnnnnnnnnnnnnnnngcct

SEQ ID NO: 10231 - DNA, 442 bp, Diabrotica virgifera
  misc_feature (6)..(23): n is a, c, g, or t
  misc_feature (33)..(243): n is a, c, g, or t
  misc_feature (250)..(287): n is a, c, g, or t
  misc_feature (307)..(320): n is a, c, g, or t
  misc_feature (323)..(345): n is a, c, g, or t
  misc_feature (353)..(375): n is a, c, g, or t
  misc_feature (405)..(436): n is a, c, g, or t
agcggnnnnnnnnnnnnnnnnnnctttttaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10232 - DNA, 896 bp, Diabrotica virgifera
  misc_feature (806)..(806): n is a, c, g, or t
  misc_feature (838)..(838): n is a, c, g, or t
  misc_feature (861)..(861): n is a, c, g, or t
cagccttctacttcggtttctttaattggtggtaaacgccataaattttcttataaagaaataaatttcgtcttcatgtgctgcaccatttttactactaccagagataagcattatcgaatcaaagatttaaagaaacatttcaaaaaactaaaacgtttcctggaatataaaatttaggcgcggatccaagggagggtcaatggggtcaattgccccctccttgagacttcgcctggtgtcgcctttttttaagaaagagataattacgattgaaaagaaatagtgagttttgtgtcctgttgacaactgaataacggaatgaaacataaaacagaatttcttctccaaagtacgtgttctcggtcttactgtatggtgtcgagtcttggattgtgaataaaatcgatctacttacctaaatcgccttgaggctttcgaaatgtggttctatagaagaattttaaaagtatcttgggtgaagaagattcgaaactccacaatactagaacgtctcagcaagactactgagattatagaaggcatcaagaagagaaaagtggagtattttggacatgtaatgagaagtttcaaatataggttgctacaaaatattatgcaagtgaaaatagaaggcaaacgcagttcaggacgaaaaagcacttcgtgattgaattagggtggcagtgaataaaattaagatagctatgatagtaaccaacgttctgaaagaacatggtacatgaaggaaaataaagtaacagcccataccgaaaaagcatcctgcgtacgcgagtgacgagaanatttttatttcattgccccctccttgcaaggntgctgggatccgccgttgataanatttctcataattcactaaaatcacttttgctact

SEQ ID NO: 10233 - DNA, 963 bp, Diabrotica virgifera
  misc_feature (823)..(823): n is a, c, g, or t
  misc_feature (864)..(876): n is a, c, g, or t
  misc_feature (878)..(891): n is a, c, g, or t
  misc_feature (917)..(917): n is a, c, g, or t
  misc_feature (929)..(929): n is a, c, g, or t
atgtgttaatgcatctgtaaacgaatttacaaacaatatttagaatttattaatgttcccaatataatcatgcaaaatggctagtgatgatggaaccactattcttaattcgataaataaagaccaaactgagtgggtccctctgtctttaacattagtggaataccccaagggtgatttatttggtaaatttttggctcttataagtttagctccttttggaattggttctggattcttagcattaattttatttagaagagatttacacacaataaccttcttcttgggtacaatagccagtgaagctttcaattacctattaaaacacatcatatgtgagtcaagacctatccttagagaaaaccattatgtagaatatggtatgccatcatcacatgcacaatttgtatggttttttacaacatatgtgatatattttgtctatataaggttacagcatatgaataacaacactatcatacaaagtttgtctaaatttttgataatcttttcatctttgtctatggccatcttagtcagcataagtagaatatacttagagtatcacacagtatcccaagtgctttatggagcattagtaggtattctatttgcaacattttggtttgctctgacttacttagttcttgctccattattcccacaagttgtgacctggagtatatcagaattacttctattaagggacacaacacttataccaaatgttttatggtttgagtataccaacaccagaaaagaggtccatgcaagaagcagaaaattggtcagcatgaagtctcaatgacatataatgtgngacaaatggtctcacttagtacattattgccctgtaacatnnnnnnnnnnnnntnnnnnnnnnnnnnngtggaaataggataggaggaaataanagagcagcttgntcaaatgactgctattttaaaactataagctata

SEQ ID NO: 10234 - DNA, 754 bp, Diabrotica virgifera
  misc_feature (8)..(753): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10235 - DNA, 931 bp, Diabrotica virgifera
  misc_feature (283)..(306): n is a, c, g, or t
  misc_feature (556)..(580): n is a, c, g, or t
  misc_feature (582)..(594): n is a, c, g, or t
  misc_feature (779)..(779): n is a, c, g, or t
  misc_feature (818)..(818): n is a, c, g, or t
  misc_feature (828)..(828): n is a, c, g, or t
  misc_feature (880)..(880): n is a, c, g, or t
  misc_feature (891)..(891): n is a, c, g, or t
  misc_feature (903)..(903): n is a, c, g, or t
ccctttgcgtccgaaaaggaagccatgaagcccacctcaggtcgatgaccctgtttgtttgtagatgaaccccctttccgtgtagtttgtgacgtgtgataaaggattttatttaaatatgtccggattttcatcgttcatttctaagattaggacaagacgaacacacaccttgggagactgagctaggccaaggacacacatagctatcatggatgattgaaatattattctttaatgttattttgattgcctggggtagtttatcatatcgtttcaatgnnnnnnnnnnnnnnnnnnnnnnnnctaaaaaatacattcatttgttatgtcatacatcatattttttcataaagatagaaatatgtggggctgaaagttaaattaaaagataaaatcgtccgtatctcgaaaatgaatcacttataattaaaaacgggatttgaaaatgtgaaacacaacaattatttttgtcgtcaaagagtaggatgctgtagaggtgaaattgaactcgattacaggtgggtagaatgtcactcataatttattctgttgnnnnnnnnnnnnnnnnnnnnnnnnncnnnnnnnnnnnnnatttgcaatttctagctaataatatctcttcagttctttctgtgtgaaacatcaaattatgtggcgacctttatttgctttacaaaaatattattaggaaggtaaagttttcaatcctaatatagacatattatgaacattaacaatattgaaaaatattaaaaatagtgctaaaagatttttanattgaaaacttattggttcatttccctggtaacacctcncaggcttctnaaatttgcaagccagatggatactgcacagtgacggtttaaggcatcatggngccctaggcgnccctagaagtangccccttaatagcgatcatttacttaaa

SEQ ID NO: 10236 - DNA, 734 bp, Diabrotica virgifera
  misc_feature (2)..(27): n is a, c, g, or t
  misc_feature (34)..(71): n is a, c, g, or t
  misc_feature (91)..(104): n is a, c, g, or t
  misc_feature (107)..(129): n is a, c, g, or t
  misc_feature (137)..(159): n is a, c, g, or t
  misc_feature (189)..(220): n is a, c, g, or t
  misc_feature (227)..(383): n is a, c, g, or t
  misc_feature (642)..(661): n is a, c, g, or t
gnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaaagaaccaaattttacaaccggggggtgggaacgcaaaatttttttaaaggggcccccaaatttaatttccggggcgggtttttaaaaccgggggggggggaaaacccgggggttaccccaatttattcccttggaaaaactcccccttttccccggtggggaaaaaagaaaaaagcccccccccatcccccttccccaaaattggccaaccttaaaggggaaggggacccccccttgaaggggcaatttaannnnnnnnnnnnnnnnnnnnacccgaagggggcccgttacttttgcgggcgcctaaggccccttccttttcttttttttcctttcttttctcc

SEQ ID NO: 10237 - DNA, 927 bp, Diabrotica virgifera
  misc_feature (735)..(735): n is a, c, g, or t
  misc_feature (792)..(792): n is a, c, g, or t
aagtttgcatatgtttaagaaacattgaaggtgttataaactttatctttaacaactatgtaaagtcgtatgttgattatttaccttatttcacgtgtataacctcaaaatcaaaatgatggattccaaatacaataatggatatgcgaaaaacggcattcagaagtttcaaatgaagctaaaaccgatacctgtggtatttaacaataaaaatggcccaccgagccccaaaaaaatgaaatttaacaatgaaaaccataatccctcatcatccaatggccacctaaacggcaaagttaagataagtatacaggaccaaagaagaagtttgccggtatttgataaacggaagcaattgttagctctcatcgagaagcacaagactctaataattctgggtgaaacgggtagtggtaaaacaacacaaatacctcagtatattttttcggtgggtttaaatgaagggggtaaaatagctataacacagcctagacgagttgctgcaataagtgtagcaacgagagtggctgaggaatatggacgtggaaagactgtaggagacatagtgggttattcagtgagatttcaagattgtacatcaaatcaaacaaaaatcaagttcctaactgacggtatgttactcagagaagctatatcagatagattgcttatggaatatagagtcgttatactggatgaagcccatgaaagaaccatccatacagatgttttatnttgggattgttaagagagctcaaaaaatcagggaagacagaaatttaccagctttanagatacttattatgtctgctacaatggatgtagatcatttttcacaatatttcaacaaatggccaaagcggttatttagaaggacgaacttttccctgtaatatacactacacaataaaaccacatgatgattat

SEQ ID NO: 10238 - DNA, 820 bp, Diabrotica virgifera
  misc_feature (353)..(426): n is a, c, g, or t
cttcccgggtccggtctttattggtctgatgactgtttctctctttaaattctgcctttcatttcttttccgatatttttattgttctctatattatttcattcagaaaacctctttgctctattcactcgatcttccactgctgtttcgagctttctatggctagatagtgtgatgcctagatatttaaactacatcacttgtttttatatctgacaatccatttctaatttacatcttagtagatctgctgctacatataaccatgcattttgtcttttttggggaaattaacatgttaaattttctggcggttatattaaatttgtgcaacaaacgattgaaatcatctnnnnnnnnnnnnnnnnnnnnnnnnnnnnnnnnnnnnnnnnnnnnnnnnnnnnnnnnnnnnnnnnnnnnnnnnnnagttcttaccttttttctgtatttcgtttcatactattggatgcttcaagtatttcagccatgtaaaatggattaaaaataaagtaaagaaatgattttagtacaataattattattatttgttaaaacaccgctttagttaataaatctcataaataatgtgataatggtcattaattcacactatactttgtaattgcagaattaatttgttaaaaccgttgtcaaagctgctaagtatatgtaacctttgttattaacagtagagttaaatagtggaccaacccttaataacacaattataattattagtgctgtagaaaactcatcagttgaataaatgtttgtagtgatttcgtaattaattggtgttttaacatctcataaattacat

SEQ ID NO: 10239 - DNA, 902 bp, Diabrotica virgifera
  misc_feature (30)..(45): n is a, c, g, or t
tcgttatcttattttttacggatttttctnnnnnnnnnnnnnnnngcttcagctagaaaccccgtccgctgcccccactgagccgcaccccggaactcgcccaaatcatcaaattcccgtcgccgcaaacacaacactctctgtgcttactgcgtagaatggtagaaggtgaatcaccaagaaaccaaaagcaagactctgatgtaaaaatcgagcacctagcaaacggctgcggatcaaaggatctcgagcttggaaactttacaacgaccaaagaacttccatttaaactctcgtcggatgtagataaatccagtgataaagctgacttcgaaaaagccatcgaactcaccagatatgggaaatttcacttcttactactagcagtatgcggcttcgtaagcacctccgaggagatggacgtcatctcgatgtcgttcatcctcccttcggcccagtgcgacttaaacctcaacactcaaaccaaagggtggctcaattccatcatatttattggtatgatggcaggagcctacgtttggggttcagtagcagactcattgggtcgtaaaaaggtgcttattgtgagttccttcatgaatgctctatgtatagtagcttctagcttctgtcaaacatatgagctgttcatgggtcttcagatttctaaacggggcggcattagggggcagcggaccagtaatctggtcatactttgcggaattccaacccaaatccaagagaggttccatggctttcattcatggccgctttctggaccttgggtaacttatttgtagctggattagcttggttgattattcccagctgatattggtttcaagaaacagtattttgtgtataattcttggagaatatttcttctcatttgctcattccat

SEQ ID NO: 10240 - DNA, 900 bp, Diabrotica virgifera
  misc_feature (6)..(892): n is a, c, g, or t
cccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataat

SEQ ID NO: 10241 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10242 - DNA, 771 bp, Diabrotica virgifera
  misc_feature (294)..(313): n is a, c, g, or t
catattatattgtaactttatacttgatttttggaattatctgaggactgctaggaacttcattagtaattttatcactaacaaaattattcatgcccggctctttctttgtcaatgaccaaatttatcttgtcattgatacagctcttgcattaattacccttttttttatattaatgcctattataattagacgatattgcaaattaacttgaccccttaataatcggagctcccgatatagattcccactcaaccaataatatgagattttgaatgcttcccccgactccnnnnnnnnnnnnnnnnnnnnggatattaaaataggaattatgtaaccggatgcccggattacccgcctctgacttcatatatcgccctagaatatccatcacaacacctatctatattaagataacattaagcgtgaattcactatcatgttacgtgcaattaattttcattacgacgagaatgattatactaccccatgatgaacctccttctgtcgaatacccctatttgcctaagctgccgaaagtacatgaaccactatcttctattatctttaccgattttagctggacctattactacattattaccagatcgaactttaaatacatcattttctgatccagctgaagcacgggatccaattctctatcaactgttattatgagatgatgtccatcctgaagaacatataatactattaccattatatctattatattctcatattgccaggagctacagaatatcttctca

SEQ ID NO: 10243 - DNA, 925 bp, Diabrotica virgifera
  misc_feature (795)..(815): n is a, c, g, or t
gaagatattttgtgttttttcctttggtattatttctttttaataacatgaacggtgaagactgtatcgataaaactgacttctttttaagagaaattccagatgttaaaattggccaaactgcgcccctaaagaagaaaatcgtaaaggaagaattgcagtatctaacattgcctgaactcattcaagaaaagatattagatacattaaaatacatccatggacctaactttaaactcagtgatatttctgactatgaagaatcaaactctaatcttcttaaaaggtactgggttggacaaggatctctagtagtaaaaggaggtgtagatttttcacaaagtagggatcaaccagcagaagaagctgaacgattgaaacagtttggtctgatgagattagaaagctatggatttcacaaaaatcactgtttggaagccttcgaatattgcaaaggtgatgttgaagactcaatatacttgctctaccaaaaatatttcaattttgatgcagcacctaaagaaatcgaacacggactatctaaaaaagaactcacagagcaaagggatgacgaaaaaagttccttagaatcaatttatgaaaaatcatttaatgttaaaactgatgatgtttggattctgaatttgaaactggagtatctcgtagatatatttcacaataaagatatcgtaaaaaagaaacctgtcgtgaaagataagagggaaaaatgcaggaatttgcttaggggtaattgtaaatttggtgccaagtgtcggttttcacacgaaatagaannnnnnnnnnnnnnnnnnnnncaactctcatttagaagattttacatttgagttggaatttcgatttcctagcatttacccatatccctatgaacctccctttatatttttaaaaactaacgcaatactac

SEQ ID NO: 10244 - DNA, 892 bp, Diabrotica virgifera
  misc_feature (55)..(82): n is a, c, g, or t
  misc_feature (344)..(364): n is a, c, g, or t
  misc_feature (777)..(777): n is a, c, g, or t
  misc_feature (828)..(829): n is a, c, g, or t
cggacgcgtgggctaatttgaaacaacatttgagaattcacaccggggaaaagcnnnnnnnnnnnnnnnnnnnnnnnnnnnngtttagacaagcagctaatttaaatcgtacatatgaggaaacacaccgaagtcttacaattgtgaagtttattttaacctttaactacacgcgcattagggtggtccaaaaaactaaagtttttttaagagacctagggaccctcccattttattatatctaatctgtgccaaatcttaacattctagaacaggggttcccaaactggggggcgcgccccccctggtgggcgtgaggacatatcagggggcgagagacaagnnnnnnnnnnnnnnnnnnnnngttatttttctaaaattcaaaattaaccgcttgttaaactgtgtctagtaacgcagagtaagcaaaagttatctcaaatacctctttttggcaacactgtgattgattttgacaacagtaataatatgaccgaaggcatacaaaaccaggtagttgacgcagtaaaataatcgccattttttgctattcagctagacgagagtactgacagaacaatgttatcagttaattgtttatgttcggtataatcaaaacgaaagaatgaaagacaagctactcttttctacagagttggagactggagttcacgacaaaagctattaatgttatgaaagcagtgtgagagctttttgacgaacatgaactctcttggcaaaaactgatcagtttatgtacagatggcgcaccttcangtgcttggttttcgctcaggctatttgcaattagtaatagagaaaaatgcnntgatgtgatggggatacattgttttatacatcgacaagccttgtcagcaaaacccttcaaatg

SEQ ID NO: 10245 - DNA, 565 bp, Diabrotica virgifera
attaaatatgaagtctctcctgcccactggtgcattaaaatggacacggtatttcatgcgtgctaacgatgcatagtcctcttgtatttcacgatgcactggacacgttcatacgctagggcccgaggctgtcgtgatatcctttgccacatgccccactttgctcagcaacacaaaggaaatgtgacgagctgccttcacaggttacatgaagatcacacatagaaacatggccgcctgaggaattatgtctttgcaaagtgaaataccccatgggacacatggtcaccaccaaaggagatctggtatgggaaatcacggttgaagtcttcgtatgggaagtcctcgtgtttataaaagtggacagtgccatggtgactgggacgtcatgctggagcgatacagtcgaggaaacgcacgcccagagtatatgttataatgttcaagacacccggcttgggtgcgctcgtccatgccatagacgccgtcgacgctgcagctcttacaagtgtgactaaactttgatgcgaggcagctactcactgcacgggcgtgaggctatcgt

SEQ ID NO: 10246 - DNA, 675 bp, Diabrotica virgifera
  misc_feature (2)..(478): n is a, c, g, or t
  misc_feature (485)..(508): n is a, c, g, or t
  misc_feature (518)..(518): n is a, c, g, or t
  misc_feature (557)..(579): n is a, c, g, or t
  misc_feature (581)..(581): n is a, c, g, or t
  misc_feature (594)..(594): n is a, c, g, or t
  misc_feature (614)..(615): n is a, c, g, or t
  misc_feature (632)..(632): n is a, c, g, or t
  misc_feature (645)..(645): n is a, c, g, or t
  misc_feature (653)..(653): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcgataatanagattgcgacctcgatggtggattaagtttataattggnnnnnnnnnnnnnnnnnnnnnnntngtcgacttttaanattttacatgatctgagttnnaaccgtgtgagccaggntggttctatcttnatttattnatatatttagtacgaaaggacc

SEQ ID NO: 10247 - DNA, 174 bp, Diabrotica virgifera
  misc_feature (4)..(66): n is a, c, g, or t
  misc_feature (74)..(74): n is a, c, g, or t
  misc_feature (83)..(83): n is a, c, g, or t
  misc_feature (97)..(127): n is a, c, g, or t
  misc_feature (130)..(173): n is a, c, g, or t
gagnnnnnnnnnnnnnnnnnnnnnnnnnnnnnnnnnnnnnnnnnnnnnnnnnnnnnnnnnnnnnnnaagcttanatttttttnaaagacgagagacnnnnnnnnnnnnnnnnnnnnnnnnnnnnnnngtnnnnnnnnnnnnnnnnnnnnnnnnnnnnnnnnnnnnnnnnnnnng

SEQ ID NO: 10248 - DNA, 641 bp, Diabrotica virgifera
  misc_feature (2)..(395): n is a, c, g, or t
  misc_feature (403)..(420): n is a, c, g, or t
  misc_feature (423)..(442): n is a, c, g, or t
  misc_feature (517)..(535): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatatgnnnnnnnnnnnnnnnnnntcnnnnnnnnnnnnnnnnnnnncactatagaattctaatattttcttacttattttctatcgttacgtggtagagataactctgatattacatttcnnnnnnnnnnnnnnnnnnngatttgagttaaattatgaacaaatgaatcatagacctattgtacaaaaatacaaggagtacaactattattttccgttttcttggagtaccatcaatattcatat

SEQ ID NO: 10249 - DNA, 126 bp, Diabrotica virgifera
  misc_feature (2)..(2): n is a, c, g, or t
  misc_feature (9)..(10): n is a, c, g, or t
  misc_feature (17)..(89): n is a, c, g, or t
  misc_feature (112)..(112): n is a, c, g, or t
tnaattggnngtgattnnnnnnnnnnnnnnnnnnnnnnnnnnnnnnnnnnnnnnnnnnnnnnnnnnnnnnnnnnnnnnnnnnnnnnnnntatagaaataattacctttaggnataacagcgtaatt

SEQ ID NO: 10250 - DNA, 185 bp, Diabrotica virgifera
atttgggggggggccagcccttttaaggagtgagagaggagaaagagaaggagagggagggcccttttagagagcaggaattttatgttatgatgattatatattatgggggaaggatattttaatattagtggagaatatttgagtgttggtatggtagtgagtgatagaggtaggtgttaatt

SEQ ID NO: 10251 - DNA, 947 bp, Diabrotica virgifera
  misc_feature (209)..(230): n is a, c, g, or t
  misc_feature (826)..(826): n is a, c, g, or t
  misc_feature (843)..(843): n is a, c, g, or t
tccaaggctcacctatttgtggactagccgcttcttcttcacgtgccatatcagacttatccgacgttggcgatcaccatttcaaaggcttttcgatcttcttctctgatactagccgcagcccgcagctccctaaatcagtgtaatgattgctgaaaagtattttttactgtgattgaaatacattgatacacagccatttttagtcnnnnnnnnnnnnnnnnnnnnnngttgaaaccacaatggtgaatgtaaattattagattgtaacattttgcaaatatttggtaatgtgaaatggaaccaaacagtataaattatattttgggtaatatccttaaatttttcaaatataaactagaatataggataaaaatgtaatcaaaatgtatgttgatttaataataatgtagatcttgtaagggatactgttaaaatatttaacagtcgtaaagttaaatcacaatcaaattcaaaaaagtacaagaatatcgaaatatgcttatattttgcttgatcttgacttttttgttcctctgtggtatgaattaaattatttagaggaaaacttttgagaaaagggatttgacaaaacaggcaaataacaaatcggtgttgatacatttttttagccaaatcgtaatttttatcgagttcataaggaatatgtttaatgacagattcttcacaacataaacaatcagtaacagctttgacaggtgacagttggctgtatagttaatagggagataggccttttcatcatgtgacgagcgcaagcacagccgccatgttgatataaacatataaatacagctccgattanatattttcgtactgttnttgatcacacggcagggacgcagtatatatcccccatggatctgcatagaaaaaagatgtgggtgtactttgtacgcacgtaagaagtatactttctatatatg

SEQ ID NO: 10252 - DNA, 733 bp, Diabrotica virgifera
  misc_feature (2)..(50): n is a, c, g, or t
  misc_feature (52)..(728): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 10253 - DNA, 950 bp, Diabrotica virgifera
  misc_feature (695)..(743): n is a, c, g, or t
attgctgcaggtcataatcagtaggctaatttctttgtagttttcattcactttttgaccttctttcttgtgaatagatataattattcttatgttccagttccttgtagttttacggatctccaaatcagttttagcaacctgtgcatacaactcttaaattttcctgttccgtgtgttagaagctcataaggaatccatctgactccatgaggaaagtttttacttgagccttgattagttcgtcttttgttgataagttatcttgtcttccatatcttgaagttgcagttcttatgttttatacagtgttatttttattatttgaccaattatttccaaacaatatcgaagaagaggtaaaagaccaaataatgaaagccagtagaacggccggatgcctaaacgacacaatttagaaaaacaaacacctaagattgaaaacaaaggcccggatatataagtcagttattaggccagttatgacttacacggccgaaacaagaccagatacaagcaaaacacgaagacatctggaaaccaacgaaatgaagatcttaagaaagatcgctggaaaggactacaggatggcaatggtaggcagttgaagcgtaacactggccctcttgccttccttttataccctatgtcctagatatagcagactgctatagtccctgctgcaaaagtagtannnnnnnnnnnnnnnnnnnnnnnnnnnnnnnnnnnnnnnnnnnnnnnnngaacagaaatccagaaaccaataaattttaaaaagttcgaagctttagttccgaagaactgaagacttttactggagccaagttctggtaatacctgtattcgtgctttctaatacttgcaaagcagaccaagaatgaattaaaagaagactagggaaaatataaaattgcatttcattacctgtctattcatctgggtaaacttct

SEQ ID NO: 10254 - DNA, 606 bp, Diabrotica virgifera
  misc_feature (187)..(443): n is a, c, g, or t
actgcttttgcgattccaaggatgtctgtgtaggtactttttttactgtcaatctatgtagtatatctgatcttccagtatcacaggagattagtttgaacaaaaaagaatgtgtgtgtactttgtgcgcacgtaagaagtgatacttttattatatgatttcaacgaaataaatatactttaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctaaaaaaaaacacaactacaccctccggggccggcgtgagaaaatctgtttagagggaaaaaaactttttctccgcgcatagttttttacaagcggggggggaaaaaaatacttgcatatctacactactactcattgtgatcgtcccccccctttcac

SEQ ID NO: 10255 - DNA, 955 bp, Diabrotica virgifera
  misc_feature (7)..(25): n is a, c, g, or t
  misc_feature (181)..(198): n is a, c, g, or t
  misc_feature (515)..(534): n is a, c, g, or t
  misc_feature (760)..(760): n is a, c, g, or t
aaaatannnnnnnnnnnnnnnnnnnagtttctcagtaaataaatataacatatcgtaaaggggaccagaagtgtaaagaatgtggtactgattatcttatatttatggaatatataactgtgggtgccgggacccttgataaccggacgagtcgtagagtacctaaagaaaatagttaacnnnnnnnnnnnnnnnnnnttgaatgacatgtattgtggttctcgttgagatccaatatagggcttttcaatgattgtcatttgttccgagcttctgtcatgttgtataatctgtgtatactagtaatatagacggattatacgacatatgatagaggctcgaaacaaatgagaagcgttgaaaagccctattgacaaacgatacaaatggcatgtgattctatatcaataaactacttgtcatgtgatcttttggtgaacccgtgtgctttctgctatattctaataaattgatatgacactaactaaaaatcatcctttttattaattgtagcnnnnnnnnnnnnnnnnnnnngcaaggcacttgaaccaaaaatgtattgataagtttgttgtatatttagtcgccaaacgctagcgtggacaaatgtcgttagttttttcataagattcgttggcctttttggcaataaccacagtaaaatatgccaaccgtttggctgttgttatacattatgttgtcacattagtgatgacgtcgcgttttttggcgatcttgattctaaacctatcatatctanatatggtatttctacgagatctaaagttcatttttactctctttgtgaataggtatatctgagatattatatagacaataaacatcttttttgctctgtaataaactcgttttggaaaggtgtacaccacattctcattttgttttatattatcataaggagtaataacatcctgataagtttaaatgaactact

SEQ ID NO: 10256 - DNA, 786 bp, Diabrotica virgifera
  misc_feature (61)..(79): n is a, c, g, or t
  misc_feature (148)..(168): n is a, c, g, or t
  misc_feature (173)..(204): n is a, c, g, or t
  misc_feature (268)..(297): n is a, c, g, or t
  misc_feature (364)..(398): n is a, c, g, or t
  misc_feature (411)..(434): n is a, c, g, or t
  misc_feature (451)..(467): n is a, c, g, or t
  misc_feature (489)..(508): n is a, c, g, or t
  misc_feature (510)..(526): n is a, c, g, or t
  misc_feature (640)..(667): n is a, c, g, or t
cgcacgcgtgggcggacgcgccgggcggacgcgccgggacctccttttttttaccataatnnnnnnnnnnnnnnnnnnnctaaagcaaaattttatataatcgatagctaattagcattgtgagagaatattcttattttaataacannnnnnnnnnnnnnnnnnnnnctgannnnnnnnnnnnnnnnnnnnnnnnnnnnnnnngtattattttccaatttaacagagctaaacaattaaaattctcattgtaaactaaatatcttannnnnnnnnnnnnnnnnnnnnnnnnnnnnntttttcaatatatctaaattttaaggaaataaattaagtttattcattaacattatatggataatcnnnnnnnnnnnnnnnnnnnnnnnnnnnnnnnnnnnggcatgatcttannnnnnnnnnnnnnnnnnnnnnnnctttgtaactaataatnnnnnnnnnnnnnnnnnatcatacttttaaagatatcgnnnnnnnnnnnnnnnnnnnncnnnnnnnnnnnnnnnnncctttatatgacgctgtattagaatataaatcacaattattaaaatctagcaatgatgataatattactattaaacaattgtatatattagtagaaacctataggttcaatacnnnnnnnnnnnnnnnnnnnnnnnnnnnncgtattatgaccgtgtctagttgtattaccgatggagtctcgtctgcccactgattaacttgaatgtacgcggtacctcgaccgcgctaaggtaccataatcatgagtacttttactgc

SEQ ID NO: 10257 - DNA, 521 bp, Diabrotica virgifera; identical to SEQ ID NO: 7280
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (484)..(515): n is a, c, g, or t

SEQ ID NO: 10258 - DNA, 966 bp, Diabrotica virgifera
  misc_feature (754)..(772): n is a, c, g, or t
  misc_feature (853)..(853): n is a, c, g, or t
  misc_feature (863)..(863): n is a, c, g, or t
  misc_feature (911)..(911): n is a, c, g, or t
  misc_feature (920)..(920): n is a, c, g, or t
aataacgtcgtaaaaatatactgatgaaacagtttgccaaaactagcagtgagttgggtgctggtgtgacgagcattttttgaacgaattttttaatataaaacagctccgtcatgaccatcgttgagcccagtgaaagacatggggtggaatatgtaccttacaatacggaaagtacagaaaagaataacctcgtccaactaaagcctcaaaaccaaggcgctaaatcggacacacctttcttaatcatgacaattctttcaggtactatgcttgccactattgccggatcccaaatggtgtggacgtcacccgtaatcccaaaaatcacctcaaacatctctgatgacaatcctttgggaagaacggcaacaacttacgaaatatcgatgattgctggttttccaccattagcatctcttgcgggatctttatttctgggacagttggcagaagtattcggaagaaaaaggtctatactgatcctggctttagggaatctcacaacagtagtttgcttggcatttagtaccaatgtatattgcattgtcgtgtttcgatgtataatatttatgttttttaacggagctataactgttacctgtttatttgacagaaatttgcgaagaccacaacagagcaaggtatggttgtttgatgggcggtatgctaccttcaggaagcctcttcggttacgtagtgggctcatttttcaccatcagagtatttactttattaacactaagtccattannnnnnnnnnnnnnnnnnngcgtatgtgcacccgagtctccagtctattccctatctagagggagaagagaagaatgtttacgcgctcttagaaagtaangaaagcatanaaatgacaaagaaattgaggatgatatgtaccaaatagaagaaacttntaagcttcngggcaaattcttctttctggtatatctttagcttatttctcacaaa

SEQ ID NO: 10259 - DNA, 629 bp, Diabrotica virgifera
  misc_feature (491)..(507): n is a, c, g, or t
gggcctcctgtgtggagaaacttcccttgaatatgtatctcttttattctaagatttgattgaccatattctgcatctatctttattctcacacctatacccgagggatattctaagacatgcatatctacatctctgacattgaacgcatagatgcaggaaagtctactactaccgattttcttgttgacatctgtggaggtatcgactacctttactactatacagatcgaaaaggaattccgaaagaagggaaaaggatccctatattatgcctgtgcactcaactatcttgatgtcgatagagaaagagatattaccccatctgttgttttgtgtataatcaatacaccttttaactaagataccctccttgatgcccctggacgcatagatgtcttctaaaaaatgatcactggaacttactacactgaatgagctgtactcattgttgcagctgtaactggtggattccccaccccaatttctannnnnnnnnnnnnnnnngtgcgtgctcttcttgctttaacccttgtacgacattttgtatttgttcgtgcctccgaaaaggactaccctgtaacggcattcttagagtcccgattcgaggaaaatcagaaagagatatc

SEQ ID NO: 10260 - DNA, 91 bp, Diabrotica virgifera
  misc_feature (9)..(87): n is a, c, g, or t
taaaaagcnnnnnnnnnnnnnnnnnnnnnnnnnnnnnnnnnnnnnnnnnnnnnnnnnnnnnnnnnnnnnnnnnnnnnnnnnnnnnnntata

SEQ ID NO: 10261 - DNA, 104 bp, Diabrotica virgifera
  misc_feature (6)..(6): n is a, c, g, or t
  misc_feature (9)..(63): n is a, c, g, or t
  misc_feature (65)..(97): n is a, c, g, or t
gcttanatnnnnnnnnnnnnnnnnnnnnnnnnnnnnnnnnnnnnnnnnnnnnnnnnnnnnnnngnnnnnnnnnnnnnnnnnnnnnnnnnnnnnnnnnttggggg

SEQ ID NO: 10262 - DNA, 935 bp, Diabrotica virgifera
  misc_feature (121)..(140): n is a, c, g, or t
  misc_feature (838)..(838): n is a, c, g, or t
cgaatttgcagtgaaactttaaactgaattaagagggaaaatcatttgattccatatataaagtgtagtcagtgtgtgtcatgtgttttcttacttaaaaatgaataatttcacatccatnnnnnnnnnnnnnnnnnnnngtcaaaaacaacgagttttagtagtatgttcacaaaaactaaccactaaatcagtagaacaaagagacagagctgttattgaagctgaaaaaattgtagggtatcctacatcctttttaaatttgcgatggctgcttaatgatgaagttgccaatattgcttcacatttgaagaagctaattggaacaaaacaccctttagtacacactgctagggaattacttttaaataaagaagttccatcatggggactaattgttctgttgatatcaaaagctggtggactgaggacaaaattttcccaccttgactgtgatataaatgcaggcattcttcatacccaaagagttcttgctgagataactgaaatggtccgcacaagtaacattatccacaaaagtgttctaaatataacaacagaagatgaatttcaagaagatcttcactttggtaataagctctcactcctgacaggtgactacctcctcagtaatagttttcgtgaactagcagccttgaaatgtcatcctgtcaatgaacttgtatctactgctcttagagatttggtggaagctacttttatagaacctagagacaaacaaaatagacctgttcctgcttcaccactctctgaacacaaaaaatgttagttccgcatgagtatgaaaaggatctccctacattgtctgatgttttgngaaatgcaaaagcagaatggactttgaggcatttgttagatggtgctagtttgttaggaaaatgttgtcaggcagctctaatgttagcggaccactc

SEQ ID NO: 10263 - DNA, 147 bp, Diabrotica virgifera
  misc_feature (8)..(45): n is a, c, g, or t
  misc_feature (74)..(74): n is a, c, g, or t
  misc_feature (119)..(119): n is a, c, g, or t
taacagcnnnnnnnnnnnnnnnnnnnnnnnnnnnnnnnnnnnnnngcggacctcgatgttgggatttaagtttnataattggtgtagcagtatattaattaagtctgttcgacttttanaatttacatgatctgagtttaaaccggg

SEQ ID NO: 10264 - DNA, 561 bp, Diabrotica virgifera
  misc_feature (2)..(17): n is a, c, g, or t
  misc_feature (19)..(57): n is a, c, g, or t
  misc_feature (65)..(239): n is a, c, g, or t
  misc_feature (281)..(353): n is a, c, g, or t
  misc_feature (383)..(402): n is a, c, g, or t
  misc_feature (412)..(430): n is a, c, g, or t
  misc_feature (441)..(484): n is a, c, g, or t
  misc_feature (491)..(531): n is a, c, g, or t
cnnnnnnnnnnnnnnnncnnnnnnnnnnnnnnnnnnnnnnnnnnnnnnnnnnnnnnncattaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttattaacatttaatttttaaatacaaattaagatcnnnnnnnnnnnnnnnnnnnnnnnnnnnnnnnnnnnnnnnnnnnnnnnnnnnnnnnnnnnnnnnnnnnnnnnnncattaacatataaatctagattatttaacnnnnnnnnnnnnnnnnnnnncactattagnnnnnnnnnnnnnnnnnnngaatatatacnnnnnnnnnnnnnnnnnnnnnnnnnnnnnnnnnnnnnnnnnnnncacaccnnnnnnnnnnnnnnnnnnnnnnnnnnnnnnnnnnnnnnnnnataatttgaatgtgcgcgctattttgaccg

SEQ ID NO: 10265 - DNA, 887 bp, Diabrotica virgifera
  misc_feature (750)..(750): n is a, c, g, or t
  misc_feature (792)..(792): n is a, c, g, or t
  misc_feature (814)..(814): n is a, c, g, or t
  misc_feature (824)..(824): n is a, c, g, or t
  misc_feature (856)..(856): n is a, c, g, or t
ggattgtatcgaactactcggacgagaaactggactttagcgatcccagtaattaccgagacctgtcgaaacctgtgggtgccttaaacgaagtccgtcttaaccgattactagagaggtatcaagaaatgaccatcaacaaatttttgtacggctcccattattctacaccgggatttgtgctttactacctagcgaggctatatccccattatgtcttatgtttgcagagtggtcggtttgatcatccggatcgtatgtttaactcggtggccgacgcttacaagaattgtttgaataatatgtcagattttaaggaactaataccacaattttatgatataaacgaccagggaaaatttttagtaaataacatgggaatcaactttggatatagatataataatctaaaagtggacaacgtggaattaccgccttgggcgagcagccccaaagactttattaacaaactaagagatgcgttggagagcgaaatcgtttcggaaaacctgcataagtggatcgatttgatcttcgggtataagcaaaaaggagaacgtgctatacaggctcacaacttattctaccatctttgcgaaggcgcaatcgatttggacgccatttcggatctaaacgagagacatgctctagaagttcaaataatggagttcggacaaattccaaaacaagtatttcgagttcctcatccacaaagaaagactggtctcactcttatgacagaaccacttncactgaaaccgatcgaactaagctttgaagatacatggaaancagctagtgaacttgaactgantactagcttntactcacacaaaaattcagttagccacctggntcataacgaggatggtgaacgtataacttcc

SEQ ID NO: 10266 - DNA, 382 bp, Diabrotica virgifera
  misc_feature (2)..(310): n is a, c, g, or t
  misc_feature (317)..(317): n is a, c, g, or t
  misc_feature (327)..(328): n is a, c, g, or t
  misc_feature (345)..(346): n is a, c, g, or t
  misc_feature (352)..(352): n is a, c, g, or t
  misc_feature (358)..(359): n is a, c, g, or t
  misc_feature (369)..(369): n is a, c, g, or t
  misc_feature (375)..(375): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaataanattttattannatttaattttttaatannaattangattannaattttcatnatttanatatggt

SEQ ID NO: 10267 - DNA, 121 bp, Diabrotica virgifera
  misc_feature (91)..(91): n is a, c, g, or t
  misc_feature (104)..(104): n is a, c, g, or t
cctccctacacacgccctctcaaaacgcttcaaatgtcgcccaacgtcgcgaggccgactcatttttctgcctccttcagtatccagtagntgtcttgtccagntgaatgcttcaaatggc

SEQ ID NO: 10268 - DNA, 222 bp, Diabrotica virgifera
gtctaaagcctgtaaaaataattggttctttaggtactcgcaatcccacatccagtacgatctctgttggatgtgatagatatccattcacgccgatagaagacgttttctctatacgacacttcgggatattcttgtatgagggtacttgatatgataatgagtattgacttagtatagtcagtatataactagacagattaagtgtccgttgtacctgtt

SEQ ID NO: 10269 - DNA, 949 bp, Diabrotica virgifera
  misc_feature (761)..(761): n is a, c, g, or t
attcatctctgtacaagaaatctttagcattttactatttcctttcccaaataaaatagtaaattgtataaaatcccacaaggaaatagcttcagaacaatatgttgtttcacgcattttgatctgttctgctatttatgctccaaataggattagctgagacagtatatatagtgatagtctgctgattttgtcacttgaaacacgcatcaaatagtttgaacaccctgtttgtctatcacatatttgttgagaaatattcttgtgaaatgagatggtttcctgatcaataaaattaattgttgtgttgtaaatgttagaccattattacatcagtatttgattttgaatatacacacgttgaaatagtaattctttaaaaattgtctgcgtctttaatagtttcacgatatgatgtcatcgattcttaatttaaatgcatcaattattgtgcttgcgcatattacttcataattttcaaatcaaaatattccgaaaacagtatcgagttttaccaagagtacctttttggtgtaaaagtgtttgatgtttaagttcaattttaaagtttgattaattctacccttaaaaagttatgttgaataatacttggtacgaaccatgtaactagcgccctctatgagagtcagatataaaaacaaattcatggtatgtattagctataaaaattttttactaagcaaaccccaattatttttcagttttttacctctccagagacggtgttaccttttttttanacatcccatatatccaaaaatatatctacctatactctgtcccactttgactttacagtataaggaacatttttaggaacatcaccgcgctaaaatgctcataagtctgcattgccctatgtcccctatactgtgaagtcattgtggggacggagtatagacatctggggtgatgcatttaaaaatat

SEQ ID NO: 10270 - DNA, 585 bp, Diabrotica virgifera
  misc_feature (135)..(160): n is a, c, g, or t
  misc_feature (298)..(323): n is a, c, g, or t
cgtcaactcccattcctttcagtttgtcccatgagacatcatcttgcggattatcgtatttacttgtctagagaacaatatactcttatacaagatcttagtcttatttgttagatctggatccgtcgagtatgnnnnnnnnnnnnnnnnnnnnnnnnnnactgactatattcagtagagcaataaaattcctgattgtatggtgtacctgttatataagtataatcgtatgggaaaggtagtcgctttccctcatatcggatatctctattttttaagatatatggtcgtctctatnnnnnnnnnnnnnnnnnnnnnnnnnnctatgtttagtattatttctattttaagggtcgacctcaatgatactcactgtactagagatttattatgttcatgactgattcaatatctgatattgctctatacttattctgccattgttacgaatcacgcttacagtcctgattatatatattgtcattgcttttttatatagacactttattattagatattttacctgtattgatgtagatattcgtcatgttaaaaatattaagaattaggaaagtgatgtttttc

SEQ ID NO: 10271 - DNA, 114 bp, Diabrotica virgifera
  misc_feature (29)..(29): n is a, c, g, or t
  misc_feature (40)..(40): n is a, c, g, or t
  misc_feature (57)..(57): n is a, c, g, or t
  misc_feature (79)..(101): n is a, c, g, or t
  misc_feature (103)..(103): n is a, c, g, or t
  misc_feature (112)..(112): n is a, c, g, or t
taacagcgtaattttattggagagttcanatcgataatanagattgcgacctcgatngtggattaagtttataattggnnnnnnnnnnnnnnnnnnnnnnntngtcgacttnta

SEQ ID NO: 10272 - DNA, 729 bp, Diabrotica virgifera
  misc_feature (2)..(52): n is a, c, g, or t
  misc_feature (54)..(281): n is a, c, g, or t
  misc_feature (286)..(666): n is a, c, g, or t
  misc_feature (678)..(706): n is a, c, g, or t
  misc_feature (712)..(713): n is a, c, g, or t
cnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggatgannnnnnnnnnnnnnnnnnnnnnnnnnnnngaattnntatttttagtaaaaag

SEQ ID NO: 10273 - DNA, 841 bp, Diabrotica virgifera
  misc_feature (620)..(642): n is a, c, g, or t
  misc_feature (687)..(687): n is a, c, g, or t
  misc_feature (758)..(831): n is a, c, g, or t
cctgggccgaactgatccttcgggaatatggaaaactccatgtctctttcattggcatttagagatcaacaccctgaagagtttagagacttatgtagacgttttccaaatatccactctatatttgccgcccagaatgatatgcatgaatacgtggaaagtagaatagaagagatggtgaatgtcctcaaaaccaatggagatgtagaactcagtgtacggctgcaagctgaattagaagatggatttaaaattgaagatgacgagattcgtgcagtagatgagcagtatgttatatgtcatggagacaattggaacaataattacatgtttaagtattcagcagataacggctgccaaatccccaattcagtaatgcttttagactggcaactctccggcattagatctcctgctcaggacctatcgaacttcctattcctcacttgttcccaaaaagaactagatcaactagaaaaccttctacacatataccacgacgcccttacagatcgtctcaaacttctaggaagctcaacaaacctatttacttttgacgatttgaagagacattggaaagagcattcatcgtctggacttctcagtatggtcatcgattnnnnnnnnnnnnnnnnnnnnnnncaagattctgatgttatggaaagtgcggagattttgttttatcanagagcaaaagcagcggtttcaacttattttaaatatcaagaaatatttttgataaatgatttgtatttcannnnnnnnnnnnnnnnnnnnnnnnnnnnnnnnnnnnnnnnnnnnnnnnnnnnnnnnnnnnnnnnnnnnnnnnnngctctaaagg

SEQ ID NO: 10274 - DNA, 266 bp, Diabrotica virgifera
  misc_feature (2)..(91): n is a, c, g, or t
  misc_feature (93)..(136): n is a, c, g, or t
  misc_feature (138)..(256): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatagagtt

SEQ ID NO: 10275 - DNA, 765 bp, Diabrotica virgifera
  misc_feature (12)..(43): n is a, c, g, or t
  misc_feature (48)..(644): n is a, c, g, or t
  misc_feature (646)..(764): n is a, c, g, or t
ccttctcgtccnnnnnnnnnnnnnnnnnnnnnnnnnnnnnnnncaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 10276 - DNA, 469 bp, Diabrotica virgifera
  misc_feature (10)..(206): n is a, c, g, or t
ttgcgttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcattatttgaggatatgcgtatgtagtaatgcggggctaagactcttatttggacaaagatttagataatctagataaaggtgctgggttgaaattatgtaactcaaattgaaagagtctcgttgccatcggaagcgggagcgaaggaccggttaaattcgcaactcttggtgaatcaacctctcttagatctacatttatacaaaaggctttacgatattgacagaagcctgattgggatggaatagatttcgattgt

SEQ ID NO: 10277 - DNA, 268 bp, Diabrotica virgifera
  misc_feature (2)..(124): n is a, c, g, or t
  misc_feature (126)..(185): n is a, c, g, or t
  misc_feature (193)..(223): n is a, c, g, or t
  misc_feature (225)..(253): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnccctatannnnnnnnnnnnnnnnnnnnnnnnnnnnnnncnnnnnnnnnnnnnnnnnnnnnnnnnnnnncaattggggaaggat

SEQ ID NO: 10278 - DNA, 897 bp, Diabrotica virgifera
  misc_feature (109)..(125): n is a, c, g, or t
  misc_feature (598)..(612): n is a, c, g, or t
  misc_feature (750)..(767): n is a, c, g, or t
  misc_feature (839)..(871): n is a, c, g, or t
tttacgtccgaacagacctgatgagttctcctgacagtggcatattcagttacaacaccatgtgttctcaagatagcggctacatcagtcaatcatttagtgtagaatnnnnnnnnnnnnnnnnnagtcagccacccagtcctgacgccgaattagatcgagtattggcaaaatttgaagaagctgccacaaatgaaccatattatttattagaatctacctatccaatgagctctttcaacatcaaaattggattatctccagctcgagatttttcaccatccatcatgctgtatcgtcatggtacttgtaacaaaatcagtttacacacaaacgagtgggcaaccataattgagtggcttaaagaaagactggttgattttttccaagcagacctacctacttttgccgatgagtatgaccccatcgaattaaagtgcggtgatttctacacactacgacaattggtgatggagaatgtaaagttagtaaccattgagaaatttggagtcgaatattacttatgggaaggagaggtcaatcaaattctagaagcagaccagagcatgatgtcccataaagtgatgctgttgaagannnnnnnnnnnnnnnaatactatataaacctttcaactttcattaagaaaaatttgtatgtcaaagaccctttgtatgggccagttgaagcctttaacgcatattgcgctatttgtccagatactttgttaagtttagctttaagagaatatnnnnnnnnnnnnnnnnnntagacttgtaaatgatttaacagattgcatctaaaaaataaatggggttatttaataaaacccaaatatatnnnnnnnnnnnnnnnnnnnnnnnnnnnnnnnnncacaaaaaaccaacccacaaaacagg

SEQ ID NO: 10279 - DNA, 896 bp, Diabrotica virgifera
  misc_feature (862)..(863): n is a, c, g, or t
ttacgtccgagcatccagcagttatgaacatttggtagcagttgaacataagatgtgtcagcatatttaaaaaattatacatacatatcaagtaccttgagataaaccttaacaaaaataagttcaaatcaaattaattttaacgaaattgtctaaaacatatctacaatcctatcatatcaaaaaatatctatcaactatcacttacattgcaggaaatatgaaaaaactttgccaacaggaatcactagcgtcttttcttttggcaacgatttggcaacattgtatttgttgcaaatgtttgaatctccgagatcaattactccaatcaagaatatcatcatcatacatataagcgctaaattatagtactagtttaaggccaatttatatattttattccgtatcaaaatgtaggacttaggcccttcgtccacctccacaacacaactacaactcgactgtgatgcaacttccgccaccaacgtgactgatttgcaatcagttatgttcaagatgtcgagcagttcagatgacgatgtcgttgtaatggtaacaggaaaaattaaaaggaaacaaaatcggtggacccatccttaaataggaaacatcaaaaatagacgagtttttacagcagcgaaggaattggagaaggacgagaagaagtttctctgaactatagaagaaatactttgccatacatagcaaaaagggatacgaactataggaaaagggtcagtgtagaagaaaattataattgtacaggcaggcactgcgttgcagtgacgttggtaagcggactttgtacttaaagcacatgtccgacacctagttgaccgtgtagcaactataacgtgactannagtgcagccgagtttgcgggcggtggacgaaga

SEQ ID NO: 10280 - DNA, 1170 bp, Diabrotica virgifera
  misc_feature (90)..(90): n is a, c, g, or t
  misc_feature (109)..(109): n is a, c, g, or t
  misc_feature (698)..(715): n is a, c, g, or t
  misc_feature (737)..(754): n is a, c, g, or t
  misc_feature (761)..(781): n is a, c, g, or t
  misc_feature (873)..(906): n is a, c, g, or t
  misc_feature (909)..(938): n is a, c, g, or t
  misc_feature (940)..(984): n is a, c, g, or t
  misc_feature (986)..(1005): n is a, c, g, or t
  misc_feature (1044)..(1169): n is a, c, g, or t
cttactggggcgttggagtcttcttgggattgggagattatatcttttatgaggaatagtaaaagagaaatgatatgtgggtgtatgggnaaaaaggtagttaatttanagtgtagatcccgttgtagagggtgaaatttttatattgtagatattgattatagaatttatgtaaattgtggtttttattttggattttaagatgagagatatttatgaaaaagaagtagagagtttttgggtagagattattgttatagaagttttaattttattagtttaagataaaaattatttatgttaatttggggtattatgtaattttagggattaattagaaagtgtattgttaatttttaagatatatatgatgtggaatagtagaggaagtaaaaaatatatgaaagtatatatatagtttttatttttgtataagttagtaaatttattatggttaatataattaattatgattaataatttagagtggttaaatggaaagtataatataaaatattacaaagttgagattgtaaatttcttagtagtgtccgttgttgtattagctgtacgatctaaaaggatcctacactgtaaataacagaatatggatacgaaagctcaaattattttctgcgtcacttctgaactagcagcacccaacagtattatgaaaattaaatgttattagtgatgannnnnnnnnnnnnnnnnntagtttgggaagtattgataannnnnnnnnnnnnnnnnntataggnnnnnnnnnnnnnnnnnnnnngaaagataatcggatttaaaggagttataagtgggaaattattatatgttaaatagaatatagaaagttttggttttagggggtatatatgnnnnnnnnnnnnnnnnnnnnnnnnnnnnnnnnnnagnnnnnnnnnnnnnnnnnnnnnnnnnnnnnngnnnnnnnnnnnnnnnnnnnnnnnnnnnnnnnnnnnnnnnnnnnnngnnnnnnnnnnnnnnnnnnnnatgtataaaattataatttattaagggagatatataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 10281 - DNA, 883 bp, Diabrotica virgifera
  misc_feature (35)..(58): n is a, c, g, or t
  misc_feature (139)..(158): n is a, c, g, or t
  misc_feature (386)..(403): n is a, c, g, or t
  misc_feature (725)..(725): n is a, c, g, or t
  misc_feature (748)..(748): n is a, c, g, or t
tttctcgtccggataattgtcaaggccatagtccnnnnnnnnnnnnnnnnnnnnnnnnaagattcaggttatgttatgaaaacgtcaacaattgtatgtagtaaataaaattagttattaaaatgcagtactgcaagcnnnnnnnnnnnnnnnnnnnnaacctttatataataatggcatatcatatcaatattgtggagcaatatataatttttctgcttcattgacagaaggtatgaaatatacgtcaatttgacaatttcaattgacaatatgaattatttaagatagttgcaatatttctccgcgactcgcgcagggtcgtttctcgtttccccttccaagtacttgcacaccacgaataccacccaccgttgagataaagnnnnnnnnnnnnnnnnnngaagttattgcacaattttttctgaaaaatttcagaatgtgacctctcacatccccctcaaaacagatccgccctggtctaactctgttagggactctaagacgccaagatattcggtgtccagttttttaagtagtataggccacaagaacggaaacctaaacttggtagtgatctttagttattaacaattacagttcggaaagtatatctttggaacttgttgaaagattttgatgtttcttgttgcatctgtatctaattactcttcgcgtacattaaaatatagtttattgttaaacaagacatgtaatgtgtttanatatttttgaaaaacatttttanattcattattttaatagaacactttgtatattggcgtaacgcatactaaaacatgtgcacgacaaaatcaaataatctgcactttgagcttcacccagtttttaaaatacataataatgcatttttaacatcatt

SEQ ID NO: 10282 - DNA, 1012 bp, Diabrotica virgifera
  misc_feature (10)..(805): n is a, c, g, or t
  misc_feature (811)..(994): n is a, c, g, or t
ttgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaataaattaccttagg

SEQ ID NO: 10283 - DNA, 445 bp, Diabrotica virgifera
  misc_feature (10)..(40): n is a, c, g, or t
  misc_feature (43)..(246): n is a, c, g, or t
  misc_feature (253)..(290): n is a, c, g, or t
  misc_feature (310)..(323): n is a, c, g, or t
  misc_feature (326)..(348): n is a, c, g, or t
  misc_feature (356)..(378): n is a, c, g, or t
  misc_feature (408)..(439): n is a, c, g, or t
taacggccgnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10284 - DNA, 924 bp, Diabrotica virgifera
  misc_feature (790)..(790): n is a, c, g, or t
  misc_feature (843)..(843): n is a, c, g, or t
cacaaacgtaacattttgataattttttagcgcctaattgtgaaatgccacattccaaaaagtaaaatgaatttccgaaaataatatgaaatcttgaaaattcgaacacaatatatttttgaggcagcaaaacttgaggttgaatactcgaaaataacatgaacacaactattccagaaataataagcagcagttccattccgataagaaatagagccgggtttgagaccatagctgtgatcttaccatcatttttctactcattaataatcgttgtattggaaacgtatatctcgctgaagacgtcatctaaatttgtcttagaattagccaccatagttttaccaataacattaggaatgacgctcttatcagaatattcaaatctaatgataggagtgctgagtatgttgagcgccctgttattgggtgtctcttacaaaaaaagaacgagcaccaagaagtctgattcattccatactagttttatcaccaattctagatctactattaacattttatctgtgatagctatattagccgttgatttcgacatatttccgtctagatttacaaaaatggacaccttgggatacagcctgatggacaccggcgttggcctctacgtcttcgctaacggcatcgtgtcaccggagtctcggggggtaaaaaaccccatctccaagtcaataaaaggttcattacctctgtttttgataggtagcgccagattcgtacttaccaaactcttccactaccacctccctgagggggagtacggagtacactnggaatttttttataactctagctgtcaccaaactgttcacttcgttccttctncacgtttttagtatttagaaatatttatgttaatgctacgatgctaacctagcacaccagatattactagtgtgcggacta

SEQ ID NO: 10285 - DNA, 763 bp, Diabrotica virgifera
  misc_feature (15)..(15): n is a, c, g, or t
  misc_feature (24)..(24): n is a, c, g, or t
  misc_feature (27)..(28): n is a, c, g, or t
  misc_feature (35)..(36): n is a, c, g, or t
  misc_feature (40)..(40): n is a, c, g, or t
  misc_feature (167)..(186): n is a, c, g, or t
  misc_feature (464)..(481): n is a, c, g, or t
  misc_feature (543)..(560): n is a, c, g, or t
  misc_feature (729)..(746): n is a, c, g, or t
cccttaaggccgagnaatatatgnatnnatatagnngggnacacttttatctaagaaaaactatctgttaagtgtttgtaaaaagtacatttacgctactatattgtacatagaaactcataatttttagaagtcgagaatattcatgaaaattataagaaaaatgnnnnnnnnnnnnnnnnnnnnttatttacattcacacaacaaattctcaactttaaatctaagcgagaatgttccataaaacagagaaaagacataagattttttgttattacaaaatacgctttatggttatcaagagaaaaataaaaaatagaactaaaaaaataaaagaattgagaaaaataagtgaagtagaaatgacgaaaagtatgtcgatattaacctttggaagaccaaggtaaatcaattttgacctcgacgtataatttcttcaatagactgagaacaatttttaactnnnnnnnnnnnnnnnnnngactctaatctcattgtagataccctcatttgccgtaataaaaaaattccctatatttcacnnnnnnnnnnnnnnnnnngaatttggggtcaaaagatttggcctttcaatttccaactttatggaaagaactataccgcctattatgtgaaatttccgagtaattttgaactgtgaattatcaaatttatttaccatgatatagataaatattattatgaagaccacgaaaaatcctttcgaagtgnnnnnnnnnnnnnnnnnntttgacaacttgaagtt

SEQ ID NO: 10286 - DNA, 922 bp, Diabrotica virgifera
  misc_feature (674)..(692): n is a, c, g, or t
  misc_feature (736)..(751): n is a, c, g, or t
  misc_feature (765)..(765): n is a, c, g, or t
tataggccggaactagttcgattcctttttgatgagctaccgtaagatatggtgtaagagcatcacgaattcattataaacaaaaacacagaattcttaattcttgtggaatcaacaacaacgaacaacccgcttagcgcttgcgcttgtgtaccacgtgaaaatgatcgaccaatcactatcgaaagcgaaacgaaacgcaagccaaaagttatcgctttcgctttgtaatcggcttcgtgatctgcttctccggttcttcccgaattagcttacagaatagcaaaccgtcggataacgaacgtaattgtttcgcgttgatcttatagaatcggtccactgatagcctcaaagatagttactgaaaaagcaattaaggaatcaaaagtgctttcaatgatgctcttaagtcaaaggtgaaatattcggttgacccaaatgatatacacatctattatataattaaaaacacgttttcctggactttatcaacttatatttcatataaactctttcaaacgaaacctgattatcccagatttgtccaaacttatctacaattacattgagctaccataggcttaatcaatcatttaggtaaaaattctgagtacaaattgaagtgaaactaaatgaaacatatagcggaaagctatatatcgtagactaaaagnnnnnnnnnnnnnnnnnnnaaactaagtctactatcaactagcaaagaagtaaaatatttgannnnnnnnnnnnnnnntcaacccaacatanatattgaagtacatcgagacaactatatgtcttgtttgagctaactgaagattggataaatgattaagtaaacagatattgtatggtatatagcacgggatttctttgttgatttgttaaatcaaagataatgtatttgaatccatgatatatactc

SEQ ID NO: 10287 - DNA, 825 bp, Diabrotica virgifera
  misc_feature (625)..(650): n is a, c, g, or t
ttgcgtccgcccactcgacttgtgataaataccagagagccattgtgatgaaactatctgtcatctgccaacggtattgtgcgaacacactatactccatgaaccccttctgaggagttagtaaccaggatacatgatcactattcctgatgacagaaacaaaaaccattctcaacaaaagtttcctcaatgccaacatgtatttactgactgatatcaatggtgaactaccttgaagatgagaaaatatcacgaatatgtcgcattcactatttgtgatcctagctcgtgctgagatcgattccatctccaatatggacactccatacctgtccatgttatctgaatcacctggaggtgagcgtgtcttcggagatagactatagtccagactgcaaagacagcatttatttagttatgcccaaagtaccgatgatcctgtgcgcattcgacctcctattatgattagctgctctagagatcatttcaaggatgctctattgagagatctctcgttatgccaaggtctggttcccagatcgtatcaagatctatgtatcataaaagtggtgattcaccttccatgcgcgtgaacaatatgaacacttaaaacaacgaggtatannnnnnnnnnnnnnnnnnnnnnnnnnatataggacacagtacaaacctttgccataatgtaaaaacgtttaagacgatattcatgttcaggcccatttttgccaatagataattctgaaatatctttataaatatagcttttttaccaggttttgccagacaaggtattaaaagtagaagatcagaagagttatttatacc

SEQ ID NO: 10288 - DNA, 96 bp, Diabrotica virgifera
  misc_feature (2)..(90): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagg

SEQ ID NO: 10289 - DNA, 342 bp, Diabrotica virgifera
  misc_feature (29)..(47): n is a, c, g, or t
  misc_feature (54)..(71): n is a, c, g, or t
  misc_feature (74)..(74): n is a, c, g, or t
  misc_feature (110)..(111): n is a, c, g, or t
  misc_feature (122)..(122): n is a, c, g, or t
  misc_feature (212)..(240): n is a, c, g, or t
  misc_feature (287)..(305): n is a, c, g, or t
cccgcctatcaagggggaaagagaaagannnnnnnnnnnnnnnnnnngcctttnnnnnnnnnnnnnnnnnnganaagaaagaaagaaaaggaggaggggaaaaaagaagnnaaaaagaaagnaggggaaggaggaaagagaagagaggagagaaaggaaggagaaggagaaaaagagaaaaaagggagagaggaagaggaaaaaaaggaagnnnnnnnnnnnnnnnnnnnnnnnnnnnnngaaggagagaaggaaggaaaagggaagaggaagaaaaaagggaaagnnnnnnnnnnnnnnnnnnnggaagggggagaagagggaaagaaagaggggggaaag

SEQ ID NO: 10290 - DNA, 929 bp, Diabrotica virgifera
  misc_feature (51)..(65): n is a, c, g, or t
  misc_feature (68)..(80): n is a, c, g, or t
  misc_feature (728)..(748): n is a, c, g, or t
ttctcgtccgacttgttcctacaaatgaaataagaagagtaattttattannnnnnnnnnnnnnntgnnnnnnnnnnnnngttattccaacttaaaaataagttattcaacttaaaacgttgtggcaattgtgtatgattgtaaagtaaagacaatcaattgttgtttttatgtattcacaatgagtttcttgtttggaagtcgttcgtcaaaaacatttaaaccaaagaaaaatataccagaaggaacccatcagtatgagttgatgaaacatgctgctgctacgttgggatcaggaaacttaagattagctgtgatgctgccagagggcgaagacttaaacgaatgggtagcagtgaatactgtggacttctttaatcaaattaatatgctttatggaacaataaccgaattttgtacagaggacagctgtcctataatgtctgccggaccaaaatatgaataccattgggcagatggtcatacagttaagaaacccattaaatgttcagcaccaaagtatattgactatttaatgacttgggtccaggaccaactagatgatgaaacattatttccatcaaaaataggtgttccatttccaaaaaattttcaatccatcgctaagactattctgaagaggctgttcagagtgtacgcgcatatataccaccaacattttagcgaagtggtgcaattgggagaagaggcacatttgaatacatcannnnnnnnnnnnnnnnnnnnngttcaggaattcagtttgattgaccgcagggagctggctcccctacaagaattgatcgacaagctaaccgcgaaagagactcgattgaataatctaagcttaataggatctatatacctctgccttgtatttaatttgactcgggtgatcccttttgcgctaagaaaaaacctaacaaggg

SEQ ID NO: 10291 - DNA, 747 bp, Diabrotica virgifera
  misc_feature (2)..(44): n is a, c, g, or t
  misc_feature (52)..(740): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttt

SEQ ID NO: 10292 - DNA, 509 bp, Diabrotica virgifera
  misc_feature (7)..(25): n is a, c, g, or t
  misc_feature (234)..(261): n is a, c, g, or t
  misc_feature (296)..(327): n is a, c, g, or t
  misc_feature (373)..(398): n is a, c, g, or t
  misc_feature (400)..(421): n is a, c, g, or t
  misc_feature (423)..(480): n is a, c, g, or t
atttatnnnnnnnnnnnnnnnnnnnctctctctctcgtaaatgtaaagaaaaatcttcacccaacgatagttaatctagtatcgtcgagatgaacacctcacttttctaaaagaaaaaatctctcacttttcgtacctcgtgtatcagggatctactcaatctcaatcaattcatcatcacctcttcactttcgaatttcaaaagagctcaaaaaatctcaaaatttttcttcnnnnnnnnnnnnnnnnnnnnnnnnnnnncgtaatcgaaacgttattcgtttttcaaatcatcnnnnnnnnnnnnnnnnnnnnnnnnnnnnnnnncttatctcaacaatatatcttatcaattaaatatttttcatcatcnnnnnnnnnnnnnnnnnnnnnnnnnncnnnnnnnnnnnnnnnnnnnnnncnnnnnnnnnnnnnnnnnnnnnnnnnnnnnnnnnnnnnnnnnnnnnnnnnnnnnnnnnngttattatcttatttttatcatatctatc

SEQ ID NO: 10293 - DNA, 617 bp, Diabrotica virgifera
  misc_feature (5)..(76): n is a, c, g, or t
  misc_feature (78)..(108): n is a, c, g, or t
  misc_feature (278)..(312): n is a, c, g, or t
  misc_feature (370)..(388): n is a, c, g, or t
  misc_feature (538)..(562): n is a, c, g, or t
caggnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnntcctacaaaggtaccatgttaatcccggggggggggggaataaaaatctattcatgatggcccccaaattaatacccgtgggccggttttttatatggtgggtgatggaaaaccccgggtttctacccaattgacccgccgtggaaccctcccccctttcccctgttggnnnnnnnnnnnnnnnnnnnnnnnnnnnnnnnnnnnacaaaatatgtacactttaagggtgtaatgggactccccctgaagggtgtgcttgaannnnnnnnnnnnnnnnnnnttcccgcaagggaaccttaacatttggaaggcccttaaccccccccctatttctttttttccctttattttacacagagatagtcggttttccccgttaaattaaaaacgggggggcccctttaggggaatgatttagcgatactcgcannnnnnnnnnnnnnnnnnnnnnnnngggggtggtatcccagctaggcccccccacctgaaaactgtttcttccccttttt

SEQ ID NO: 10294 - DNA, 52 bp, Diabrotica virgifera
  misc_feature (2)..(15): n is a, c, g, or t
gnnnnnnnnnnnnnncgctgtagaatacgtttttataagattttaatttatc

SEQ ID NO: 10295 - DNA, 885 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(233): n is a, c, g, or t
  misc_feature (235)..(271): n is a, c, g, or t
  misc_feature (286)..(316): n is a, c, g, or t
  misc_feature (341)..(396): n is a, c, g, or t
  misc_feature (410)..(426): n is a, c, g, or t
  misc_feature (428)..(449): n is a, c, g, or t
  misc_feature (457)..(476): n is a, c, g, or t
  misc_feature (557)..(576): n is a, c, g, or t
  misc_feature (597)..(614): n is a, c, g, or t
  misc_feature (622)..(669): n is a, c, g, or t
  misc_feature (691)..(717): n is a, c, g, or t
  misc_feature (736)..(757): n is a, c, g, or t
  misc_feature (821)..(840): n is a, c, g, or t
  misc_feature (849)..(866): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnngnnnnnnnnnnnnnnnnnnnnnnnnnnnnnnnnnnnnngaaatatgtaggtcnnnnnnnnnnnnnnnnnnnnnnnnnnnnnnngtgcttattaaaagcatgactttgnnnnnnnnnnnnnnnnnnnnnnnnnnnnnnnnnnnnnnnnnnnnnnnnnnnnnnnngtgaccgtgctatnnnnnnnnnnnnnnnnncnnnnnnnnnnnnnnnnnnnnnngaaggagnnnnnnnnnnnnnnnnnnnncgttatttaattgacaaggaatttgattttttgaggtaaaagagttaaagttttttataagagagaaaagccaacagagcnnnnnnnnnnnnnnnnnnnnggttttatgttaaaataggtnnnnnnnnnnnnnnnnnngtgggggnnnnnnnnnnnnnnnnnnnnnnnnnnnnnnnnnnnnnnnnnnnnnnnngtttggaccaaatcttttgtgnnnnnnnnnnnnnnnnnnnnnnnnnnncaggggggttttttgtgcnnnnnnnnnnnnnnnnnnnnnngggcccccccaacggggcctaaagttttataaagggggggggcgacctatttgacgtggtgccnnnnnnnnnnnnnnnnnnnngggaaaagnnnnnnnnnnnnnnnnnngggttttccttcttttttt

SEQ ID NO: 10296 - DNA, 803 bp, Diabrotica virgifera
  misc_feature (10)..(53): n is a, c, g, or t
  misc_feature (55)..(97): n is a, c, g, or t
  misc_feature (105)..(143): n is a, c, g, or t
  misc_feature (145)..(604): n is a, c, g, or t
  misc_feature (606)..(637): n is a, c, g, or t
  misc_feature (646)..(728): n is a, c, g, or t
  misc_feature (730)..(796): n is a, c, g, or t
atctttttcnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnatttttt

SEQ ID NO: 10297 - DNA, 56 bp, Diabrotica virgifera
  misc_feature (3)..(3): n is a, c, g, or t
  misc_feature (37)..(38): n is a, c, g, or t
tanattaccttagggataacagcgtaattttattggnnagagtcaatcgataataa

SEQ ID NO: 10298 - DNA, 632 bp, Diabrotica virgifera
atcctagtcattgcccttattgtgatctctatttgacatcataagagacttctaatattgaacgatatttaatgaaacccatagcaaaactaactaatttatagaagacaaacttctattctttgtatcccgagactacctcataataatctaggaactcaatgttaataatatactgaataagaaaactactacttgactgtttctattgcaccaattgtatccatagctagaattccttgctatgatgtgccattcgatggttaacatatccaatctatccttaattgcataacacttattcaataccaatgtactaactgtaaaatattttgattgtatagatattgacgatttgttagtcataaatttaggactgagagtatcttgctgttctttcattaccaccgaatccctctaaggacttctcatcttccacaatatgcaacgtagttcctctcatagattattattgttatactgtagaacttctttatatgctgattgaaacagatgattgatgactaatgccgataactatgttaaacaccatgaaattctcttactaatctcaataagattacaccgatagagatgatcgctgccataatgttcacaacgaaacactctct

SEQ ID NO: 10299 - DNA, 146 bp, Diabrotica virgifera
  misc_feature (2)..(48): n is a, c, g, or t
  misc_feature (50)..(95): n is a, c, g, or t
cnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnntccgcgcacatctgtgacagtgctaacggaatgtaatcactactgtctgta

SEQ ID NO: 10300 - DNA, 193 bp, Diabrotica virgifera
agacgtggtatctgcatattttttattgatcctattgcaagatgttatctgatgcttgacaattagtatggtgatagatgattatatcagtatagtttaatacattctgtaaagtcactccgctatccagatatcattgtgttagtcatctaatctattgctgctactgctcgtgatgattgtgaatgtgtac

SEQ ID NO: 10301 - DNA, 313 bp, Diabrotica virgifera
  misc_feature (9)..(44): n is a, c, g, or t
  misc_feature (46)..(117): n is a, c, g, or t
  misc_feature (119)..(147): n is a, c, g, or t
  misc_feature (149)..(208): n is a, c, g, or t
ttaagtccnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnannnnnnnnnnnnnnnnnnnnnnnnnnnnnnnnnnnnnnnnnnnnnnnnnnnnnnnnnnnngaatttttattgaagaattattattttatctcttttgtaggatgattgaagtagttggtttataattttaatgtataatactgaagaaaacttcaatagagttat

SEQ ID NO: 10302 - DNA, 895 bp, Diabrotica virgifera
  misc_feature (509)..(543): n is a, c, g, or t
  misc_feature (799)..(799): n is a, c, g, or t
cagcaccaatttcagctacagttattaccattaaaagaagcttggaaatatgctgaagaaaagggatttacaagaaaaagtgcacttcagaaacttgcccatgaggatatacccatgccctcaacttttgcggatagaaactgttttagtttaggagcacataatcccatacctggattagacgtcgaatggattactctaaaaattacggagtatgaagatgcgggtcatttttgggctaataatttggaaagtgaaccttatcttaccgcattagaagaaatactaaacaaggctattcttcactccgttgtttctagaggccaaaccgtagaagtaggatccacctacgccgctcgattcgtcgaggataatatgttttataggtgcaaagttttttcagtttcgcccacatatgctgaggtacgttttattgactatggaaacatgcaacgggtacctataaaagagatttatcttttaccaaatagaccagaatgttcgtttgnnnnnnnnnnnnnnnnnnnnnnnnnnnnnnnnnnnaaaccttcaagaaaagctaatataagaggaatatggtcagaagcaaccaccaacttcgtgaagaaacacacttttaatatcttattgtatggcagggtacattctgttgtggataaggtagtatatctagaggtctacaaacgtgatccacatatgaataactctaaatcgctaaacttggttatgcttgaagacggatgggctgaacccgcaatagaaagttatcactcaagggatgactccaataatcgacaanaagtatacgcatctgacaaatccagggcagaagctgtaagggtgagttttgataaagtcccaagttatgacgattttgatgcgccacagatgtcta

SEQ ID NO: 10303 - DNA, 293 bp, Diabrotica virgifera
  misc_feature (4)..(4): n is a, c, g, or t
  misc_feature (16)..(74): n is a, c, g, or t
  misc_feature (255)..(284): n is a, c, g, or t
catntatttggggtgnnnnnnnnnnnnnnnnnnnnnnnnnnnnnnnnnnnnnnnnnnnnnnnnnnnnnnnnnnncacttttttggttttaagaaaaaataccctaaggaagcagcgggatttttttggggggggcaaccgaaataaaaatggggcccccgggttgagtaagttttaatgggggggaggttattataatatgggtcgcttttaaatttcatgtttggggttaaccggggggggcccgggggggtgnnnnnnnnnnnnnnnnnnnnnnnnnnnnnntgcgccccc

SEQ ID NO: 10304 - DNA, 52 bp, Diabrotica virgifera
  misc_feature (11)..(29): n is a, c, g, or t
  misc_feature (31)..(49): n is a, c, g, or t
gttggggtgannnnnnnnnnnnnnnnnnncnnnnnnnnnnnnnnnnnnngtt

SEQ ID NO: 10305 - DNA, 298 bp, Diabrotica virgifera
  misc_feature (90)..(112): n is a, c, g, or t
  misc_feature (133)..(150): n is a, c, g, or t
ttaaggccgaatatatttatcttcctaacttgtatacagtcattaaaaaaatttgcagctaattaaccctcacatacctcattaatgagnnnnnnnnnnnnnnnnnnnnnnncgctaaaaatttaacgctttnnnnnnnnnnnnnnnnnnctaaaatacctgtatatcatattccatgtacttgcaactcaacaataccttttgttttcattgtaatagttttttaatttattccattgtagtagtaattttcgaaaaccaaatttttaactagtcactgtattcatgattgttaatt

SEQ ID NO: 10306 - DNA, 88 bp, Diabrotica virgifera
ggtccggccggatcccggcgcctgcgtcgggcttgatcgtcagtggatcgatcccatcaaatataacaaatgagtcaagacatagcga

SEQ ID NO: 10307 - DNA, 237 bp, Diabrotica virgifera; identical to SEQ ID NO: 9225
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t

SEQ ID NO: 10308 - DNA, 151 bp, Diabrotica virgifera
  misc_feature (15)..(44): n is a, c, g, or t
  misc_feature (67)..(67): n is a, c, g, or t
  misc_feature (70)..(70): n is a, c, g, or t
  misc_feature (79)..(79): n is a, c, g, or t
tctaccaagggcggnnnnnnnnnnnnnnnnnnnnnnnnnnnnnnccttaaaaggagatatattaagnatnaaaaatggnttggcgatgatttgtagtaggtggtaagtggaaaatgaatgtttgtaagaagaaaattgaggaaatctggaa

SEQ ID NO: 10309 - DNA, 195 bp, Diabrotica virgifera
  misc_feature (12)..(33): n is a, c, g, or t
  misc_feature (36)..(143): n is a, c, g, or t
acgagagacccnnnnnnnnnnnnnnnnnnnnnnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaattttttgataatagataaattacctagggatacagcggaatttttt

SEQ ID NO: 10310 - DNA, 389 bp, Diabrotica virgifera
gattgtattaaacgatggcgaattagagttggaagacagcatctgattaatataaaagagaatgcttagttttcgtggatcgctggagctagcggatcgttatgaagtaattatctctgcagtattttccaatacccacgacctgatagcctgttagttccattgtcaaagcaactattttctatcaatttttcgaaatgagagtggtgagccacacatagatatatccaacttattacttcatatataaaatatacttattgacacaataaggaaaatgaaatatgtccatatcattaatattaaacatccttaagaattcgctaaaaaatagaatttgctgataatggactttgtacaaaagcttatgcctaaagaaattcatattc

SEQ ID NO: 10311 - DNA, 631 bp, Diabrotica virgifera
  misc_feature (592)..(610): n is a, c, g, or t
gataaaagtagcgttgactgaaactggtagctctatcaagggacatactaggagaggaagctggaggattaccgttgcgggaaagcggtacatcaaaataatacaacttctgaaatatttgaactcgtgccaaccccaatatgaatcagacataatagtcctaagagaaaccaattacctttatctaatatatcacttaacttcttgcaagagctacataatctaaaatgttattgccacgaaacggaacccgcccgtgatcagaaccgaaatagtattgaggcccaacgataccatgcccctgatggataacctccatggcagactgatgttccccccaatgaacatccatcacggatacctcccgaacgacaggaggaagaagataaaggttaataacacggctacgagaaagaatatgaagatgaggaacagcaaaataaatgatggccacgaaacgtacaatatctgtcatatacagccatgcactgcaacatcaaattccctatcataaaagtgaacaatgactacatgttatatttatacaaatgcataatgtgctttacttctttctccacacaagacgataacnnnnnnnnnnnnnnnnnnnctaatgtcgaactgcagtatt

SEQ ID NO: 10312 - DNA, 957 bp, Diabrotica virgifera
  misc_feature (124)..(145): n is a, c, g, or t
  misc_feature (529)..(553): n is a, c, g, or t
  misc_feature (607)..(626): n is a, c, g, or t
  misc_feature (737)..(757): n is a, c, g, or t
caatgttgcagagcaaaggcagctcaataggatagtcgaaacagaagaccatataagacagagcatgcctttgcctccgatgagcttcctggctaaggtaccgtcgagtccttcatgtgatacnnnnnnnnnnnnnnnnnnnnnnaccatttatgacgatacctgggtcagccagttcaccacagtcaaagaagagcctgaagataggttgtcccatccacagattactccagcctcgttagacgatttagacaggatcgacgacctattaccaatggatgggatcaatcttgaagaattagcggatatcgataccaacttcgatactgcttcaaatagttccggatcgcacctagatttctcatgtcccaaggatattccgatgttctctaacatcgaaaacgaaacatgggccgaaatgcaaacagcggcgtttctaatgtgaggaagagattaagactgtttttgagattttactgtgtgtggaggcacaattatactgttaatattttggggttggtcctcattnnnnnnnnnnnnnnnnnnnnnnnnngtttttatattgttataaatattcttaaccccaaacattgatctcattttgcgnnnnnnnnnnnnnnnnnnnncattacgatgtattaccagaatctaacagttttacgtaagacagtcattttagatcgagaatgccactatatttaaactgccactgaaaatcgcattcctaagggatctgnnnnnnnnnnnnnnnnnnnnnaaacgtgtttgtgacgaaataaatggttctggtagtcagatttgtcgaaatttttaaatgcaaatggatgtatatcttacctatttatttactcctttgtttcttatttccttgagtactttcatatttttttagcttacaacattttgttacgcttctaaactctagactcctaggcatattcgtattcagtaaaattg

SEQ ID NO: 10313 - DNA, 597 bp, Diabrotica virgifera
  misc_feature (16)..(49): n is a, c, g, or t
  misc_feature (57)..(95): n is a, c, g, or t
  misc_feature (100)..(137): n is a, c, g, or t
  misc_feature (147)..(185): n is a, c, g, or t
  misc_feature (226)..(253): n is a, c, g, or t
  misc_feature (296)..(320): n is a, c, g, or t
  misc_feature (322)..(347): n is a, c, g, or t
  misc_feature (349)..(366): n is a, c, g, or t
  misc_feature (377)..(416): n is a, c, g, or t
  misc_feature (456)..(530): n is a, c, g, or t
ccccccctcgcgtccnnnnnnnnnnnnnnnnnnnnnnnnnnnnnnnnnngtaaaagnnnnnnnnnnnnnnnnnnnnnnnnnnnnnnnnnnnnnnnggaannnnnnnnnnnnnnnnnnnnnnnnnnnnnnnnnnnnnngcaccttggnnnnnnnnnnnnnnnnnnnnnnnnnnnnnnnnnnnnnnntctcgaatatcaaagagctaaacaattatattgtttattgnnnnnnnnnnnnnnnnnnnnnnnnnnnngtgtgagctgtcttcgtatatctatatatctaataaataaagnnnnnnnnnnnnnnnnnnnnnnnnncnnnnnnnnnnnnnnnnnnnnnnnnnncnnnnnnnnnnnnnnnnnntgagcgggatnnnnnnnnnnnnnnnnnnnnnnnnnnnnnnnnnnnnnnnngagaaattaggaccaacatttttcaaagtatgaaataagnnnnnnnnnnnnnnnnnnnnnnnnnnnnnnnnnnnnnnnnnnnnnnnnnnnnnnnnnnnnnnnnnnnnnnnnnnngaaggtgaatatagatgaaaaaattggtagtttataaatgaatatatcgtgtgataaaaagaaagcc

SEQ ID NO: 10314 - DNA, 646 bp, Diabrotica virgifera
  misc_feature (51)..(78): n is a, c, g, or t
  misc_feature (96)..(109): n is a, c, g, or t
  misc_feature (111)..(248): n is a, c, g, or t
  misc_feature (254)..(360): n is a, c, g, or t
  misc_feature (386)..(431): n is a, c, g, or t
  misc_feature (433)..(446): n is a, c, g, or t
  misc_feature (549)..(573): n is a, c, g, or t
  misc_feature (595)..(641): n is a, c, g, or t
acattattttctactttagaagagatctaaaatacttaatttttatagtgnnnnnnnnnnnnnnnnnnnnnnnnnnnnggagaaatgtgatactcnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggaggagaatattagaattatnnnnnnnnnnnnnnnnnnnnnnnnnnnnnnnnnnnnnnnnnnnnnntnnnnnnnnnnnnnntcctgctgattataaacatgacgttttgtataatatataaagactcgcctgcccactgatgaatttgtatgatcgcgctatttttaccgagctaaggtagcgnnnnnnnnnnnnnnnnnnnnnnnnngtggaatgaaggggtggatgtnnnnnnnnnnnnnnnnnnnnnnnnnnnnnnnnnnnnnnnnnnnnnnntttat

SEQ ID NO: 10315 - DNA, 95 bp, Diabrotica virgifera
  misc_feature (10)..(72): n is a, c, g, or t
  misc_feature (75)..(91): n is a, c, g, or t
ggaatggagnnnnnnnnnnnnnnnnnnnnnnnnnnnnnnnnnnnnnnnnnnnnnnnnnnnnnnnnnnnnnnngcnnnnnnnnnnnnnnnnncgag

SEQ ID NO: 10316 - DNA, 72 bp, Diabrotica virgifera
  misc_feature (2)..(27): n is a, c, g, or t
  misc_feature (29)..(71): n is a, c, g, or t
gnnnnnnnnnnnnnnnnnnnnnnnnnncnnnnnnnnnnnnnnnnnnnnnnnnnnnnnnnnnnnnnnnnnnnt

SEQ ID NO: 10317 - DNA, 1008 bp, Diabrotica virgifera
  misc_feature (162)..(185): n is a, c, g, or t
  misc_feature (198)..(215): n is a, c, g, or t
  misc_feature (249)..(271): n is a, c, g, or t
  misc_feature (497)..(517): n is a, c, g, or t
  misc_feature (596)..(615): n is a, c, g, or t
  misc_feature (680)..(728): n is a, c, g, or t
  misc_feature (868)..(888): n is a, c, g, or t
  misc_feature (896)..(896): n is a, c, g, or t
  misc_feature (958)..(958): n is a, c, g, or t
ctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctntttcttttcaacgaaaaagattaaggacttttaagaataactttctccattgaatgactacnatttaacccctcagctgaacacagatattctgaatggcaatataatcatc

SEQ ID NO: 10318 - DNA, 791 bp, Diabrotica virgifera
  misc_feature (12)..(758): n is a, c, g, or t
cctcctggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaatgaaaaaaaaactggctttataaaaatt

SEQ ID NO: 10319 - DNA, 204 bp, Diabrotica virgifera
  misc_feature (12)..(35): n is a, c, g, or t
  misc_feature (69)..(82): n is a, c, g, or t
  misc_feature (85)..(107): n is a, c, g, or t
  misc_feature (115)..(137): n is a, c, g, or t
  misc_feature (167)..(198): n is a, c, g, or t
ttaagtccgagnnnnnnnnnnnnnnnnnnnnnnnntcgatcataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10320 - DNA, 782 bp, Diabrotica virgifera
  misc_feature (4)..(367): n is a, c, g, or t
  misc_feature (369)..(383): n is a, c, g, or t
  misc_feature (387)..(407): n is a, c, g, or t
  misc_feature (713)..(765): n is a, c, g, or t
cttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnngaannnnnnnnnnnnnnnnnnnnnctattacttatttttatatcttattatgcttatttgcgataatacttctcattaaaagatctccttaaataattcctactatgacaccaatgatattatcaacagactccaaaatatggcccagcacaacctactgacccacttgacgacaaaaggccctatattcctctacagcatataaatggaacacaactgaacaatgtcgcatctcaggtcatgaatgcagataggcacacaactttcgcatgcttattacacaaagagatagaacactatccacaaaaagggccgtacgagtgcgttacnnnnnnnnnnnnnnnnnnnnnnnnnnnnnnnnnnnnnnnnnnnnnnnnnnnnncattattattgtgaaag

SEQ ID NO: 10321 - DNA, 854 bp, Diabrotica virgifera
  misc_feature (2)..(833): n is a, c, g, or t
  misc_feature (835)..(849): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnattta

SEQ ID NO: 10322 - DNA, 552 bp, Diabrotica virgifera
  misc_feature (20)..(37): n is a, c, g, or t
  misc_feature (54)..(134): n is a, c, g, or t
  misc_feature (145)..(183): n is a, c, g, or t
  misc_feature (195)..(257): n is a, c, g, or t
  misc_feature (273)..(366): n is a, c, g, or t
  misc_feature (397)..(415): n is a, c, g, or t
  misc_feature (434)..(457): n is a, c, g, or t
actaaaggccgccttatttnnnnnnnnnnnnnnnnnngaagacctttagaaagnnnnnnnnnnnnnnnnnnnnnnnnnnnnnnnnnnnnnnnnnnnnnnnnnnnnnnnnnnnnnnnnnnnnnnnnnnnnnnnnngttgtgtatgnnnnnnnnnnnnnnnnnnnnnnnnnnnnnnnnnnnnnnnaatttataagannnnnnnnnnnnnnnnnnnnnnnnnnnnnnnnnnnnnnnnnnnnnnnnnnnnnnnnnnnnnnngtattagtgtttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaagagttagaaagagaaattgttattagnnnnnnnnnnnnnnnnnnnttttggataagaagtgttnnnnnnnnnnnnnnnnnnnnnnnnaatgttttgttttatagttataatattttatagattttttataagaattagagatgaaaaaatttatatgtataatatgatgtagaatggagtaa

SEQ ID NO: 10323 - DNA, 210 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaagataatat

SEQ ID NO: 10324 - DNA, 1167 bp, Diabrotica virgifera
  misc_feature (10)..(27): n is a, c, g, or t
  misc_feature (40)..(59): n is a, c, g, or t
  misc_feature (343)..(355): n is a, c, g, or t
  misc_feature (357)..(374): n is a, c, g, or t
  misc_feature (376)..(389): n is a, c, g, or t
  misc_feature (499)..(514): n is a, c, g, or t
  misc_feature (516)..(531): n is a, c, g, or t
  misc_feature (771)..(788): n is a, c, g, or t
  misc_feature (838)..(861): n is a, c, g, or t
  misc_feature (874)..(919): n is a, c, g, or t
  misc_feature (921)..(947): n is a, c, g, or t
  misc_feature (963)..(1009): n is a, c, g, or t
taaaggccgnnnnnnnnnnnnnnnnnntgcggccgccccnnnnnnnnnnnnnnnnnnnngccttttctgtatcggtaccagtgatgaggaggtggggaagaagaaaggattggagactttaagaatttcatctattaggccgggaagtaggacggagtataacgtgagaaataagtaaataatgtagtacaaattatatcagagtaaaaaactatggattatattgaaatgtagatagtataatgaatatttctgtgtaatgaagtctgaggtgatttgagatatatggaggattataacgaataagtgaaaagaatttatcaacaatataattatcatgagnnnnnnnnnnnnngnnnnnnnnnnnnnnnnnngnnnnnnnnnnnnnngaatgagtttgtattgacatttaaggtaaaagtaaaatttaggagaagaaatagtagtaatgaaagatatgttataatgtaggtttatatatacataatgtagatgacgnnnnnnnnnnnnnnnncnnnnnnnnnnnnnnnnggatagtgtagaggcatgaggatatctagtgaggtgaaggaaagggggtagtatagtaagaatatagaggtgaatacaaggaattaatcaacgatgttgtcacctgtttattacgaacgtgcgtgggtgtatgacatatagggtcacatctgcacactggtgaggtcgatgggcacgaggaatgtgagcggggtaatgtcagatattcattagaatgtttattgaaatttggatggaatnnnnnnnnnnnnnnnnnnctggcaatagggatgttataaggaacttgatagggaaattaagaagcggnnnnnnnnnnnnnnnnnnnnnnnnagcgaataggagnnnnnnnnnnnnnnnnnnnnnnnnnnnnnnnnnnnnnnnnnnnnnngnnnnnnnnnnnnnnnnnnnnnnnnnnntgggttatgagggagnnnnnnnnnnnnnnnnnnnnnnnnnnnnnnnnnnnnnnnnnnnnnnnacattttttgtgctataaaaaagaagtaactaaagggataaactggggatttaaaggggaagagttaaaggcgagataaaaaatgggaacctcaagggggggcctaaagggttaaaacttggggggaataaatataggtaaaaaagttggttttcagc

SEQ ID NO: 10325 - DNA, 775 bp, Diabrotica virgifera
  misc_feature (15)..(38): n is a, c, g, or t
  misc_feature (40)..(52): n is a, c, g, or t
  misc_feature (60)..(87): n is a, c, g, or t
  misc_feature (89)..(118): n is a, c, g, or t
  misc_feature (143)..(156): n is a, c, g, or t
  misc_feature (158)..(192): n is a, c, g, or t
  misc_feature (209)..(286): n is a, c, g, or t
  misc_feature (293)..(323): n is a, c, g, or t
  misc_feature (327)..(348): n is a, c, g, or t
  misc_feature (434)..(453): n is a, c, g, or t
  misc_feature (455)..(480): n is a, c, g, or t
  misc_feature (538)..(575): n is a, c, g, or t
  misc_feature (585)..(603): n is a, c, g, or t
  misc_feature (649)..(692): n is a, c, g, or t
  misc_feature (713)..(762): n is a, c, g, or t
gtggaggggggagcnnnnnnnnnnnnnnnnnnnnnnnntnnnnnnnnnnnnngggggatnnnnnnnnnnnnnnnnnnnnnnnnnnnngnnnnnnnnnnnnnnnnnnnnnnnnnnnnnnggggggggtgtttcttacacatgcnnnnnnnnnnnnnngnnnnnnnnnnnnnnnnnnnnnnnnnnnnnnnnnnncttccttataacaaatnnnnnnnnnnnnnnnnnnnnnnnnnnnnnnnnnnnnnnnnnnnnnnnnnnnnnnnnnnnnnnnnnnnnnnnnnnnnnngataatnnnnnnnnnnnnnnnnnnnnnnnnnnnnnnngtannnnnnnnnnnnnnnnnnnnnngtataaaaggggttctcggccattttttttctcacgtgttatttaaaacatggtcttttttgaattaatattaagcccccgccggnnnnnnnnnnnnnnnnnnnngnnnnnnnnnnnnnnnnnnnnnnnnnnaatatttcattattttttgtattggaaatgggaatgaagggttgggatgaataaaacnnnnnnnnnnnnnnnnnnnnnnnnnnnnnnnnnnnnnngttaaaatgnnnnnnnnnnnnnnnnnnnacgaaagcaccctaatacagtttttataacaatttttaataggttnnnnnnnnnnnnnnnnnnnnnnnnnnnnnnnnnnnnnnnnnnnntgggggtgattaacaaaactnnnnnnnnnnnnnnnnnnnnnnnnnnnnnnnnnnnnnnnnnnnnnnnnnnatcacaatttttt

SEQ ID NO: 10326 - DNA, 999 bp, Diabrotica virgifera
  misc_feature (20)..(22): n is a, c, g, or t
  misc_feature (28)..(28): n is a, c, g, or t
  misc_feature (31)..(33): n is a, c, g, or t
  misc_feature (718)..(738): n is a, c, g, or t
  misc_feature (763)..(783): n is a, c, g, or t
  misc_feature (791)..(803): n is a, c, g, or t
  misc_feature (805)..(850): n is a, c, g, or t
  misc_feature (887)..(924): n is a, c, g, or t
  misc_feature (930)..(944): n is a, c, g, or t
  misc_feature (946)..(980): n is a, c, g, or t
cttcgcctgctaggccgggnnnaatcgntgnnnccggcgagggatctctttgaaaatactacgcagggggcatctatgatgacaaatattgtggagacaatatcaatcacgccataattgctaccggttacactgatgaatatattgtgataaaaaattcttggggagaagagtggggtgaagatggatacatgaggatagccagaggaaaaaatatatgccacattaacgatgacaattcttatccgattttgtcaagttaaaacaaaaatttgttattgccatataaacaattatataattgtgaactgcaaataatatgggacttgttaaataaatgcataatctaatatgtattgcagaaaaatatcagatagtaacggaaaaaaaaaatcagctgtatatccagtagaagattgcatctgaaggacctaagctctgcataggccgtgtatgagacgatctcaacatcttcgatattgcctgcgtaaatacagatatacagagacacccgtttaatagtagctacgatggcgccaaacgaagtaattgaacacactcctgaatatggtcagaaacacactactgacctaatagacgacgaatggcacaatattcttctccagtaaacaaaaggaacccatctgaacaatgtagcattaaggtcatggatggagataggcacacaacttgcctacgctttattacataaagagannnnnnnnnnnnnnnnnnnnngtccgtaggagtgggcaaaaaaatnnnnnnnnnnnnnnnnnnnnnagagaaannnnnnnnnnnnngnnnnnnnnnnnnnnnnnnnnnnnnnnnnnnnnnnnnnnnnnnnnnncaaataatcttttgaacttgggcaccaggaattatannnnnnnnnnnnnnnnnnnnnnnnnnnnnnnnnnnnnngctacnnnnnnnnnnnnnnngnnnnnnnnnnnnnnnnnnnnnnnnnnnnnnnnnnntggttttccgtttaaaaat

SEQ ID NO: 10327 - DNA, 993 bp, Diabrotica virgifera
  misc_feature (9)..(29): n is a, c, g, or t
ccctttaannnnnnnnnnnnnnnnnnnnncaatgatgccaatttcatcacaagtgaaaattactggtgttgtgagatcatctcccgacaccagtaattttcaatgatgccaatttaaacacaagtgaagttgtgttcgagacatacaaagtattagaccgcggaatgaagagtaccgaccgaaagggctcccattttgacttataccccactagaatcctcatacacgggcacggcgaaaacggtcaaagttcttgggtactaacggcaaggaatgcttacttaggtctcagagaacctcacaatgttgttattgtagattgggcaacaggagctgccccatacgagacagctgcggcgaatacaaaacctcttggagaacttattggaaagtatattctcgataatgaacttgagctagaaaagttgcaacttattggtgttggtatgggcgcccacgctgccggacaggcaggaaaatatattactagagtaagtcttcaccatataggtagaataactggtcttgacgtagctggtcctaaatttgaattggattctgtgccagcagaaggcaaattacagaaaactgatgcttttttcgtagatactgttcatacgaacgttcaaaagtttggatataaatgtcctattgggcacgtagattggtacgttaatggtggaaatgttcaaccgggatgtcctgttttagattctccagatttggatgtgtgcagagagtttacgcgcccccgacctgtatgttgaatcaatcacttatcaggcaccttcctatgaatgtacgggaaccatccagaatggatcatttgtattgaccaaagttccgtttggaagaaagtggaatttggaaaaaacgcaatttatccgctaaagaaatttatccaaaataccaatagggttcctaaaaatttgccactttaaaaatcaaaggggcccagaaaaaactcaatggttttggtctttttaccccctt

SEQ ID NO: 10328 - DNA, 860 bp, Diabrotica virgifera
gaggtgttgaaccagctgggaggctggccagttctgaaacaaaactggaccgtgccgtcattctcagttgaaattctaatcggattgataagaagttattataacgaagggttacttatcgagcaatgggttggacccgatgataaaaatagttctgtgaacattattcagatggatcagtcgattttagctctaccaagtagagactattatctaaagcccagcagcaagggagatcttttagcatatcatagatatatgaccaatatagcaatacttctaggtgccaataaaactacagccggtgatgaactacaaaaagttatcgaattcgaaaaacaactcgcaaatgcttcgcttccagagcaagacagacatgatactagtatgatttataagaagatgtctatcaaagatctagccaagttagtgcccaaatttaactggctggagtattttagaaccatatttgacatgaacataaatgaggacgaacagatcgtagcttatggaatatcttatttcgtcgagttgggaaagattttgtctaccacagatagaagaataatccacaattatgtattgtggcgtctagtaatgtcgttatctacgcacttggtggacgattaccagaaggagcgtgtagagtttcgaaaaattctacaaggtgttttatccgaacgacaccgatgggcgcaatgcgtagaatggaccaacaagaaaatgggcatggctgtaggtgccttatatattcgagacaatttcgatcatttaaataaagagactgcattggaaatgatacacaccattaaagaagcttttaatgaacttttacccgaaaaccactggatgggatgacg

SEQ ID NO: 10329 - DNA, 471 bp, Diabrotica virgifera
  misc_feature (407)..(432): n is a, c, g, or t
gtcccctctctccccctagacagaatgacctaatcatctgatctccctcctatacgcagtatgtggtggattctaacttatgtgtttcactaacattcatgcggtagttcaaagacatacgacttatggagtgtttgcactcttgcctaacccaataagaatcagactacactctctaacgagaataccaattacattaccatcatatagaacctaaattctaccaagaagaccataatctagaatgaatagaccactcgacggtccctgctcgtgaccagattcgaaataccatagagattcgacgaaaccatgcccctggtgaataacctctatggtcgactgatgttcccccctttgttaatccgccacagagagcacctgaaccacaagaggaagagactaannnnnnnnnnnnnnnnnnnnnnnnnnaggatgatggtgaagaacatcagaataaatgcatgcccc

SEQ ID NO: 10330 - DNA, 69 bp, Diabrotica virgifera
  misc_feature (17)..(17): n is a, c, g, or t
cgtgaacctcctgtctnaaagtggtcgcaggataaagtttctgcagtacgtccaccactctctaccatc

SEQ ID NO: 10331 - DNA, 619 bp, Diabrotica virgifera
  misc_feature (10)..(40): n is a, c, g, or t
  misc_feature (42)..(528): n is a, c, g, or t
  misc_feature (541)..(571): n is a, c, g, or t
ttaagtccgnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcttttagtagnnnnnnnnnnnnnnnnnnnnnnnnnnnnnnngctggggggatttcaataaattatgaactatttctccataattatatc

SEQ ID NO: 10332 - DNA, 480 bp, Diabrotica virgifera
  misc_feature (17)..(17): n is a, c, g, or t
  misc_feature (36)..(36): n is a, c, g, or t
  misc_feature (79)..(80): n is a, c, g, or t
  misc_feature (84)..(84): n is a, c, g, or t
  misc_feature (86)..(86): n is a, c, g, or t
  misc_feature (89)..(89): n is a, c, g, or t
  misc_feature (97)..(97): n is a, c, g, or t
  misc_feature (101)..(101): n is a, c, g, or t
  misc_feature (107)..(107): n is a, c, g, or t
  misc_feature (114)..(114): n is a, c, g, or t
  misc_feature (159)..(159): n is a, c, g, or t
  misc_feature (176)..(176): n is a, c, g, or t
  misc_feature (180)..(180): n is a, c, g, or t
  misc_feature (186)..(186): n is a, c, g, or t
  misc_feature (190)..(191): n is a, c, g, or t
  misc_feature (198)..(198): n is a, c, g, or t
  misc_feature (202)..(202): n is a, c, g, or t
  misc_feature (230)..(230): n is a, c, g, or t
  misc_feature (232)..(233): n is a, c, g, or t
  misc_feature (235)..(235): n is a, c, g, or t
  misc_feature (252)..(252): n is a, c, g, or t
  misc_feature (273)..(285): n is a, c, g, or t
  misc_feature (288)..(300): n is a, c, g, or t
  misc_feature (313)..(313): n is a, c, g, or t
cggtcccctaccaaggnggagtaaaatgagaaatanaattaattttattctttaatgggttgtgtattaggtgttattnnatanangantggtaganatgnaaaatntaaattngattaatctgttattaatttaataagagatatagttgaagaatgnaaaaatggtttagaganattngaatantatnnttatgantgtnaaaaatattaatcttgtagtaagggagnanntnaggtaaataattgtganaatgggatatattggaaagannnnnnnnnnnnntgnnnnnnnnnnnnngatgtagattggntgaagataataatatttatagattttgattgtaaggatggtaaaaatatatattagttatatgtatacgattgtaaaaaattttaagaatgttttgatttgataggttatattctatgatgttgaggggatttgatgagttatagattagttagtaaatgagactac

SEQ ID NO: 10333 - DNA, 887 bp, Diabrotica virgifera
  misc_feature (158)..(172): n is a, c, g, or t
  misc_feature (344)..(362): n is a, c, g, or t
  misc_feature (503)..(520): n is a, c, g, or t
  misc_feature (548)..(565): n is a, c, g, or t
caatgaaggatcttggagcaggaggaagaactttcctttataatgaaagaaatctggacgcaaggttttccaccgcaagaaaatgcatattaggtatatacattgtgatactagtagtgttagtcgtgggcttagtcctcatcacagtcttggctccnnnnnnnnnnnnnnntttaaaaaagaactgaacaataaaattcttcaacgtggagtcataaattttaacgaaatgaaatctaaaagatttgctgatggtgccagtttactgtagataaatatttttacaagtatttataaaccataaataaaatgttacaataactgttgacaactaaattttcacnnnnnnnnnnnnnnnnnnnatgattttttaactattttcaaaacatgcttacttacttatttgaaccttattatttgagaaataaatcgtttaagaacaagtcctttgtcaccaaaacagctcccatcaatttattaacacattttgtgataatttggcnnnnnnnnnnnnnnnnnngtatcggtgaattaatgatttataacgnnnnnnnnnnnnnnnnnngatgatcaataaggggatattatgtatcaacatttatttcaaacttcataaattttttgatattatggaagaatgacaaacacagatcaccccagacgtataactgaaagtggcagagagagagaatttggaaaacttagttgggtactagagaacccagttccaagagttgggtactagagaaccaagaaccgcaaaatattccaatacttgcggagccaagtgtttcaccagcgcatccttcctatactgacctatgaatgtcaaacctgtcactcctaaccaagcgcaaatattgaataatcctacccacactagaaaa

SEQ ID NO: 10334 - DNA, 837 bp, Diabrotica virgifera
  misc_feature (7)..(32): n is a, c, g, or t
  misc_feature (42)..(102): n is a, c, g, or t
  misc_feature (104)..(140): n is a, c, g, or t
  misc_feature (148)..(221): n is a, c, g, or t
  misc_feature (227)..(427): n is a, c, g, or t
  misc_feature (429)..(519): n is a, c, g, or t
  misc_feature (566)..(587): n is a, c, g, or t
  misc_feature (614)..(633): n is a, c, g, or t
  misc_feature (679)..(703): n is a, c, g, or t
  misc_feature (705)..(732): n is a, c, g, or t
  misc_feature (773)..(793): n is a, c, g, or t
  misc_feature (799)..(813): n is a, c, g, or t
  misc_feature (815)..(833): n is a, c, g, or t
catatgnnnnnnnnnnnnnnnnnnnnnnnnnnataattagannnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnaatttatnnnnnnnnnnnnnnnnnnnnnnnnnnnnnnnnnnnnnnnnnnnnnnnnnnnnnnnnnnnnnnnnnnnnnnnnnnatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatatttagtagaaatatataggtttattaaaggaattcgtaaacgnnnnnnnnnnnnnnnnnnnnnncacatgactttttgtatgacatatagnnnnnnnnnnnnnnnnnnnncagtttgaatggtcgcggtattgtgaccgtgctaatgtaccatatnnnnnnnnnnnnnnnnnnnnnnnnntnnnnnnnnnnnnnnnnnnnnnnnnnnnnactttatttaagttataatgaattttatatttaagttaatnnnnnnnnnnnnnnnnnnnnnacgatnnnnnnnnnnnnnnnannnnnnnnnnnnnnnnnnnatta

SEQ ID NO: 10335 - DNA, 628 bp, Diabrotica virgifera
  misc_feature (8)..(536): n is a, c, g, or t
  misc_feature (538)..(627): n is a, c, g, or t
aaaatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10336 - DNA, 635 bp, Diabrotica virgifera
  misc_feature (12)..(30): n is a, c, g, or t
  misc_feature (35)..(35): n is a, c, g, or t
  misc_feature (69)..(130): n is a, c, g, or t
  misc_feature (132)..(144): n is a, c, g, or t
  misc_feature (149)..(186): n is a, c, g, or t
  misc_feature (190)..(208): n is a, c, g, or t
ctcaccctaaannnnnnnnnnnnnnnnnnnacagntgcatttacttcatttccaaacaatcaaaatggnnnnnnnnnnnnnnnnnnnnnnnnnnnnnnnnnnnnnnnnnnnnnnnnnnnnnnnnnnnnnnannnnnnnnnnnnnaattnnnnnnnnnnnnnnnnnnnnnnnnnnnnnnnnnnnnnngatnnnnnnnnnnnnnnnnnnnctgtgtataggaaataaaaattttgaatgcaaaccacacaaagtaaagcgatgacgtcgaacataaagatacatttatatagaatagcctaaatagattaatggatagtaaagaccttactaaaaattcggaccttagagaaaaaagatatttcataagaaccagcgaaatgagagaattatgttaatagtatagtataacatgatattcataaataaaaatattaagaatttaaaatatggtgaaaaacatttgtatatatcaagaatataactgtgtaaaagacgtatatgaaagtctattattaaacgtttcttaatttaataaagctgggaataggagaaatataaaatgaaatatgtggagtccagtaaataggtttaaataaggagacttgtctaaactttcttcgactggtcaatactta

SEQ ID NO: 10337 - DNA, 679 bp, Diabrotica virgifera
  misc_feature (262)..(279): n is a, c, g, or t
aattaatttagtcacatggtattaacaaattctctgcaaaaaaattattgaatattacaaaacatattgaatcaagataaataaatccaagtatcaatacttattctacaagagaggtcgacaatcagaaaactaattttgcaggaaataatattttaaaagttctagaaatagtacgaaaaatgtctacctccctttgatacttaaagtttagcaagaaattcaataaaaccaaaaaactttctaaaaattatattgtagnnnnnnnnnnnnnnnnnncacattattatattatagttgtacagtgatgagcgcgctaataacctgcaaaataccgcaaaagatagaaatcatattaggttgtgagatgaagggaggtgaatctggtattggtgggaaatttaacgataaaaacctataaatttacattggattgattgtttaccacctttaaacgtatcagaggaatgtcaaatagcactggcacagtggtagtatccagactcgcccaatacgcctaaaggagagaagtcatcaatacaatgaaaatttataggtatcatatcgctaaattagctcacctcgacgggattcatttcttttaatgtcacaacatagtatacttttttacagatgtaatgtaaggtaactttatagtataggacatctcggatttcct

SEQ ID NO: 10338 - DNA, 477 bp, Diabrotica virgifera
taaagtccgcagacttcaaaacacatcatgacagttcccgcgaaagaagccaatggtaccgatgtggaaaatgcagctcagcaaaaagaacaagaagtacaaaaagaaaaggagctccttaaagcaatgagaaaatccaaaagaaagtttcctggatttcgtaagaacttatatgattattttcaagaatttactggtatcacggttatccacgcttttaattatatggaagaacttgaaagaaactcgtatgaaaggatagggagggcttagacgagatatttcatatgtttggaattggaaagtagaaagtaacagaggttataaaacatagcgtaaaagatgatgttaggactattatatattacataagatacagggaatagattggggagtgatatctttatggcatagcatgaaaggtaaggagtcaaagtttgaggaagagaaaactagtcacgatctagaaggtataca

SEQ ID NO: 10339 - DNA, 1017 bp, Diabrotica virgifera
  misc_feature (22)..(22): n is a, c, g, or t
  misc_feature (42)..(64): n is a, c, g, or t
  misc_feature (239)..(265): n is a, c, g, or t
ttaaggccgaccggtttgaggntatgtgacacgtaaagaccnnnnnnnnnnnnnnnnnnnnnnntaaattagaaatttatttcaagatgagcactcagtcttcacagaacggtaacgttagtgaaagtactgaagccgaaaatagattaatagaattggcaaaatctaattcagaaggtatttcaaatgacgacataacaaagcatatgcctgatgtaccccttacagaaataacaacnnnnnnnnnnnnnnnnnnnnnnnnnnncacatttgatttgtttaaaaccaaagataacctcttatacaaatacaaggatccatctaagaagacaaacattaaaggagcagatagtgaggagaaagtagtatataaaataatagaagaagcaggaaacaagggcatatggataagagatatcagatttagttccaatttgaatatgacacagcttaacaaagttttgaaaagtttagaaaccaagaaactgattaaagctgtaaaatcagtatctgccagtaaaaagaaagtttatatgctgtatgatttggaaccagacaggtcagtaacaggaggggcttggtatcaagatcaagattttgaatcagaatttgttgatgtgctaagccaacagtgtcataggtttttagtagaaaaatgggaagaagctaataaaaaggctggtggcccccttttagtaagaaacagaagttatgctacagctagcgatgtccacaaatttatttctgaactgggtatcagtaaagtttctctatcagtagatgatatagaaagcatttttgtatacagttagtcttgggacaacaatggcggaaacggatttctagcaagcaaaatgggttcttactttgtataaaagctgtaaaatagggtttttggccaacaccaaggggctagtggaaaatttaccttggggggatggcgcccccggaaagctaagaaaaatggggcagaaaaagcggacttaattaaattccgaaaagccctggtaacttatt

SEQ ID NO: 10340 - DNA, 1099 bp, Diabrotica virgifera
  misc_feature (2)..(841): n is a, c, g, or t
  misc_feature (843)..(858): n is a, c, g, or t
  misc_feature (1057)..(1085): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnagaataattaccttagggataacagcggtattttttattgggagagttcaaatcgataataaagatgtccgacctcgatggttggattaaaagtttataatttgttggagcagctatattaattaagtctggtcgaattttaaaattttacattgatctgagattaaaaccggtggggggcccaggttgggtttctttnnnnnnnnnnnnnnnnnnnnnnnnnnnnnaacgaaagggaacc

SEQ ID NO: 10341 - DNA, 505 bp, Diabrotica virgifera
gccatcatctagtttttttttatatctccttacccatgactgacaatgaagaagtttactccgaaaaaaaggaggaggaagaagactttgatacgactaccaccactacctccaacgccgaggaaggagcgggagaattggaattcctcaaacgtcaagatcattaagagatcagatctcgatgaacagattcacgagtacatcactagaatggagcaaacaacgagacaaggatgaagaagacttaaagaaactcgtggaaagataggctaatagcaaaattactcgtgctgatgaggaaaggaatatggcagaacgtaacatagctgcagaaaaacgtcgagttcatgttattgttatgaagaccgaagaagatattgaggaaatgaaacaccggcttgattaagacgagaatattaggtatgtgatgatggaatgtctgtatgaactagaattgatcgacggtcctcactaactaatcacctagagatacgactgtggcaac

SEQ ID NO: 10342 - DNA, 985 bp, Diabrotica virgifera
  misc_feature (862)..(862): n is a, c, g, or t
  misc_feature (873)..(874): n is a, c, g, or t
  misc_feature (896)..(896): n is a, c, g, or t
  misc_feature (911)..(911): n is a, c, g, or t
  misc_feature (933)..(933): n is a, c, g, or t
gaccttgctatttacataggtttttttgatttaattctaaaatagagagtaataagcggcgtataattctaaattaaaaccatctagttcgagttttccacaaccgtccaatcatctggtaggtattatcggcacttttgtgtttattttattttgtacaaaacgacataaagaataaataagtatgtaagataaagtaattattataaatattggtgtttatcctaaatattatcatatagacttttgtaaatatataaaaggaaactttgcttaaaatactatttgttaatgataaaatatgttgatttcgatcgattttttgcaaagtttaacattaacataacgtctatcgtctattggacttccttgtatatatactaaaaattttcgctgcttatatgcgtgccaaaataataccaattgatttttagtgattctgaattattaaagatattttttacctacatttatcaaaaatagcaaaatatattggtcaaaagaatattcagcagatgattattttggtcatcaaattgtttaaaatcttaaatccaacgaaaaggtagtgacacacatggtctgcggcctgaaattaaactacatttatttaagataattccatatttctttgaatgtttattttttcaacttcatgaggaacgtactacaaaattagatacaaacataacatacctaatatttccacttaggaaatgtggtattttattttatgaaactaattctatcagcagtaaaacatgtgacgatcttcgagtagccgaggcggtaataatttcatgtcggtcctttatttccacatgtgttcctatggccaattagtggtatatcttgtattaanggctatattgnngttttatttcagtattttatanatggtagaaatattncagagggtgatgcgaactttgngaaaaaccagtttgattggtacacccggtatagaatgaaaatttacctgttt

SEQ ID NO: 10343 - DNA, 66 bp, Diabrotica virgifera
  misc_feature (2)..(57): n is a, c, g, or t
annnnnnnnnnnnnnnnnnnnnnnnnnnnnnnnnnnnnnnnnnnnnnnnnnnnnnnntttttttga

SEQ ID NO: 10344 - DNA, 74 bp, Diabrotica virgifera
  misc_feature (14)..(72): n is a, c, g, or t
gtgataaaaaatannnnnnnnnnnnnnnnnnnnnnnnnnnnnnnnnnnnnnnnnnnnnnnnnnnnnnnnnnnga

SEQ ID NO: 10345 - DNA, 80 bp, Diabrotica virgifera
  misc_feature (4)..(68): n is a, c, g, or t
gtgnnnnnnnnnnnnnnnnnnnnnnnnnnnnnnnnnnnnnnnnnnnnnnnnnnnnnnnnnnnnnnnnnccccaatttttt

SEQ ID NO: 10346 - DNA, 934 bp, Diabrotica virgifera
  misc_feature (13)..(30): n is a, c, g, or t
  misc_feature (771)..(790): n is a, c, g, or t
tttgtggtgatgnnnnnnnnnnnnnnnnnnaatgtaacggctcttttgcaacccatggatcagggaatcattgttaaatgtaagaaactgtaccgaaagcaagtgttacaacgtttacttatcgctgaacgagacgaagatagcgtgatcactttttcgaaacagttaaatttaaaagactgctgtcatatgttagcggactcgtgggacagtttgactaatgaaaatttaaaaaatggatgtaataaattatggaaaatacaagatgacaaacaaatcgaaagcgttcaggacgaaaatatgacacatatctctgcaatatgtcaaaatatacctgggttcgaagaatgtgacgaacaggatgttaatgaatggctcgaattcgatcataatctacaaggacatcaaatttatgaggacgatgaaattgtcgatatcgtttctaatatggttgacgataacgcagaggatagcagcgacgatgaccatgataatgatgatccaaagccttcacattccgatgcatttaactcattggaaactgctatgaagtggttcgagaaccagcctgagtctaattcggcacagttgctagtgctgaaaagaatccgcgatttagcagcaaagaaaagggcagccacagtagttcaaaaaaagatatcagattatattcatgtaacaaattaaacttactacatatgtatctattgatctctcacgtttacatactatgtactatacgagtatgtacgtaaatattttttttagagnnnnnnnnnnnnnnnnnnnnatgcagaaatatatttgtttattatgcaggtgttttattccttgtaactaaaacgtatgtacatacataccatgtttatgagcttttattttgaacatatgttggataatccgaacaattggataattcgaactacccctgtac

SEQ ID NO: 10347 - DNA, 360 bp, Diabrotica virgifera
  misc_feature (2)..(161): n is a, c, g, or t
  misc_feature (168)..(205): n is a, c, g, or t
  misc_feature (225)..(238): n is a, c, g, or t
  misc_feature (241)..(263): n is a, c, g, or t
  misc_feature (271)..(293): n is a, c, g, or t
  misc_feature (323)..(354): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10348 - DNA, 664 bp, Diabrotica virgifera
  misc_feature (71)..(87): n is a, c, g, or t
  misc_feature (89)..(101): n is a, c, g, or t
cttaagaaaaaccacctagttcctgtctagttttgttgctgaatgttatactcgtagaattgattgaatcnnnnnnnnnnnnnnnnngnnnnnnnnnnnnnccgctgatgatgtaattgctgagaaaagaacaacacaaggaaatataaatcttattaaacgatggctgtttgcagccgatgaaaaatatgtaccatctaaattatcagatgaattcatagttctgtttctattgtcttgtaacaatgacattgatgtgactaaaaagactattactgcctactataaattaaggaaagacgcacctgaactgtttgatgacagaacttccgagagagaagatattcagaaagccttaaacacactgagaatggtaagcataccaaatcggacagacgaaaactatcaagtagtgtatcttagtctaaaagatacagatagcagtaactttgaactgaatcccgatatgaaagcctcattaatgctaatatatatagaacaccacaatatcccaccatatggaattatgttactattatgatatgaaattattaaaatgaccactagtactgttgtataaaactatctcaaatgtgttagaatatttaatgtattcatttgtgatagtttctgatgtcatgtctagttacttttagatgtatta

SEQ ID NO: 10349 - DNA, 761 bp, Diabrotica virgifera
  misc_feature (2)..(44): n is a, c, g, or t
  misc_feature (52)..(164): n is a, c, g, or t
  misc_feature (174)..(726): n is a, c, g, or t
  misc_feature (736)..(759): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaagcnnnnnnnnnnnnnnnnnnnnnnnnac

SEQ ID NO: 10350 - DNA, 395 bp, Diabrotica virgifera
  misc_feature (5)..(37): n is a, c, g, or t
  misc_feature (39)..(71): n is a, c, g, or t
atgtnnnnnnnnnnnnnnnnnnnnnnnnnnnnnnnnngnnnnnnnnnnnnnnnnnnnnnnnnnnnnnnnnncaattaaagatgtttactgaataggataaaaaatgaagaagcgtctcgtgcgactccccgagaaatagaaagcaacaagggcggagaatagtttcgagtttgtgtttttttaaatagttgaactccgagttccaaaagatgatggtacactatccgaccgagatgtcggccaacacgttcgacgagtggtccaatcctacaatccataattagtatcgactcaggatctgaatccagatgcaaaaatattttatgtcagaggtgtaatagaattttatggcagtagcatccaaagcaaaaatgcgtcgaagatttagtgccaat

SEQ ID NO: 10351 - DNA, 891 bp, Diabrotica virgifera
ctccctcaagctgttgttgtgggctgcttggatcttcttcttgtgtgtgttacttacgtgtccccatgcgagagacgcgtatgttaatactggtaggattatactattgatcagtcttaaccttgttttcagtcttagtttgcttttcctgcctgtgagtcctcttagtgttgcttttgctatgttggccttccggactgtggcttctacgtgtttgtttttggaaggttaatcctttgtccatgatgactcctaggtatttagcttcgtttttccactcgatgggtctgttctgcaccgtcagctgttcctctggctgttgtcttcctttcttgtatagaaccgcttgcgttttatctgagttgatggctatcttccattttatgctccattcttctatttcttctaacgctgtttgcaggttggtcactgctgtatctacatttctatgatagaagataatgatatgcgtctctcattctttataagcacagcgctgtgagtggggcttgtctagccctagtggacgagaatttccgggaactttttggggctaggtcaggctatatttttttgcgccttctgcaatggttgtcccgagctgcatctcgggatagccaattgtatgttttagcatcctgactacaaatactgaaaaaactaaaagtgcgaattttgtcatgaaatttggtacgtggggttagaataatatttggaacaaccttttcaaataactttttccgatatctctaacgcgaagcaaaatatcgaaaattcgccctgtttgtagattcgtagtagatagcgtttaaaatttaaatttgagttgactatgactatctttaaaaatgtgagccatcactttttgcttgacttcaaaatttttaatct

SEQ ID NO: 10352 - DNA, 343 bp, Diabrotica virgifera
gccgcgtcttacagtggagctaactctatacccctattaagatttgagacatgagattttatgtgagacgacgtatcagtcgaagtagatttctgagatgcaaaatgattaaagcaatcatatagtacgacgcccgaaaggtaagttgagcaaaacgtagggctgtcttctactacttgttttttaacacatttgtacgccgagttcaacaacatgcgcagtcaccaaccccaccaaacgtatgccaacactgttcgatgagttgtttaaagatgcattgcgaactctgaattcttcctcgatcatgatcaagacgtaaaaattcctaatgtccatagtgtaa

SEQ ID NO: 10353 - DNA, 760 bp, Diabrotica virgifera
  misc_feature (391)..(409): n is a, c, g, or t
aattcatcgctgaagatgtcacaacagcagaagtggaaattctagctgagctctgcctgccttcttgaagataattcattattagagagggttgatagcctcatcaatataattgcttccttacaaaaatcaattgagaaattggatattatggatgtatattccaagcaaaattgaatataagaagagaggaattcccttccccaagatcttttcacaattgattttgaacgagtctttataaaaggtaatgaatggtggagtcgctgaggtagaaacctgagccttggctgaaaactgggttcaattttacttaattcgtatgtaaaatgttctcattgactaagttatgttaataatttaatcattttgtcacagattttatgttaannnnnnnnnnnnnnnnnnnttaggattaggtatactggtagtgtacaatctttgttaattctatgtaggggtgattccatttcaagtcactcaattttggatctccgatttttctgagaattggtgtatagcatctgcggagtgtaaaaataagatatttaaggttgaattgtcttctgatgaaacttcgtacccttgtaaattgtaactttcctacaatatgtattcaatattggtcgatagataaacagaaagaagtttattgcagcggtcgttattacaccactggcctagataataacacatgttgggaatttctatatacaagcagcagttgggttatttattacttcggtaaagaacgggaaag

SEQ ID NO: 10354 - DNA, 75 bp, Diabrotica virgifera
agtagtataatcattagttatttattggaagcaggaaagaagggctggatgataaaaaaaaactggaatttattt

SEQ ID NO: 10355 - DNA, 547 bp, Diabrotica virgifera
  misc_feature (2)..(98): n is a, c, g, or t
  misc_feature (110)..(129): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttaataannnnnnnnnnnnnnnnnnnnattgatctttaaaaataaccattaatgattgttttaatgttcaatatgagattatttaaatggatacattttcacattgctaattttggtggttatttttacctcataactacacatggggaaagcgctggaagggcctcatttcatgtcttgcttgttgctccacttacaataggcctcctgcagaaagtgattatgcagagcgaatgtgctttccatcccctgtgctaagggaagaataaacttcgttgtatttttctaaagctatgcggccatgagatagttgacaaaaaggttttgtttccagacactatgtagagccagcactaggagccttggaacagcttcgattatattagaagattcctttccttccctgtatctccgacttttcatcccagttgcatctttccccccc

SEQ ID NO: 10356 - DNA, 821 bp, Diabrotica virgifera
  misc_feature (778)..(806): n is a, c, g, or t
ccaaatattagtttttgttcatcatgagacaattcgtcgttctcttcgccatcatcgggctcagctactgtgggcgtctggaaaatacctacctaccacccaaccaaggaggagggtatgacagtgcagcccacgccaggttcaacaagatctcaactcatagagccaatagtttctcttctcaaaatagtttccaacaacccagcttcaacaacaaatactctgctcctgcaccttctggacctgctggacctatcaacaaagaagccaatgacgtccctattctaaggttagacaataacaatgacggagaaacctacaactatgctttggaaactggaaacggaatctctatgcaagaacaaggtgatgcttcccatgacggaactaacgctcaaggaggattctcctacactgctcccgacggacagcaaatctccatccaatatgtagctggagaaagcggtttcgttccccaaggtgcccatatccccactgctcctccagtaccagaagacatccaaaaagctctcgaacaaaacttggccgatgaagctagaggaattgtcgatgatggtcaatatagagaagaaggtgaatctggacaatacaaccaagcagcttatggcggacatggtggacgcaacgaacaggatactggagctagcaaaaacaatttcaacttccaaccagataagaaccaatacatccctcctagtcacaacggcaagcaagggtatcattattaagcactgatttttgttgtttattgtagaannnnnnnnnnnnnnnnnnnnnnnnnnnnngaatgaaaataagga

SEQ ID NO: 10357 - DNA, 104 bp, Diabrotica virgifera
gtgcaccggcgcggttttcgcggcgccccccacgcgcccggtcgtatcgtaatttttggttgagctatgaaataatcgtcaaacatccaagatgttgaacttcg

SEQ ID NO: 10358 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10359 - DNA, 428 bp, Diabrotica virgifera
  misc_feature (42)..(67): n is a, c, g, or t
  misc_feature (75)..(112): n is a, c, g, or t
caagtagtgttccttttattctaagtttaatttcgaacagtnnnnnnnnnnnnnnnnnnnnnnnnnnaaaatggnnnnnnnnnnnnnnnnnnnnnnnnnnnnnnnnnnnnnncacgtagattcttgtccaatcgaagtaccacagcacatttaatgctcaactgcaagagtgagcaaactcagtgctccaagttgcaatggaagcgataggccaaacaggactcatacgcaggacatagggcgcaaatcgaaaaaggttaccctgctagtgatgaagccccttgaacacggtatcgacaccaattgtaaggatatgtgatcaagatggcttcacagcttctaccatgaaatgcgggaagctccagaagaacacccagtactcctcactgaaaatccaatcaaacacaaggccatatgataaaagacga

SEQ ID NO: 10360 - DNA, 906 bp, Diabrotica virgifera
  misc_feature (565)..(583): n is a, c, g, or t
gatggacttcgtagtggtcgtatcttggtgtattatcatataaaacggagctgtgatagtggtagcttggagaggttagtcttcctaatgaatatcccaaaaagaaaccaagatggctgcttcctgtatctgctgtagtataatgataagttggtacataagctggataagaataatgatgattattattgttgataatcgttacatgacctccactgggatttgcactgtaagcaggtgacattgtcaagagaactggtgccattgtagatgtgcctgtaggtgaccaaattttgggacgtgtagttgatgccttaggtaacccaattgatggcaaaggaccattgaacaccaaacaacgtttccgtgtaggtatcaaagcccctggtatcattccacgtatctctgtaagagaacctatgcagtctggaattaaggctgtagattctcttgtaccaattggtcgtggtcagcgtgagttgatcattggtgatcgtcaaactggtaaaactgctttggctattgatacaatcatcaaccaaaaacgattcaacgatgctgaagnnnnnnnnnnnnnnnnnnnctgcattcacttcgccatcggtcaaaagagatctactgtggctcaaatcttgaagcgtctcacagacactggtgccatcaactacacaatcattgtatcagctactgcatctgatgctgcacctttgcaatacctcgccccatactccggatgtgctatgggtgaatttttcagagataatggcaaacatgccctcatcatctatgatgatttgtccaaacaagccgtagcctaccgtcagatgtctctgttgcttcgtcgtcctccagggcgtgaagcctaccctggtgatgtattctactttcactcccgtcttttggaac

SEQ ID NO: 10361 - DNA, 977 bp, Diabrotica virgifera
  misc_feature (813)..(813): n is a, c, g, or t
aatttacgcgttaaaatggagaatcaatcagattctccaattgttataaaaactagtaggaaaacaacacgttaaagatggaataattgattttacagggggctcattgggtggtgtggccttagtgtatgttggacaaccattagacacagttaaagtaaaaatgcagacatttccaactttatacaaaaatatgttcaattgtttcgcaaccactttaaaaacagatggtgttcgaaggggactatatgcaggaacagtgccagcattagctacaaatgttgcagaaaacgctgttttattttttgcttatggtttctgtcaaaaattcatgcaacatattacaggagcacaatctatagatgaactaagtactgtcaccaatgcaacagctggatttttagcagcctttttttcttctgttgctatatgtcctacagaattagtcaaatgtaggctgcaagcaatgcatgaagtaaacaacagcaggctcaattaggaaaagctgttaaaagtgtgggacctttgcaattgactgcagaagttattagaactgaaggagttaaaggcatgtttcgtgggttagtgcccactattgtgagagagatgcctggatatttcttcttctttggtgcatatgaaggtactagagagttattaaggaagccagaccagaaaaaagaggacataggtctagtaaaaaccatgattgcgggtggaatgggcgggggaatcttttggacagctctctttccagccgatgttgccaagtcacgtatacaagtcaacaacctgaaacgaaatatgatgaangtaatatttaagatagcaagacatgaaggcataggtgccttgtataatggtttgctgccaacggttattagagctgttccagctacagctgtcatggtccttacgatagaatatagtaaaaaatggatgcatcatatttcaagagattataggagcttttgatt

SEQ ID NO: 10362 - DNA, 742 bp, Diabrotica virgifera
  misc_feature (5)..(76): n is a, c, g, or t
  misc_feature (92)..(132): n is a, c, g, or t
  misc_feature (171)..(189): n is a, c, g, or t
  misc_feature (206)..(264): n is a, c, g, or t
  misc_feature (288)..(315): n is a, c, g, or t
  misc_feature (317)..(348): n is a, c, g, or t
  misc_feature (356)..(397): n is a, c, g, or t
  misc_feature (423)..(445): n is a, c, g, or t
  misc_feature (453)..(486): n is a, c, g, or t
  misc_feature (489)..(523): n is a, c, g, or t
  misc_feature (533)..(564): n is a, c, g, or t
  misc_feature (567)..(584): n is a, c, g, or t
  misc_feature (588)..(610): n is a, c, g, or t
  misc_feature (617)..(661): n is a, c, g, or t
  misc_feature (673)..(700): n is a, c, g, or t
  misc_feature (713)..(735): n is a, c, g, or t
gcgannnnnnnnnnnnnnnnnnnnnnnnnnnnnnnnnnnnnnnnnnnnnnnnnnnnnnnnnnnnnnnnnnnnnnnntgtgggtgctctcttnnnnnnnnnnnnnnnnnnnnnnnnnnnnnnnnnnnnnnnnnggtttttgttgttggtgtggtggggggggagggggccannnnnnnnnnnnnnnnnnnagaaaagggcctttctnnnnnnnnnnnnnnnnnnnnnnnnnnnnnnnnnnnnnnnnnnnnnnnnnnnnnnnnnnngcccaccatttaagagggggggcnnnnnnnnnnnnnnnnnnnnnnnnnnnncnnnnnnnnnnnnnnnnnnnnnnnnnnnnnnnntgtttggnnnnnnnnnnnnnnnnnnnnnnnnnnnnnnnnnnnnnnnnnngagcgctgttccctccccctcctccnnnnnnnnnnnnnnnnnnnnnnnggccccgnnnnnnnnnnnnnnnnnnnnnnnnnnnnnnnnnngannnnnnnnnnnnnnnnnnnnnnnnnnnnnnnnnnntcccgtcgtnnnnnnnnnnnnnnnnnnnnnnnnnnnnnnnncannnnnnnnnnnnnnnnnncgannnnnnnnnnnnnnnnnnnnnnnagcgcannnnnnnnnnnnnnnnnnnnnnnnnnnnnnnnnnnnnnnnnnnnnttcggtgtgtgnnnnnnnnnnnnnnnnnnnnnnnnnnnntcctttcctcctnnnnnnnnnnnnnnnnnnnnnnnccacccc

SEQ ID NO: 10363 - DNA, 84 bp, Diabrotica virgifera
  misc_feature (4)..(41): n is a, c, g, or t
  misc_feature (46)..(73): n is a, c, g, or t
gagnnnnnnnnnnnnnnnnnnnnnnnnnnnnnnnnnnnnnngaaannnnnnnnnnnnnnnnnnnnnnnnnnnngccacattaga

SEQ ID NO: 10364 - DNA, 51 bp, Diabrotica virgifera; identical to SEQ ID NO: 9123
  misc_feature (2)..(44): n is a, c, g, or t

SEQ ID NO: 10365 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (139)..(139): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttanaccggtgtgagccaggttggttnnnnnnnnnnnnnnnnnnnnnnnnnnnnnnnngaaagg

SEQ ID NO: 10366 - DNA, 518 bp, Diabrotica virgifera
ccccccctcgcccccggactgctggtggatgtgttatccaagaattttcttcccgtatactattgatattgggcgtaatgacattaacatcgagctatttatggtgttacagggtacacagcgcgtggtgggactgttctaaaaccttgccattcgtaaatcccacgaagaggggcgctgataccttttccccccctatctagaaagattagctactgtttcgaatcagcttcttacacttctgatctgcacatgcggaatgggagctacccctgttctgagcttcgacttcatcagtcaagcaagttctatggatctactaagaacatgaaactgcgagctgatgacatgacgacgttcatctgtatccgctatgtttcactgattgtaatctatatgcgccagcattcgagggtaagtataattcaaagtaatttcatatgggctgcttatgcaaaagacggcgatggaagcgcaccgtttgtgcgcatgaatgttcccccagtccctacttcttc

SEQ ID NO: 10367 - DNA, 235 bp, Diabrotica virgifera
  misc_feature (5)..(32): n is a, c, g, or t
  misc_feature (173)..(192): n is a, c, g, or t
cccannnnnnnnnnnnnnnnnnnnnnnnnnnnccttaagggaataacagcggtaattttttattgggggagttccaaatccataataaaagattggggacctcccaaggggtggaattaaaggtttaatatttggggggaagaaggttaatttttttatagtttggttccaannnnnnnnnnnnnnnnnnnnggaatcttgagggtttaaaacccggggggggggggccaggggt

SEQ ID NO: 10368 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10369 - DNA, 870 bp, Diabrotica virgifera
  misc_feature (557)..(577): n is a, c, g, or t
aaaaatagtgcggtagttttttggtgaattgaagcttttgtgattatcgagtggatatagctacaagcaaaatggagccagcaaccgtaacaggggtagatttttttcataaagaaaatgcacataaccatcacacatgcgagtatgagttggttaacgctgaagcacctacgccagtcttacgaagaggagcagtttttcagttgggaataaatttaaatagaaccttcgatcctgagcatgatgtaataagaatcagtttcgggtttggagaaaaacccacagtaatattgggcacaagagcagttcgaccactcaatccgaagttaaatcactttccgaaggacccccatgtatggggtgttatgctcaaagaaaataaaggaagttctgtgattgtgaatgttagaattccacctcaagttcaagttggaatttggaactgcaatattattagtaccattgctggacaaaagggagtaagaaaagattacaagttcgaagatgacatttacatcatatttaacccctggtgtcccgaagacggagtattcatnnnnnnnnnnnnnnnnnnnnnggagtacgtgcttaatgattgcggcaaaatttggtgtggcactttcaaaaaacctacaggaaagcattggatatttggacaattcgatgaaatatctttaccggcagcaatctttcttttggaaaagtccgcactagttactgctcaacgaggaaatccaattatggtttctagggcaatttcagcaatagttaacgcagtagaatgatggtggtctcttagaaggtagatgggatggcgattattcagatggtacttctccatttgcgtggacaggatcaactggcattttg

SEQ ID NO: 10370 - DNA, 567 bp, Diabrotica virgifera
  misc_feature (53)..(53): n is a, c, g, or t
  misc_feature (284)..(313): n is a, c, g, or t
ttgcatccggaaggactgcatgattaatctacctgtattgcccttccgatatntgccatctcgatacccgacccacaaagaacactccgaagatctgtaccacatcctgaactacgacttttacatttgtcttaaaataaagcttctcctaaacactctcccctatgtcttgatttcgtctgtgtccaatgtgaacaactatttcttcaaccattataaccctgacgaatatgaaggagcgaatattcgcaacaacactgcagaaaaaatgaattccacatctnnnnnnnnnnnnnnnnnnnnnnnnnnnnnncagagttgaatggaaggatacccgtgatgcagatgatcgttttcatgctggaaagtatatacttttcgaccacgcccgctagtatctttgtctccgactgcattgctcttgctattataagtgacttctctacacgagcgtctatggctgaagttgatagatgatcaccatacttccccagatctctgcacaaaacatacagatatctacttattaaagaaaagtttattcgccattccctgcgtgctctatat

SEQ ID NO: 10371 - DNA, 981 bp, Diabrotica virgifera
  misc_feature (53)..(86): n is a, c, g, or t
  misc_feature (94)..(114): n is a, c, g, or t
  misc_feature (118)..(136): n is a, c, g, or t
  misc_feature (299)..(354): n is a, c, g, or t
  misc_feature (397)..(420): n is a, c, g, or t
  misc_feature (426)..(490): n is a, c, g, or t
  misc_feature (576)..(605): n is a, c, g, or t
  misc_feature (613)..(656): n is a, c, g, or t
  misc_feature (659)..(672): n is a, c, g, or t
  misc_feature (726)..(754): n is a, c, g, or t
  misc_feature (766)..(823): n is a, c, g, or t
  misc_feature (840)..(862): n is a, c, g, or t
  misc_feature (875)..(894): n is a, c, g, or t
  misc_feature (953)..(971): n is a, c, g, or t
aattgtatattactctatttcaacatactcaaatatttttatagtagaagtgnnnnnnnnnnnnnnnnnnnnnnnnnnnnnnnnnnctgtgacnnnnnnnnnnnnnnnnnnnnnaagnnnnnnnnnnnnnnnnnnnccgtgctatatcaggcattattattgagtaactatatatttattatttgcccatttctaaaatataaagaattataattttcattgcaaaataaatatcttcaataattcttttgaaatgaaatgatattcatttttaactatatctaatctttccaaataannnnnnnnnnnnnnnnnnnnnnnnnnnnnnnnnnnnnnnnnnnnnnnnnnnnnnnncctatatttttacggatgagcttatccataaaactttattacnnnnnnnnnnnnnnnnnnnnnnnnggatgnnnnnnnnnnnnnnnnnnnnnnnnnnnnnnnnnnnnnnnnnnnnnnnnnnnnnnnnnnnnnnnnnacacattttattacaatatagatttaaattatttacatttaataatgatatataatattagtattaacataatggatatttagccnnnnnnnnnnnnnnnnnnnnnnnnnnnnnncctccaannnnnnnnnnnnnnnnnnnnnnnnnnnnnnnnnnnnnnnnnnnngtnnnnnnnnnnnnnntcctgattcatttgaatgtacgcgtcattttgagcgggctaagggagcataaannnnnnnnnnnnnnnnnnnnnnnnnnnnnaaccggtccccnnnnnnnnnnnnnnnnnnnnnnnnnnnnnnnnnnnnnnnnnnnnnnnnnnnnnnnnnncaaaccttcaaatttcnnnnnnnnnnnnnnnnnnnnnnntgtaaaaatgtcnnnnnnnnnnnnnnnnnnnncttttttcacaataaaaaattaatcaattctccaccctttcttttaattgggggcggannnnnnnnnnnnnnnnnnncttttttttt

SEQ ID NO: 10372 - DNA, 605 bp, Diabrotica virgifera
gctcggaggctcacagaggtgccccacggttgtcaacaaacaactgacagaagcgtttctatgcgatttaatcgaggtttggagtttgaagtgacgatatttggggagatcgctcctttggaatatggagtcttggcgcagttatgcaactatttgcaggttgtgcttgcagaaagacggctttatgctgggaatatttaatcacatacaaggcaaggacaggagcatttacaagaagattattgattgcacggcactccagatatccagtggagatggcttgcccaacgtaatttgccatagatgcctctacaagatacaattttgactggtataccgtcaactttgtttcatgcctgatgctactctgcgacaattgactggtgcaggaatagaaaacggatctgagactgataacggaaatacgtatatgccgatttatgacccatagtgaggtgtcgataacgtagggatggtagtggttccgcaagtctacaactatgaatcaaagtactagttggagaaggactccgccccgagatgcgcagaatactaagagttcaaaatggtcaaggccgaacggagcccgagggaaaatgggggat

SEQ ID NO: 10373 - DNA, 733 bp, Diabrotica virgifera
  misc_feature (2)..(44): n is a, c, g, or t
  misc_feature (52)..(728): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagc

SEQ ID NO: 10374 - DNA, 902 bp, Diabrotica virgifera
  misc_feature (90)..(106): n is a, c, g, or t
  misc_feature (851)..(851): n is a, c, g, or t
  misc_feature (866)..(866): n is a, c, g, or t
gagaactgctaaaatgatacgtgttttgataattttgtcaatatgtacggttgtttatggattgtcttcagagatcggaactctctcaannnnnnnnnnnnnnnnntgcgacaaacttcgtcacgatctacttttgaattatgataagttttcacgaccatcacatcattcaaacacgacgaaacttcgttttggaataagcattactcatgttgaattacaagaatttaaatctactttaacagtacatggaatgttaaaaatggtgtggaatgatgacaagctaaaatggaacgcttcaaactatggcaatctttcagtgttacggttagcagaacatgaattttggcaacccgacatttacttatataatagtgcgttgagcgcctcagttaatcaatacggaaatactcacagtttggtatatccaaatggggaagtattatgggtacctccagtacagttaaatgccctttgtcagttacatctaaaatattggccgtttgatacacaagaatgttatttaatgtttggatcgtggactcaccatggtgaacagatagatattcaaaattataatggcaaagataataactcagttatcgttgagttgatgaggattcttgacacagacatagaatggaaaattgtagaagctatacagtatgtggataaaaaagaatatgagtgttgccctgacgaagtatatccttatgtaagcgttaaattaactatatcaagagtttcagatgcctataaaattattttagtagcgcctatattattggtaatccttttaactttatggagcttctggttaccacctcaggctagtgaaaaagtaatcttanatggctgtacagcgngtatagtatccctgtttctactatattttacacaaa

SEQ ID NO: 10375 - DNA, 787 bp, Diabrotica virgifera
  misc_feature (281)..(338): n is a, c, g, or t
  misc_feature (377)..(394): n is a, c, g, or t
  misc_feature (517)..(535): n is a, c, g, or t
gttagatattcttaggtgttgttgtctaccttcagactcacatgttgattcgattttttgcactccatatattttgttttactttcatttatatatagaccaaatgtagctattcccgtttcagttctatagctttttcgcttaatatccttttgttgcggcttattatggcaacatcatccgcatgtgcgcatgtttgtatagatcttgtattaatacagccgttcatatttaattttctaacaacagcttccaaagttagattaagaagtgttgttgannnnnnnnnnnnnnnnnnnnnnnnnnnnnnnnnnnnnnnnnnnnnnnnnnnnnnnnnngagtaatttctacacaagaaacgtggaagcaaagaatgnnnnnnnnnnnnnnnnnntgaatagttcatgtaaaacggggatcaaagaaaaattgatgttttgattataaaatcaaaggatcaggttaaatgaattatatatagtacatgaatgacggatgtgtataaagccacgcaggnnnnnnnnnnnnnnnnnnntttgtataacctttcaaagattttagcgcatgaggtttgttctcagtatttctcaaaattacctagtcacacattgtattaacataacttcatcaatttaataaaaaaaatcttcaaaaatagatttctatatctcttcagatttggaaacacgtgataatcggagggggtcaaatcaggagaataagctggatgagaaagcaattcgaagcctaactcatgagtgtttgccattgtcataacgctcttgtg

SEQ ID NO: 10376 - DNA, 934 bp, Diabrotica virgifera
  misc_feature (17)..(36): n is a, c, g, or t
  misc_feature (788)..(805): n is a, c, g, or t
  misc_feature (902)..(902): n is a, c, g, or t
atacgccactgcccaannnnnnnnnnnnnnnnnnnncaaaagcaaccaagttatctcattgtacaaatgcttaatgttagacagaaaggaagaaatctcagaaagtgtcatcttaaaccgtttgaaaaactgtgtaaccaaccagcattggaccatactcatgcttggagggggacactttgctggggctgtcttcaaaggtaacgaacccattttacacaagacgtttcattgttacaccgtcagagccggccagggtggttcacagggtgctagagataacaagtcgggtggatctcaacctaagagcgctggtgcatctttgagaagatataacgaaacagctctagtgcagcatgtcaaatctatcgtggagacgtggaaaacagaaatagaaaacagttctttaattatgtatcgagccgctggaccctataacagaggtgttttatttgggggaagtacacctttgctagatagaaccaatcctaaattaagaaccattccattttcgaccagaagagccactttcacggaactgaaaagggtgcatcagttattaacgacagtaaatgtttacgattctctggaaactgcaactaaaaatttttccaaacaagtagctcccgatgttgatgctaaaagaaacaaagttcggacttcctgtatcaatagagccaagtctagagagaccgtagaaagacctctacccactgagcacctttccagtgacagtgaatcagaaaccgatcaaatctatttatctaccaatgatcaggaaatatctnnnnnnnnnnnnnnnnnntttgaggattcgctaacacccgaacaagaaaaaagcttgcaaagaagaaaaaccgagaaaagtaaaagtaaaaagtgaaagagctggaagacagtanaagaaggaactggggtagtgtatatccaatgg

SEQ ID NO: 10377 - DNA, 567 bp, Diabrotica virgifera
  misc_feature (2)..(566): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10378 - DNA, 551 bp, Diabrotica virgifera
gtcttactacatggaacaaattgttgtctatgaattacttctttatatacagggtgttggtctcatagggatttcgaaataaaaatggtcataacttgttaaatgctctgtatagtaatgcagaaccctatattatatgaacaagaattatgaggggaatataggtgtggaagggtatatggggtgtaccatttattgtatccataagataggggtatgatggtacttttgatagaggtactgttgaatacagtcaaacagaaagagatacaggatcaatgaatataagagctagagagagaaaaggaaatcaatgatgcacgagtatacgaacaagattttatgagtggtgatgatggggtatgaagattgcgactatatagaaaactatccccttatttttgcaggagtactttggttagcttggtaatgaagaaattttgcatggagtatcaccaagaatataaataaatgttatgagaaatgtctagacaaatgtctacagttactacctaatcatattagctacaccaacagggatatcagaaaca

SEQ ID NO: 10379 - DNA, 863 bp, Diabrotica virgifera
  misc_feature (677)..(677): n is a, c, g, or t
  misc_feature (781)..(811): n is a, c, g, or t
acggcgtagtaaaatttaacatacaactatgaggggtgatcaaaaatttcagaaccaatcgttagagaattatttcaaaatttttggagacggacaatacacatcacgtcgaccactacacaccctccagggggtcaggattgaagaggtagtcttctttcttcttctgtcgacgttcctcttctgcaccgcttattttttgaagtacctctccaggtacctgattatctatgctgtaggtttctaatactatttttggccaccgtacctacctgcttggctatcatcggcaatcacctggctggaccctgattggatggtcaatcagtttatgggtttcacgatgtatcctctgcattctgtttctgccgaggatatccctgttcttaagctcttcttgtgacctggtgaaagaatcttctggtcatattcacaggcacccttcgcagtagtgagtactggagactttcttagatggttggcggtgtttgaaagtcttatcttaccatgacgaaccaagagagttgtggaatgtggtttagaaattgtgcgatggtgtcctttcgtttaatattgtcaaaacatctgcccgtcgtacataggtgacgctagtattctttttctcatgatcatctttcagtgcgtcacagtttttcgatttctctctaacgcattanattgtatgtgacagaaaaaaaggcacgtctgggaatacttcggtaattattctagttcggtgattattctagttgtcgatagatggcgccataatcaaaaaagnnnnnnnnnnnnnnnnnnnnnnnnnnnnnnncaatataatctgtacaatttataagactatacaaatgaaagaaaataccatt

SEQ ID NO: 10380 - DNA, 952 bp, Diabrotica virgifera
  misc_feature (272)..(311): n is a, c, g, or t
  misc_feature (898)..(915): n is a, c, g, or t
ggtgaattatccaccatccctcacgataacgctgtctttgtttgatgtacaatatattcaagaataacttcatgtatatgcaaagaaccggggatagactatcactataccttttgtacttttcagccatctagtttagatatttgtcattttcgatttcttcagtagcaagttttttttgcttttaacaagtgtatatgccttcgaaacgccttattagaatataggctttaggtaataaacatctaccaggtatatccttgatacatacnnnnnnnnnnnnnnnnnnnnnnnnnnnnnnnnnnnnnnnnttgaatattaattgaaaatggttattcatttttaatttatttagaaatttaagaaatttttgtatacagtgatgagtgcgcgaataactggcaaaataacggaaaagacagaaaacataattagttatgatataaaaagagatgaaactagtagaggtgggagattatcaatagaaaactataaatttacattattttggtagtttcacacctttaaacgtatcggagtcaaactgtcacagaagaattttataaaggcggtatttacgaatctcattgatatatcacattaatacatcacaaaaaattgtcggccatgatggcaagttgctttgtgtacttgtttttggtactcgttgtaggtattacacgatgctggttttatatttgggtgaaagttaaaaattataaagaaagcctgtaatatatttgttgcttaatagtcttacgaaaattcagtgatttagaaagaactgtaagattttttagtgtagtcttaacatatatttatttctatatgtctatgttataatattaattacgctgattaatatagtgagattttttatatatacacacacgatagnnnnnnnnnnnnnnnnnnctttgtagaatataactttggagtagtgattaaaaag

SEQ ID NO: 10381 - DNA, 85 bp, Diabrotica virgifera
  misc_feature (9)..(11): n is a, c, g, or t
  misc_feature (15)..(58): n is a, c, g, or t
  misc_feature (63)..(84): n is a, c, g, or t
atttattgnnngtgnnnnnnnnnnnnnnnnnnnnnnnnnnnnnnnnnnnnnnnnnnnnataannnnnnnnnnnnnnnnnnnnnnt

SEQ ID NO: 10382 - DNA, 874 bp, Diabrotica virgifera
  misc_feature (173)..(199): n is a, c, g, or t
  misc_feature (208)..(226): n is a, c, g, or t
  misc_feature (278)..(298): n is a, c, g, or t
  misc_feature (305)..(344): n is a, c, g, or t
  misc_feature (349)..(405): n is a, c, g, or t
  misc_feature (428)..(479): n is a, c, g, or t
  misc_feature (492)..(518): n is a, c, g, or t
  misc_feature (521)..(534): n is a, c, g, or t
  misc_feature (598)..(624): n is a, c, g, or t
  misc_feature (626)..(642): n is a, c, g, or t
  misc_feature (652)..(669): n is a, c, g, or t
  misc_feature (684)..(706): n is a, c, g, or t
  misc_feature (713)..(755): n is a, c, g, or t
cgtgatcgctgatctagtctattcattgttgaaagtagtgagtatagcgtcggctgctataatatcttactatttattgaattataccatttataattatagaaaattgactgttcgtgccagggatgattagtttctaatgatatatatagttattttctaatttccaagtnnnnnnnnnnnnnnnnnnnnnnnnnnnatatagatnnnnnnnnnnnnnnnnnnnttttgataggatgtgctgttattcatatttcaatatatcttatttattaagnnnnnnnnnnnnnnnnnnnnncaacacnnnnnnnnnnnnnnnnnnnnnnnnnnnnnnnnnnnnnnnntatcnnnnnnnnnnnnnnnnnnnnnnnnnnnnnnnnnnnnnnnnnnnnnnnnnnnnnnnnntaagattataaattttcatatgnnnnnnnnnnnnnnnnnnnnnnnnnnnnnnnnnnnnnnnnnnnnnnnnnnnngttctttattacnnnnnnnnnnnnnnnnnnnnnnnnnnnccnnnnnnnnnnnnnncagtattagaatattgtatatttactaaaaacatataggtttactaagggaattcgggcgcagnnnnnnnnnnnnnnnnnnnnnnnnnnncnnnnnnnnnnnnnnnnnctagtctcgnnnnnnnnnnnnnnnnnnccgcgcggccgcgtnnnnnnnnnnnnnnnnnnnnnnngtaatcnnnnnnnnnnnnnnnnnnnnnnnnnnnnnnnnnnnnnnnnnnngaaagactgtccttatttaatttatagagaatttcattttttacgttgaaaagcttaagattttttcagaagacgaaaaaaccccattcgagttttataagattatcaataagtttttt

SEQ ID NO: 10383 - DNA, 790 bp, Diabrotica virgifera
  misc_feature (129)..(148): n is a, c, g, or t
  misc_feature (199)..(221): n is a, c, g, or t
  misc_feature (700)..(719): n is a, c, g, or t
cgcatattacatgattctagggattgttgagtatgcatgagtagttgtacataagtaataggttctgaatattgtacttcataaagaaaatgtattggtaattagcagtttcaaaagtcccttataatnnnnnnnnnnnnnnnnnnnngtggctaaaataaaattttcgaatttctttcgtccatattggatccgccannnnnnnnnnnnnnnnnnnnnnntaagatttgtaatcagcgaccttaacctaccaaatttcacaaaaaaattttcctttttgattcatattttcaatttctttccgccatgttggatccgccattttgtttttcaaaaaaataatgccatattcgtaatcagcgatgccaaaaacccttgagaatgaaagtaattccaaatgctgaagacgtggtcatgaggcgaaaaaaggagtccctatttagggattttcatgtttacagttgttttctcatactatcgtagagtactaatacgcaggtatgaggatcagactggatgtattctggttcacaactcaggaataagtgggccatgtccggggttattttgaccggcagagaaagtgaaaaagaacgcgtatattgaaaacgctataaaacgttttgtagtttatcaattttatcgctgtaaagcagattcttcttttttaagtatgtagtaatgtaagatgtaacttaannnnnnnnnnnnnnnnnnnnaatgccttaaatttgttaatgcataaatagtgaaaatatacttgaaattataaaaattttgtaaggaatgc

SEQ ID NO: 10384 - DNA, 775 bp, Diabrotica virgifera
aacatgtccaaacagtacatgattcctcaattctttgctgtttttggtctggtgttagaaaacgcgacacccatttggaaaacagatttctcatacccaatgttcatgtataatagtcaaaaagctctccttttttatttgtagagtgtcagctatctctttcaacctcattttgcgatatttcataatatttttccccgttttttcgattttttcgggaataactgccccatttggccctccacagcgcccatcattattgttgtctgtacttccccgttttaattcagcaaatcatcgtttaatggttatactcgaagagcaagagtcccgctgacatttgttgatccattgctcagtttggacagtattcttcccatcaaataacaaggataaacccatgaaattgttttgaatccattgtttagaaaaatcataaaagtagagccacttcaagccctggtcaggaatgcgtatgtcaggaaattttgacagtatgcttttgatggttaggactgccgaaatgtcatacggaaaatttattatagacgccatctcatggttagacccgagacttattgaccgacatattaaaaacgtccacattgtactaaattgctctctagaatcctagttactgcaagtttttttttttagtgtgtttacaggccatttaggcccagaacttagttgttcttttccatagctttttgttatttgtcaacttcttccagtctgttattcctttttcctttaagaattctactaccgcctc

SEQ ID NO: 10385 - DNA, 737 bp, Diabrotica virgifera
ctacatgttagtttataacgctctccaccattttgacgacttccaatcaccacttcgtatggttgttccacaggtcctcttctatgtctctttctctcagctctttgtttatttcttcgctcatttttttctcggtctacctcgctttctctttccttctagttgcaattttagtatatcctttggtattctttgttcatccattctttgtatatgtcccaaccagataagttgttttgttgatacatagttgttcatttgattcccattatttctctaatgcattcgttggtaatattttctcttctagatcttcttgctactcttctccaaagatcaatttctgttggtctcagtgttgccagtgttctttctttcagcgaccatacctcacagctgtatagagtgatacttttcactatagtctcatatcctcttgtgatgatggattggtcccataaaatgctgtttaacattgtgatggcttttatatctgacatatttctccctcgaatggctttgtctaatgttctgtagtgcaaaatactgatacctatggtttgtttctaaaccaggaggagtaaactagaaagacagattcgcacccaaaaaagtcactagaaaaatcaccaaatacatcttgttttttggttgatcatattggccttcaactgtaattagtgatgccaggtccgatttgattttaatcgctacataagcaaaaacaaatcggtatt

SEQ ID NO: 10386 - DNA, 880 bp, Diabrotica virgifera
  misc_feature (359)..(376): n is a, c, g, or t
  misc_feature (555)..(573): n is a, c, g, or t
  misc_feature (585)..(611): n is a, c, g, or t
ggggtagtgaagcgcaatacatgatgtcgtatcctgttggcatcacttagcctctcctactcaattcctatcttcacctccaagctggtacacaccgataacctgagcaaccccactggagattgggtaaccaaccccagtggaaggtggggtcagggctgacgaagaagggagtcctggtcctccgatgaatagggggttgggctgaaggttaactacctcctcctagaaaaactacgagttatgaatgtgaaaggaagaaaagccggactgatcaaacgatatatataatatatacgatttaattaaagggatttatatgcaaaattaaaatacataattttctttgcaattaaatnnnnnnnnnnnnnnnnnnacatacaattaataaattccaaaaaatttgacatttagttttacgatccagaaaatttaatgggatttctatggttgtttattggatgacaaaaaagaaatatttggttcaattgacgtggcacgtaatttaagtttgatcttccaaatgaacatcacttatttgacttcttaggcggnnnnnnnnnnnnnnnnnnngtttagtatcgnnnnnnnnnnnnnnnnnnnnnnnnnnnaaaaggccacaacttgggcaagaaaaggccacatgcggccttaaggccgcacgttcgccacccctgggctagactaacgttttgtgatatatttgagaaaagtagtacctttcagggttgtttattttcttgcggttggttggttgtatcagggtacctaatgtaagctggggaaaaaaggtggggttcttctggggccttagaagcgatcgtaagaagtaaaaaaaaagcactgtcgatcagacgaccaagtgaataggtcgattctt

SEQ ID NO: 10387 - DNA, 953 bp, Diabrotica virgifera
  misc_feature (785)..(785): n is a, c, g, or t
  misc_feature (857)..(857): n is a, c, g, or t
cataattcctttattggtacttgttgtatcgcactccaactgtatgtcaccaggatgcaactggatggaaaacgaggaagaatggcaatgcaattcgatatcccttcagtctcccgatccggaattagcaaaattaaatccaactgaagttcttagtctatgtttatataaagtttatggaaatattaatccagacttgttcacaaatttaactagtttaaaggtactcttattattagaaacggaatttaaaacttttaaatttaagtcaaatacacttcaaagtttgcagttaatacgaaacaaatttcccagaggatcaaatattaaaaattgttgttataaattagaaaaactaacactaaaaaataatactggtattagtctcaaacacgaagtgctatctagttttaaaagactgcgcagtttagatttaatattacaaaaagtgaaacacataaataaacatatattcaagggcctgaccaagttaaagaaactttcaatagtgaactgttcaacagaaactatagccgaagatgcctttagagacctttctcacctccaggagctctacatagaagataacagcttgagacacatacatccaaaagcattcgaaccactaaaacagttaacttcgcttagtatttacagtaacagattacccccgttaccacttactacttttagtgagcaaaagaggttaactcaaattggtttacctacgaatacgtggaaatccataactgttgaagacgtgccatatatgtttccccggctanattttttttcttacatgggtggatggaaaacagaagaagacaaataaataccaagtcaaatgttttcacganattgacaaagctgtttactgaaagggatgaaatataaactaaataatagttaattcagtattaatagtaatagagtaaaacagaggcttatgcttt

SEQ ID NO: 10388 - DNA, 647 bp, Diabrotica virgifera
gaggaatgtacattgttgcaaagctactttggtattggcggtcgaaagcagtaaaaaaataagtttttattacaccgttagaaacatacagggcgatcaaatcagtatgatttttaataaaagtgctcataacattcaaacgcttggtataaccttagacaagtgttatatctttttaatcagaaaaatgtagaggaaccagattttgaatgaaatatagggtgttctatttaaaaaaacataactttggtttggcaccgtgttatggaggaccctgtatatttctcactaattttaaaatgtgtacattaaaggtgtctataacttttattaacaacgttttttcatatattgtataataacagatatgttggactttgtcacagaagttgatcaccctgtatactgctcgtctataatttttagaagttcgatataaaacatggcaggtccaaggggattcccgcttttactaatgcgtgtacgcaagtaggatcttagtttatatcagtgcaagacggaagtgaggataggatcatgactatgatatggaataaatcaatagagaactgtttttagtatagtgtttcagcatgatttttttcggctatttagagggagcatgtattgttgttttaaatattaaa

SEQ ID NO: 10389 - DNA, 425 bp, Diabrotica virgifera
  misc_feature (31)..(51): n is a, c, g, or t
  misc_feature (63)..(226): n is a, c, g, or t
  misc_feature (233)..(270): n is a, c, g, or t
  misc_feature (290)..(303): n is a, c, g, or t
  misc_feature (306)..(328): n is a, c, g, or t
  misc_feature (336)..(358): n is a, c, g, or t
  misc_feature (388)..(419): n is a, c, g, or t
gtttataaaactctatagggtcttataaacnnnnnnnnnnnnnnnnnnnnntctatagggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10390 - DNA, 57 bp, Diabrotica virgifera
  misc_feature (3)..(39): n is a, c, g, or t
  misc_feature (41)..(55): n is a, c, g, or t
gcnnnnnnnnnnnnnnnnnnnnnnnnnnnnnnnnnnnnngnnnnnnnnnnnnnnnat

SEQ ID NO: 10391 - DNA, 101 bp, Diabrotica virgifera
  misc_feature (22)..(95): n is a, c, g, or t
acgaggaagacccctataggannnnnnnnnnnnnnnnnnnnnnnnnnnnnnnnnnnnnnnnnnnnnnnnnnnnnnnnnnnnnnnnnnnnnnnnnngggggg

SEQ ID NO: 10392 - DNA, 258 bp, Diabrotica virgifera
  misc_feature (2)..(252): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggttt

SEQ ID NO: 10393 - DNA, 670 bp, Diabrotica virgifera
  misc_feature (94)..(111): n is a, c, g, or t
acgaggtctgcacctataagttatgatatatatttccccactattcaaaatggcaaatattatttagtgactttcaacttcactagctttgggnnnnnnnnnnnnnnnnnnggaaatttcaacttgtgcactcattcctgttgatgggattggtccagcaatttcatcgtttgtacaaacaatcttccaacctgtcatcatgcctattgtatggtacagtgtatatgtgacacccgataatttcccaaatgaatggtttgccattcctcatgctgctattgtctcattcaaccaatccaaaatcgggctgaaaggtcctctcatgacccccgtatggaaaaggacactcatctttaaatcttgttctcatgaaataattcattctatatgccaacgtcttggccctgcttaattatatagggatataaaacttttcaccatcttgtagatgttatgaccattcttgaaaacacttaacgtgtatattctgttattgaattcgagattgtataccgagttgtacagagtattaaacagatatcatagtacgcatcctggagggttgctgatttcgcttttctatatgccacagagaacactacaaagaaagctactgctctacactaatctaacattatgcgcatgttcgacttacatatcttgagatcgc

SEQ ID NO: 10394 - DNA, 618 bp, Diabrotica virgifera
  misc_feature (303)..(324): n is a, c, g, or t
gttttgttaatattgactgtagagtagatctactttgggatttcaaaagctggtatttttgcacgagttttcaaagagaactttttgcgtaggttaattacggtcagagttagccatttttgttatttagtccacagttacttctgtgtacatacaattctcctgtaacagtgctagttaccatactcctccgaaacggcttgaccgatttttatgagattttacacatatatcctgtaggactaagaataggttttaacctatttttcatacccataagttgtaaggggggttgccccctgnnnnnnnnnnnnnnnnnnnnnnggacaaaattgtctatcttaattttgtattatgtatcattagttaatacatgcaacccttaattttcactcttctatctccgaccagtattatttactaaccatctatatgatttactacaaggaattttcctgtcttagtgtcagttgacagtactactcggagactgcttgaccgattatattgccattatttctagaagattatcttacttctttgtctaccgtatcaacattgcttttatattgagaactgggtagatggcttcacgatcgtgctttgtacagaagcgtg

SEQ ID NO: 10395 - DNA, 912 bp, Diabrotica virgifera
  misc_feature (667)..(688): n is a, c, g, or t
  misc_feature (806)..(807): n is a, c, g, or t
  misc_feature (832)..(832): n is a, c, g, or t
gtttgagttgaacaaataaataaaagtgacattaggaaaaataggaaatgcaaattatcacaaaatcataaatatgtttgaagatgtttaacaaaactataaatttgattaaatacctaataacttaactaaaacaaagtttagtttaattcaacatgcaggtagaaatcaaacccgaagtgaatagggaattaataaccataaaagatgaaccccaagaaactccaccaaactcctgcattaaacaggaaagtgatgttaatatggacatagatgctacaccagtaataaaacaagaacaaaatgaaacagtcaaaagcgaatgcaaggtagaaacggaaataaaatcagaacccctagatgttagcataaaagaagatgactcttcctttgaagatgatgatttgaatgtttcggtcgatgaacttaaagccatcagtgaagataaagatgtgactgttattgtaaatgaaacgactacctacaaatgtcagctctgtgatacaattttcataaaatacgaagaatttaaagtccacagaaagaatcattatattgagaaaagaagatgtcatctatgcaacaaagtattgaagagtctttcgttattggaagagcatgttaacaaacatatgggttttaaaccttacaaatgtgacgagtgcgnnnnnnnnnnnnnnnnnnnnnntcatctcagtttgcataaaagatgccacaataaggatgaaatcttcaaatgcaatcaatgcaacaaacattttaaaagtagtggttctcttagaagccatcggttagttcattccgannaaagtattgatgatttaaaatgtanagtttgtggttacaaatcacaaaaagaagcggagcacaaagaacacatgtctgagcatgctacaaaagaggagcttaaat

SEQ ID NO: 10396 - DNA, 91 bp, Diabrotica virgifera
  misc_feature (13)..(44): n is a, c, g, or t
tttgatccaattnnnnnnnnnnnnnnnnnnnnnnnnnnnnnnnntaacagcgtaattttattgggagagtcaatcgataataaagattgcg

SEQ ID NO: 10397 - DNA, 789 bp, Diabrotica virgifera
  misc_feature (254)..(272): n is a, c, g, or t
gttaaattaacaacatacatgttcagaaatgttgctgtatatattttggtgtttttcggttatcgaaataactcttgcacagatagatccatatagttctaatagcttaaatgaaaacccatataaccccaataatgataatagtcaggtatacaatctgaataatcccaattcaaattataatccggggttcaactaccctgatttgaatcaaaaccaagcaagtaatcttaatccaggatctacgtttaatnnnnnnnnnnnnnnnnnnnaaaatggatataatcgagattttaactacaaccagaattatccgagttcgaatcctgggtatggttatggcaggggttatggatatggaagtactgatgagttgagatgtccccaatactggattcgttatcaaaatacttgttataaatttgtccgatctcctcttcgagcttataatgaagcacgaaaaatatgtcagacctacagtccagataatggaggatctgacctagtttcaataagtaactccgacgagcatggctttattattaatcagttaaatgctatagaccctcaacacaggcgatggtacataggggcacatcaaacttctccaaattattacactaatgttgatggaactcaattggctaatatggataacgcgattatggaaattgattatccttatggaagagattacctagcatataacttttccaagcatcatttacattggggatttggacctgttagggggggtgaacctctgttgtttatctgtgaagcaaaaat

SEQ ID NO: 10398 - DNA, 148 bp, Diabrotica virgifera
  misc_feature (2)..(73): n is a, c, g, or t
  misc_feature (75)..(91): n is a, c, g, or t
  misc_feature (93)..(127): n is a, c, g, or t
  misc_feature (129)..(144): n is a, c, g, or t
annnnnnnnnnnnnnnnnnnnnnnnnnnnnnnnnnnnnnnnnnnnnnnnnnnnnnnnnnnnnnnnnnnnnnnncnnnnnnnnnnnnnnnnngnnnnnnnnnnnnnnnnnnnnnnnnnnnnnnnnnnnannnnnnnnnnnnnnnnctaa

SEQ ID NO: 10399 - DNA, 502 bp, Diabrotica virgifera
  misc_feature (2)..(54): n is a, c, g, or t
  misc_feature (91)..(150): n is a, c, g, or t
  misc_feature (156)..(246): n is a, c, g, or t
  misc_feature (287)..(304): n is a, c, g, or t
  misc_feature (332)..(360): n is a, c, g, or t
  misc_feature (432)..(483): n is a, c, g, or t
gnnnnnnnnnnnnnnnnnnnnnnnnnnnnnnnnnnnnnnnnnnnnnnnnnnnnnagctcaaatcttttaaagacgagaagacctatagagnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagggaaaccaccgaaatttttattgggaaagttcaatnnnnnnnnnnnnnnnnnncccccccgggggggttaaaggttttaannnnnnnnnnnnnnnnnnnnnnnnnnnnngtttccgcttttttaaaatttaatcgtgtattttggttgttaaccccgggggggggcccgcgcggggtgtgnnnnnnnnnnnnnnnnnnnnnnnnnnnnnnnnnnnnnnnnnnnnnnnnnnnnaaggggcccccccacccaa

SEQ ID NO: 10400 - DNA, 791 bp, Diabrotica virgifera
  misc_feature (632)..(650): n is a, c, g, or t
tcaaggccgcaagagctgacacatctaaaacgagacgactcctagaaacaatggagatgacaatactccgacgaatatcagggaaaagtctgttggatagggagagaagcgaaaacatacgaagatcatgcaatgtagaagacataaatggatgggtgacaaaacaaaaacaggagtgaaacgaacacattagtagaatcctagaggataggatagtacgaatagcacgagataagtcaccaaattgacgaagaagtattgacagaccaagaaaaagatggtgcgataacttaaacaatttaggaggctaatattgaagaagaaacaggctttaaagcctacatacaaaaaggaagacaacgacgttcgatggtattgttgtctattgtgacatcattttcattatgaggttttcttttgacggtcatatacttggttattgtttcgtttactttaatttgtactgatttggtatttatatggccaattacatctgtttttctgttgattgtcttaagagttggcttgaatagttaaatattccactggtagttcagccttttccgatatgttttttagtaatttgtgtattttgtctgttagctacgttcttctatatttttaacatttcnnnnnnnnnnnnnnnnnnntgacaaataatattatatatataaagggttgtctacagctaatgccgtttcccttccgtcagccaggacttccatttttttcgatcttcccagtctccgtcttccaaacctttcttagacatggcttcgtcgacttcattt

SEQ ID NO: 10401 - DNA, 230 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (135)..(135): n is a, c, g, or t
  misc_feature (166)..(184): n is a, c, g, or t
  misc_feature (196)..(220): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagnttaaaccgtgtgagccaggttggttctatcnnnnnnnnnnnnnnnnnnngtacgaaagacnnnnnnnnnnnnnnnnnnnnnnnnngataatattt

SEQ ID NO: 10402 - DNA, 78 bp, Diabrotica virgifera
  misc_feature (4)..(77): n is a, c, g, or t
ggtnnnnnnnnnnnnnnnnnnnnnnnnnnnnnnnnnnnnnnnnnnnnnnnnnnnnnnnnnnnnnnnnnnnnnnnnnna

SEQ ID NO: 10403 - DNA, 168 bp, Diabrotica virgifera
  misc_feature (9)..(44): n is a, c, g, or t
  misc_feature (56)..(80): n is a, c, g, or t
  misc_feature (82)..(152): n is a, c, g, or t
tatagaggnnnnnnnnnnnnnnnnnnnnnnnnnnnnnnnnnnnngaatttattttnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnngaacccccactttttt

SEQ ID NO: 10404 - DNA, 886 bp, Diabrotica virgifera
  misc_feature (156)..(177): n is a, c, g, or t
  misc_feature (656)..(674): n is a, c, g, or t
gaataagtaatgatcattgttttgcttgtaaaaattataaaatagttgtaaattgataattaaagtgtaaaatactaattataatattattgtgtgaataatatttatcagttcttactcgactgtatgtatcgtatcacattttcaaatagatgnnnnnnnnnnnnnnnnnnnnnngaatagaaacttgtaaatatatacactatttatgacatgtatacagctcaaattgttatagctttaaaattgttgttagttatgtgtaaggcttggaaaagtaatggaagctatttaataaagttgcggaaacattcgaaatttgacgctttgcttcttacgaaaactacgtgcacggtactacaaatatttataataagttcccaacgaagaaaaatctgcctaaacaattacacgtgaatcgatcgtgatttcgaactagaatcgcaggtaatcacaagcttccctcgcgctacgactcaccttctactctctctatccctatttcgctatccttttatcaatgaatatgccttagaaaagacgatcatacagtgttcgtatatttcgagcgctttttcttagctgtcaatattttatggtgatttactgtagaaagaaaaattgcttctatttttctaccttttttatttctgagnnnnnnnnnnnnnnnnnnnattttgttagttgatttggagatattttttcctacatccatgctaacttaaagttacattgatttactttctttatcacacttaattcaataagtcgtaagcctaagtttcttttattatctcctagagagatctgcgtttttctgacaatgaagctgatgatgtgtagtctcattccatgaaatatctctttaaaagtatcccaacttatc

SEQ ID NO: 10405 - DNA, 288 bp, Diabrotica virgifera
  misc_feature (17)..(43): n is a, c, g, or t
  misc_feature (73)..(98): n is a, c, g, or t
attaaattgaattactnnnnnnnnnnnnnnnnnnnnnnnnnnngattgatattaaaaattgagatataatatnnnnnnnnnnnnnnnnnnnnnnnnnngcctctgtaccgtgttgaatcatgagattagtatttagtaatatatatatcaactatttacaaattaacaagatctaaaaaattaaagattacatcgcaaagcaaacataatgacagtgccatatagtaagctacgaggatactacatttcagtatacccctaagactgattcagttaaattttctaaaa

SEQ ID NO: 10406 - DNA, 237 bp, Diabrotica virgifera
cagtgataattttttttatcctttcaacattgttaaagatactataacgcgtcaacttggaatagctgtaaatacaagatcgagttgacagacctatgtgaaccgtaccataaaaataaaagatatgaatctataaggtttttattttttgtgatttatggtatgcagccagtacaggagttttttccttgtgatgtttttgttatactacacagggaaaaaatagtaagaccatta

SEQ ID NO: 10407 - DNA, 692 bp, Diabrotica virgifera
gatttctaagaccttctatcagcagttgcgttcttccgaacgtcaaagcttagtgggacctccggaaagcatgcgagagcacgtcgtcgcggcggctaaagcaatgaggaacggcaattgggcggcatgcaacacttttatcattaacgacaagatgaatgccaaagtgtgggatctgttttaccaagccgaccaagttagatccatgttgacgaaattgataaaagaagagtctttgaggacgtatttgtttacctactcccacgtttacgattcaatttcgatggccactttggcggaaatgttccagttgggcaaacccgtcgtgcattctattatttctaagatgatcattaacgaagaattgatggcatctttagacgacccgactcaaactgttgtaatgcacagaagcgaaccatcccgtctacaatctttggctttgcaactggcggataaaatcaacaatttcgtcgattccaacgaaagaatattggaatccaaacaaggaaacttcttcctaaggggagcaaaccagggcaatttccgaggagataggcagaactaccgcggaaataaccaaaactgggataggcaacgtcgagacagggatagaaaggaaaaagataattattaataaacatagatcttttgtatttctttttatggctttgttacggttgcctataatt

SEQ ID NO: 10408 - DNA, 635 bp, Diabrotica virgifera
  misc_feature (389)..(425): n is a, c, g, or t
agtatagcttgtatatgtattattgaaataattaagtgtttatgcagagaaagcaagacagaattatgtagaggtatgtaataactgcttcttgagtatatcatatcctcggactcagtagaatagttagtagtgtattctgtgcatacagcgaatctacgagttgatatattgtacaattgcatacaaaacatagatagtataactctcaacacaaaatattatatatagctcatatagtaatatgagccatacatttctaagtcttctgcgatgaatctgtgcagcaagatttttcgaaatgtatcgaataatccatatttctgtaggatgctgtttgagaaaccgatcttagaggacttaaaatctcgcattgtaatgaaaagctnnnnnnnnnnnnnnnnnnnnnnnnnnnnnnnnnnnnntaaggtgtacattatgctaaatatgatatacaatccctatttttgctttttcctacaaagatcttcatggtagtagggtcagaacaagatgtatccggaatttcctatctactcataggataacctctattgcagacgaggaataaactaatgtagacgactgattgaagattgccacataaatttctgacccggcggatggaaagatca

SEQ ID NO: 10409 - DNA, 464 bp, Diabrotica virgifera
  misc_feature (5)..(340): n is a, c, g, or t
  misc_feature (374)..(403): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattagcaatgatgtataatattattcattacnnnnnnnnnnnnnnnnnnnnnnnnnnnnnnattatcatatttagataatacgatcattttttatacctatttagtaaaaccttgtactttt

SEQ ID NO: 10410 - DNA, 341 bp, Diabrotica virgifera
  misc_feature (2)..(2): n is a, c, g, or t
  misc_feature (9)..(44): n is a, c, g, or t
  misc_feature (49)..(69): n is a, c, g, or t
  misc_feature (73)..(96): n is a, c, g, or t
  misc_feature (128)..(155): n is a, c, g, or t
  misc_feature (296)..(330): n is a, c, g, or t
gnggtgatnnnnnnnnnnnnnnnnnnnnnnnnnnnnnnnnnnnnatatnnnnnnnnnnnnnnnnnnnnnccannnnnnnnnnnnnnnnnnnnnnnnattaccttaggggatacagcgtaatttttaannnnnnnnnnnnnnnnnnnnnnnnnnnngggcaaccctcgaatgttggaattaaaggtttataattgggggtagcagctatatttattaaggcctgttccaactttaaaaattttaactggatctggagtttaaaccgggtggggagcccagggtgtgggtttctattnnnnnnnnnnnnnnnnnnnnnnnnnnnnnnnnnnngaaaaggggcc

SEQ ID NO: 10411 - DNA, 200 bp, Diabrotica virgifera
  misc_feature (7)..(70): n is a, c, g, or t
  misc_feature (76)..(102): n is a, c, g, or t
gttttgnnnnnnnnnnnnnnnnnnnnnnnnnnnnnnnnnnnnnnnnnnnnnnnnnnnnnnnnnnnnnnnnatttgnnnnnnnnnnnnnnnnnnnnnnnnnnnggacttatttttaagaataatataataaataatagtttatccataataaaaggttgaactaaagatgagctttatacatatgcttatttgcaattatg

SEQ ID NO: 10412 - DNA, 230 bp, Diabrotica virgifera
  misc_feature (139)..(167): n is a, c, g, or t
cgctgcccttattgtggccaccacggacaagcgatgaacaatgacataatcgatatatataaaaattcatagcccctgccttgagacaatcattactaaatagacctatagcgcaacccaactaccaactgatactttnnnnnnnnnnnnnnnnnnnnnnnnnnnnncacaagcagaaaaggcgaactagaatacagatagccaagatactcgactacgagcaatctata

SEQ ID NO: 10413 - DNA, 141 bp, Diabrotica virgifera
  misc_feature (96)..(96): n is a, c, g, or t
gtggaggctactcactggttgggtcgagagtggatacaggctctggaaatcaatttacatcagatggatacctttttgcttcgatttcttcgagtncaaaagttcagcattcctatggcagaacagaccctccctgagtat

SEQ ID NO: 10414 - DNA, 340 bp, Diabrotica virgifera
  misc_feature (9)..(9): n is a, c, g, or t
  misc_feature (16)..(17): n is a, c, g, or t
  misc_feature (26)..(62): n is a, c, g, or t
  misc_feature (71)..(71): n is a, c, g, or t
  misc_feature (102)..(102): n is a, c, g, or t
  misc_feature (195)..(213): n is a, c, g, or t
  misc_feature (220)..(238): n is a, c, g, or t
  misc_feature (256)..(330): n is a, c, g, or t
ggtgattanaaaatannatttaactnnnnnnnnnnnnnnnnnnnnnnnnnnnnnnnnnnnnncccaatttnttttgattataagaaataattaccttagggnatacagcgtattttttttttggagaggtcaatcgataataagatggggccccccagggggggggttaagaggtttaaaattgggtgtagcggnnnnnnnnnnnnnnnnnnngggtccnnnnnnnnnnnnnnnnnnngggtttggggggttaaannnnnnnnnnnnnnnnnnnnnnnnnnnnnnnnnnnnnnnnnnnnnnnnnnnnnnnnnnnnnnnnnnnnnnnnnnnggggggcccc

SEQ ID NO: 10415 - DNA, 899 bp, Diabrotica virgifera
  misc_feature (91)..(106): n is a, c, g, or t
  misc_feature (149)..(167): n is a, c, g, or t
  misc_feature (465)..(492): n is a, c, g, or t
  misc_feature (783)..(783): n is a, c, g, or t
cctaattagaaagaagatttccattactgtaaaaaattgctctcttttattttaccatttcgttaggcataactatattgacaaatctatnnnnnnnnnnnnnnnnagttaagatttagatctgtgatataatttggagaatttatcannnnnnnnnnnnnnnnnnnctattccaagatatttttttaggaaacatcttatttttagtgttttgttaaatagtaaattgatatttttgatgacattcataatagaacaaagtgagcggattaagcacaggcttggtagaaataattagaaaaataaaaaggaattaatatctataatttcttatgctacaatgcttcatatattttaagaatttaggttccttatcatttctgtatatttgcaaattaagggggccagtccaggtagcattactttaaaaataatttagaaccaaatataattctactaagtagnnnnnnnnnnnnnnnnnnnnnnnnnnnngtcatttgtgcctttcgtagttgataatcaacatttccagcgcattatatatgtatatttttggtgggcatatattgttatcctgaattatataaattttagtcttttcagcccttagaaacttgtgaattatatgctgatagatcaagttctacggagctgaagggacaaaataacagcgattaaagtataggtggtatgagagatgtatggcatgtagtggcaaaactaatttctttagtgaaaagttttatcttctactggaagatagagaaagagtacagtttgtcnaatatacggtgatacttggccgtattgatattaagctccacctacgatgcgcagtcacagaaacacattctctgaatggcgtcccacttacagtttattcgcatggcttatgcact

SEQ ID NO: 10416 - DNA, 502 bp, Diabrotica virgifera
  misc_feature (7)..(43): n is a, c, g, or t
  misc_feature (65)..(65): n is a, c, g, or t
  misc_feature (79)..(101): n is a, c, g, or t
  misc_feature (109)..(130): n is a, c, g, or t
  misc_feature (166)..(190): n is a, c, g, or t
  misc_feature (199)..(294): n is a, c, g, or t
  misc_feature (488)..(500): n is a, c, g, or t
taacagnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaaccgtgtgagccaggttggtttctatccnnnnnnnnnnnnnnnnnnnnnnnnnaaagggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctctagggaaccaggcttacgacccgcggggtgggccacggctaaaccccttctaataaggccccccaaaattcatttccccgggcccgccccgttttaacaccgcccgggggggggaaaaaccccgggggtttcccccctcttaaccccccttggcggcccatccccccccctttccccccgcgggggcggnnnnnnnnnnnnnga

SEQ ID NO: 10417 - DNA, 342 bp, Diabrotica virgifera
  misc_feature (5)..(5): n is a, c, g, or t
  misc_feature (14)..(32): n is a, c, g, or t
  misc_feature (41)..(61): n is a, c, g, or t
  misc_feature (76)..(240): n is a, c, g, or t
  misc_feature (242)..(311): n is a, c, g, or t
ttgcnccgcggatnnnnnnnnnnnnnnnnnnnctaatcacnnnnnnnnnnnnnnnnnnnnngggatgggagggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnncattttttttggattataagaaaaaaattta

SEQ ID NO: 10418 - DNA, 823 bp, Diabrotica virgifera
  misc_feature (22)..(58): n is a, c, g, or t
  misc_feature (507)..(525): n is a, c, g, or t
caaatattagcaaataaaatgnnnnnnnnnnnnnnnnnnnnnnnnnnnnnnnnnnnnnaagaatgggtaagtattctagtgattcagaaaatgaaaggcgcgggagtaaaagttcaagcaaagctaaaagcaggcgtagatcttcctcttcagattccagtgattccaaaagtagaagtagcaggaggagatcggataagaaatctagtcgccgatctaggaccaggagtcgggatagatccagagacagatacgggaggtctaggcgttctagaagtagaagcagctccacatacaaatcatcaaaatccagatcatacagatcaaaatccagagatcgctatcgagatagacacagaaggtcaagatctagagatagatacagatctagacgttccaggtctaaatcttacattaaagaatatgtgagtaaaccaaaaagaagatcacattcaagttctagtacaagcagtagtgaatgcgtcaaaacaaatgtaaagcataacnnnnnnnnnnnnnnnnnnngtaataccaagggcactgtcagtaaaaaggagaaatcggcttctccagattgtattgtaatagacaatgaagttttagatgaaataaatgagaatagttttgctcccaaacaatttacgtcgaagtcaaagaaagttccagaaaatattgttatagacttaaagaaaaatactattacagttccagaaattgaacaagaagagccagatagcatatttcatcagaccctatgtctaagtgatgaagctcgcatggaaaagtgggtgagagaactatattcattccgacagaaagcgct

SEQ ID NO: 10419 - DNA, 764 bp, Diabrotica virgifera
  misc_feature (385)..(408): n is a, c, g, or t
  misc_feature (663)..(680): n is a, c, g, or t
aaaagtatttttacgtttattttaattctttgttgttatttttatacttttatacgctcaatcattatgagttcctaagataaagtaaacgaaaattaatttacatatattttaatatggctgcaataaatgagttgagggtaacattatttagttgttgtattccccagcctcctaagagaaaacatcacattgataggtcaatgataggatatccaacgaattttcaacacacaggtcatgtaggtagtagagatgtagaaatgccaggtgaacaattgatagcactccaaaaccaaatgaaaagtaaaggtggatatgaaactccttacaaggaaccagattggtgccagtaagtcggatagttggtactatataggctagnnnnnnnnnnnnnnnnnnnnnnnnaatcagatttatttccaaaatgtatataggtaataagatatggaaacaagtttatatgttataaataatattatcgaacaaaattatcacattataattcgtgtatatataatttgtttcagtaagatttgactgtttataaaatagtatcttagtttctggtattcatactcattttttgtaaaacattatttataagctattaagaattattagtaggacaaaccgatattttcatactggttctagagcccnnnnnnnnnnnnnnnnnntttactttatttgttgacgggttcctttacttacaggttctatttttatatgaccaaatatctaaaatagagatgtcttattct

SEQ ID NO: 10420 - DNA, 787 bp, Diabrotica virgifera
  misc_feature (2)..(50): n is a, c, g, or t
  misc_feature (52)..(772): n is a, c, g, or t
  misc_feature (777)..(777): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataanatattaatag

SEQ ID NO: 10421 - DNA, 93 bp, Diabrotica virgifera
  misc_feature (2)..(20): n is a, c, g, or t
  misc_feature (22)..(45): n is a, c, g, or t
gnnnnnnnnnnnnnnnnnnntnnnnnnnnnnnnnnnnnnnnnnnngtctgcaacattctattcacctgcacgactgcccacatgttcttttgg

SEQ ID NO: 10422 - DNA, 728 bp, Diabrotica virgifera
  misc_feature (177)..(204): n is a, c, g, or t
  misc_feature (472)..(495): n is a, c, g, or t
  misc_feature (628)..(715): n is a, c, g, or t
agttatactaacacaatgtccgatctaagtgccagagacgttgaaagggccaactttgtcttttccatctacgactttgaaggaaatggcacagtcgatgctgttaacttgggagacatgctcagggccctcaaccttaacccaaccttggtcacaatagaaaaagttggaggaacnnnnnnnnnnnnnnnnnnnnnnnnnnnnctagatgaattccttcccatcttcagccaagtaaagaaagacaaagaacaaggtaacttcgacgatttccttgaatgtctcaagttgtacgataaagaagaaaacggtaaaatgatggctgctgaactttcccacacactcctttctcttggtgagaggttagctgacgcagaaacagaacaagtcttagccgattgtatggacaaagaagtgatgatggcttcatcccttacgaaccattcctcaaaaaactgatggcgtaagatgnnnnnnnnnnnnnnnnnnnnnnnncacctgagaagtgctgtcaaattgaaatggcttttcgaacaacagaaattgaacaccagaagtcaaacaggagtgtgtactaccaccaacattcataggcactgcctttaccaaccacatttcaaatacgctnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgtaagatac

SEQ ID NO: 10423 - DNA, 233 bp, Diabrotica virgifera
  misc_feature (30)..(30): n is a, c, g, or t
  misc_feature (56)..(56): n is a, c, g, or t
  misc_feature (80)..(102): n is a, c, g, or t
  misc_feature (104)..(104): n is a, c, g, or t
  misc_feature (110)..(131): n is a, c, g, or t
  misc_feature (161)..(192): n is a, c, g, or t
  misc_feature (200)..(230): n is a, c, g, or t
taacagcgtaattttatttggagagttcanatcgataataaagattgcgacctcgnatgtggattaagtttataattggnnnnnnnnnnnnnnnnnnnnnnntngtcgannnnnnnnnnnnnnnnnnnnnnagtttaaaccggtgtgagccaggttggttnnnnnnnnnnnnnnnnnnnnnnnnnnnnnnnncgaaaggnnnnnnnnnnnnnnnnnnnnnnnnnnnnnnngat

SEQ ID NO: 10424 - DNA, 974 bp, Diabrotica virgifera
  misc_feature (115)..(135): n is a, c, g, or t
  misc_feature (540)..(554): n is a, c, g, or t
  misc_feature (643)..(643): n is a, c, g, or t
gcatgtagttacattatcggcatcttaaagtttttgtccgaaaatgaagaggatagatgtgaaatgacatatatgtttgagtatcctcagtatgtgaaaatttcaaacaaagctnnnnnnnnnnnnnnnnnnnnnggattgtacgcctatagtgaaggaaggctcactgagaggacacgaaatatgtattttgatgcaataccggtactttttataccgggaaatgcaggatcgcataaacaagttcgctctctatcctcggtagcattaagaaaatggatgaattcaaggacatcttaccacttcgactattttgcagttgatttaaatgaagaatatagcggcctgtatggccctttactttttgaccagttacgttatgttaacgcttcactatatagaattttggagttatacgcagacaggcagaagcctcctgaatctgtggtggtagttggacattccatgggtggaattattgctatgaaactgctctctgaattagaacaacctgaacttatatcagtattaataaccttnnnnnnnnnnnnnnnaagagcagcaatgagcttagactaccacatgaacaaattctatgaaggaatatttgacgagggatttcagtgcaaccactgtcgtcagnttagcaggagggatataagatattttgatgcatccacattttactaaaaggcaaaataacgagataatccatgtttcgacatcaccattccaatgtcttggactgagagcaaccatgtacagatactatggtgtaaacaggttgttatggctctcaatagagctttgttcgatagcgttgacatgaaaacacgactgatctcaacaaataccacataccgtaacgaggcgttcaacatcatctcatcaggaatagcggaacaaaggttaaaaccacgaacagtattctaaactggtcactatccatacaaaaggcaaatggatagatgata

SEQ ID NO: 10425 - DNA, 815 bp, Diabrotica virgifera
  misc_feature (122)..(149): n is a, c, g, or t
  misc_feature (274)..(275): n is a, c, g, or t
  misc_feature (630)..(630): n is a, c, g, or t
gaagacgataccaaaacagacgaaacagcaagcgcagaagacgatggtaaggatgaagctagcaatgaaggggacgatgagaaagctgatgagaaggcgagcgaagatgaggagagtaaagnnnnnnnnnnnnnnnnnnnnnnnnnnnnagatggggagagtgaagaaccgcaggctgagagtgaggaagaaaaagctgatactgacgatagtaaagaggaagctgaagctcaacaaacgcagatgactcgactgaagatgacggtgcacaacnnagatgaaagtaagaggaaacagctcaaccagatgattagagtgaggaacatggagacacgttagaggaaaggatagaagccgaaaatatagagcattaacacaatccccaaaatccagatgatggaaggcaaagaagacgaaccagcagcacaaggtgaagatctaaaaggaagtatagaagatccagctccaagtgatgtagagccagcccagagtggagaggaacacacctaccaaccccgaaatacaccagataccaagaggatgactcaaggaagatgatgtgaaagatgtgactccaaagagatgaaaaaatggacccgaagaacataagaagccgcaaaggagtactanggacgaaacgacgagacagtaagaggatgacatgacgcacaaaaatctattgatgatgctcaggtgatggatagatcaaaggagaagaactactttaaagaaatgcatcaaaggaaatcaaagaggagagcagctacaaagaagagtagatgataacacaagaggagtcgagaggtcgcggagtc

SEQ ID NO: 10426 - DNA, 263 bp, Diabrotica virgifera
  misc_feature (3)..(16): n is a, c, g, or t
  misc_feature (181)..(253): n is a, c, g, or t
ccnnnnnnnnnnnnnntagaataaataccctaagggataacaggggattttttttggggagggtcaatcgaaaataagatggggacccccagggggggtaaaggtttttaattgggggagaggcaataatatttataaatctgttggccctttaaaatttttatttgattcgggggtgtannnnnnnnnnnnnnnnnnnnnnnnnnnnnnnnnnnnnnnnnnnnnnnnnnnnnnnnnnnnnnnnnnnnnnnnncgggcccgcg

SEQ ID NO: 10427 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10428 - DNA, 547 bp, Diabrotica virgifera
  misc_feature (125)..(137): n is a, c, g, or t
  misc_feature (139)..(151): n is a, c, g, or t
  misc_feature (161)..(181): n is a, c, g, or t
  misc_feature (198)..(227): n is a, c, g, or t
  misc_feature (290)..(312): n is a, c, g, or t
  misc_feature (320)..(351): n is a, c, g, or t
  misc_feature (447)..(470): n is a, c, g, or t
ggctagcagcctctgttatgcgatgtggtattaatacaggatggcagaactcttatttaatgatcgcttatttagtattgtgcgagacgatcttactttcataaaccgaacacttattgtttggnnnnnnnnnnnnncnnnnnnnnnnnnnctaatcatcnnnnnnnnnnnnnnnnnnnnntaagagctaaacacagnnnnnnnnnnnnnnnnnnnnnnnnnnnnnncacaatttttctgtaatgaaccgacattccctttccagtatatctacttttttaggaatgacnnnnnnnnnnnnnnnnnnnnnnncatttccnnnnnnnnnnnnnnnnnnnnnnnnnnnnnnnnctttttcggcatgagcttcaaaatcagattttattaatattcaacttccacataaagattaccattaaacatcttcatattaccaaaacatgcccnnnnnnnnnnnnnnnnnnnnnnnnctctcattgtgtacacgtttttcattacaatataaattctgattcttcacatttacgtacccgatgacaatattagc

SEQ ID NO: 10429 - DNA, 939 bp, Diabrotica virgifera
  misc_feature (254)..(284): n is a, c, g, or t
  misc_feature (429)..(443): n is a, c, g, or t
  misc_feature (878)..(878): n is a, c, g, or t
cgaaaacggtcctaatttgaataggctacggaatcacataaatatatagcatttctgtgccaattagagatacattacttttaactatcttattttttctgcacttataagttctcctataaatgaattccacagtttaaccaatacagaatacaagtatgtagatttattatcttcttcttaacgtgccctatcaagtccccttgacgttggcgattaacatggcgaaactgtctctgtctcgagctattctnnnnnnnnnnnnnnnnnnnnnnnnnnnnnnncactcccggatattcttcaaccaagaggcctgctttctaccaattcctctgcgtccttcgattttacccatcataataagttgaagaatattataccggtctccccttactacgtgtccaaaataggccatctttctatatttgnnnnnnnnnnnnnnntcgcgggtagcatttgctctcttaaggactgccacatttgtcagcatagccgtccatggtattttcagtatacgtctgtgcagccacatttcaaaggcctccaaacggttaatggtggatatttttaatgtccatgcttcgacaccatacaagaggactgaccaaatgtagcatttaatcatgcgctttcgaagttgaagttgcaaggtatcattacagaagaatgacctcatttttaaaaatgtcgtgcttttttttatttatcgagatttattatacagtacataattattggaaacatcgcataagacctgaaggtaaaataacaactcaataaaagaaacatgtgtatataaatacttgtgggaaactttaaaaaatacaggatcagatgatggatacaaaatgggtaaccgaaccatgagaatactttgncacgcagatgatgcaatcttaataacccgaaacgagatgactttacacgcctactacaaaa

SEQ ID NO: 10430 - DNA, 947 bp, Diabrotica virgifera
  misc_feature (535)..(557): n is a, c, g, or t
aaacttcaaaacaccgaaaatttcataatttttgtttttcaacaaaatatacctacaagcaaataaatttaaattggaatgaaacatgtcaactgatcaacaagatcttgatttatcagtacaccatcaaatttatttaaaagacagtgatcaaccacataatattcaaagaaaatgtcttacacacttggtaaaagtatcctctaatatattggacaacgaaaatacttgtactttagtagaccataaactaaaagctcttgcagatatattagataaaggccatgaaaatgtttatgacaacagaataaaatcgcttcttttaaaatctggcaaggttgcaggaaataacattaaatctcagttatccaatataaatcctcaacagtatattacagctttgccttgtacctcagaaaaaagctcctgctataattctgaaaattttgatgaagaattgcaagatttattggatacattgaaacaaaacaaaagttgtaaacctgctcaaaacccagaatttctaaaccagtcnnnnnnnnnnnnnnnnnnnnnnnatcctaacaaaaaatcctatatagaagaaaagactaaaagtaatgataatatgactagtctggctagttcttttaaaacagcaagggaagaattacaaatacagaatattcaaaaatatggtactgcttcaaatactgtgcaatcaaattcactagcacagaaaaaaagggttggaaatagaaggggcatcagcaataaattcatttctcctcttagatcaaatagtggaagccatgaagatataaaaccaaaggaaagtgaagaacccgtggatgaacgattgaaaaatattgagccccaaatggtagaacttattaaatcaaaaataatggactgtaatgcaaatttacattgggatgaaattgctggatatcccttgccaaaactgc

SEQ ID NO: 10431 - DNA, 769 bp, Diabrotica virgifera
  misc_feature (3)..(24): n is a, c, g, or t
  misc_feature (436)..(454): n is a, c, g, or t
gcnnnnnnnnnnnnnnnnnnnnnntggcggacgcagctccagccggtggacgtggtggattccgaggaggttttggaggtggtggccgtgcagtgttaatatgtggcaaccgttagacagcgtttgtgctgctgagagtgttgtttgataataatctctggattacttcgcaatatagtctgacgacgattagattactctattattatatgtgtatgtctgtatatgtgttgttgcttattgagctaaattccctatgattgatgtcatcaacaatgatagtgcataagctctatctataaccattaattttcctgctgactaatttgagagtttatgatgacactctatatgaagctgtactttgtaaccaaatccgatatgatgcatatacctctgtggaagttgactccgatcattgcattgacaatactannnnnnnnnnnnnnnnnnnctaattagattattgtgttctacacctgtattatttgctatgcgtgtttgatatttgtctttgctggaccagtttcaaaataataattgtcggttacgccgctgaatgcatattttatgatattagcgaacggcacctgtcgtactggttgccgtctagtgatattattgtaaattttccactcttaatttataattgtccggagctttccatttggtcagaatctcgtatgtctgcacttagtctctgcgatttttatttcttgtagctttcctattcatgcagaatctcctatggatgcaataacagatttta

SEQ ID NO: 10432 - DNA, 310 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(309): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 10433 - DNA, 879 bp, Diabrotica virgifera
  misc_feature (849)..(849): n is a, c, g, or t
tgtttttttttaacgacaaattgtttattaaaattaataagtaaaacagaaacatgaatacatgtattacttgcatttaaattactttatttacacaagtttttatactcccagcaaaggagtggaataattcgtgttggtgtactgtacaacactacattatatatcgtgaatgaattcttaatactcatatcttccaacagggtgacaatgtaacgttaaaaatctaaaaacacgtaaattgcaaaattgttacataaatagtgtactcacagtcatagtaggtaccgagacaaagacaaaaatatcaactagatacgtctataggacgtaaatctggttctaaagctggctgctttgtggtttttcggatattttaaatatctctttgacaacaatcgacaaaggacaacgcacacatcttatgaaaaatgtgtcactcaaatccaataaaatttacatgaatagattcgtctcgaagttataatcatttcatatcattgcaccaactctgagtgctaaaagcaaataggtatgtaggtgagctagagagaaaaaaggtattttgtgaaacggcacttcatacatatttctgcaggttattaaggcagtggcttactcttatcttatagatgataaagtagatataatttggtcagtcgtaccaaagtatatacctagttcgtttaatccatagctcacgctgggttagctattttcaatagcgactaaactactagtatttatgaatgacagttctatggacttttacaatgtatgccgttattaataaaaattctgagttggcgcatgatatgaaataatatcaatttcgggacgaacttgttngaaattttattgcattggacatcacattct

SEQ ID NO: 10434 - DNA, 850 bp, Diabrotica virgifera
  misc_feature (22)..(76): n is a, c, g, or t
  misc_feature (322)..(342): n is a, c, g, or t
  misc_feature (747)..(773): n is a, c, g, or t
gccagtaccaaaaaaacagcgnnnnnnnnnnnnnnnnnnnnnnnnnnnnnnnnnnnnnnnnnnnnnnnnnnnnnnntgctggctgataaagccgatgcgatggaaggtcaatacaaagacgccaacggtcgtgctgaaaaggtcaatgaggaagtactgacatcatggctcactgctctctcaagaaatatgtcttctcatgatctaccattattttttataccgggaaatccataatttcataatcaacatcactctctatcctcgatataattaagaaaatgtatgaattcagggacatcttaccacttcaactattctnnnnnnnnnnnnnnnnnnnnntataacagcctgtatggccctttactttttgaccagatacgatatgataacgcttcactatatagaatttcgcacttatactccgacaggcagaaccctcctgaatctgagttgaactaatagacattccatggtcttcacctattgctatgatactgctctctgaaataaaacattctgaacttatttcagaattaataacctcagcttcgccactgaaaggaacatcaatgatattagactaccgcatgctcacgtactgtttggcgtctgtataatatcattcattgtcactttagttttcatttctggagctttccattggtcagaatctcctatggatgaattaatctctgccatttttattcttgtagctttccattaccccagaatctctatgaatgnnnnnnnnnnnnnnnnnnnnnnnnnnngcaatcaaaactaaagtttttactgttacacatatttagagcgtcaacagcatttatcaaataccaatatatcttca

SEQ ID NO: 10435 - DNA, 1137 bp, Diabrotica virgifera
  misc_feature (445)..(474): n is a, c, g, or t
  misc_feature (747)..(773): n is a, c, g, or t
  misc_feature (922)..(942): n is a, c, g, or t
  misc_feature (996)..(1014): n is a, c, g, or t
  misc_feature (1104)..(1134): n is a, c, g, or t
acaaatgccaatacaactcaaggttgtaatgaagaaagtaataactacacagaatatacagtggtacgacgaattaaaaagaaaaacaatgttgtacacaaagaaacagaagttaaagaaagcttgtctcgacctccgagtatataccaatctttagaaagcctccaatcagaaccaaaatctaggcctagaagcatatacgaatcgttagaagatatccaggcagaatcaactggaagtcttataaaagttgataattttgtaggtattttggaacaaattcagaaagagactggtttttggaacttaaattcaagactaaacaacgaataaggtatcgaaactgttaagtttatatgaactatatctgtgggggaacaatcttataataattataaagatcataggggaattccctcagattatttcatgaataaaactcttnnnnnnnnnnnnnnnnnnnnnnnnnnnnnnatatcttcacctgaatatttgctaaacgtatttcttattattctttgtgacaagttttaaaacattaattgtcagtaacgtcactgaatgttaatttttgtatagtaacgaagggcacctgacgtaatgcttgacgacggtatattatcataaattatcactttattttttatttctggagctttcccattggtcaaaatctcctatggttgatataatccactgcaatttttattcttgtagctttctattagtcagaatctctatgaatgnnnnnnnnnnnnnnnnnnnnnnnnnnncaacaaaaactatagtttttaatgtttcacctatttagagcgttaaaagcatttatcaaataaaaatatacttcccatatatttgtggctttgcttataatttcaattaaactttgtaatggtaacagatttacaatgaattttgtggnnnnnnnnnnnnnnnnnnnnncttgaaagtctgaacaaaaaaaactaaccctggttagaaaatttataaatgtcnnnnnnnnnnnnnnnnnnncgtctctccactgccatgtcttaatttggttgctcttttttttttgttcgtccaaaaaaaaacaaaaagttgtctctcgacaaaaccttnnnnnnnnnnnnnnnnnnnnnnnnnnnnnnnttt

SEQ ID NO: 10436 - DNA, 918 bp, Diabrotica virgifera
  misc_feature (321)..(376): n is a, c, g, or t
atatctctaacaagtaacttctaacatgctaaagtctcatgcctaacttctaacagtacgaaaaacaaggcggctacgcatgcgctcgtcacacaatgaaaaggcctgtaaatatttagaggttatattttttttgttgtacgtttccaatgatgaatctgtcaaactattctcaaaatgagcgaatggactatatcagtaagaacaatcctaaacgatacccactggaattaaatgtcagttatgtatgctttccaatattttgtatcgaataagtaaattaccgtcacagtgtacatgatttgagccaaagacttgtgnnnnnnnnnnnnnnnnnnnnnnnnnnnnnnnnnnnnnnnnnnnnnnnnnnnnnnnncagccttctgcatccaaagttgaacataggcctcccctaatttcttccagttttgtcgatcttgggcttcctgtaaccaattcccagcaatccttttgacgtcgtctgtcgatcgtgtaggtggtcaacctctacttcttctgtctgctcttggtctccacactgtaattttttgggtccatctcctgtcctcattctggctagatgggccgcccaattgcacttcagccatgctactcgctctataacatctgatttcttcgtttctgaccctgtctctgagagtcagtccaagtagtgaccgttccattcttctttgggccactctaagtttggttgctgtagcctgggttaaagataatgtttcggcgccttaagtcatgactggaagcacacattggttcaaaaatcttctttttcaaacactttggcaggttgctcttgaagaaatctgataaagctccatatgctgcccattttaaggtgaccttttcttttgaatttcggaagtttgaattgcccctggaaattttggatttcct

SEQ ID NO: 10437 - DNA, 791 bp, Diabrotica virgifera
  misc_feature (46)..(70): n is a, c, g, or t
  misc_feature (78)..(91): n is a, c, g, or t
  misc_feature (93)..(106): n is a, c, g, or t
  misc_feature (122)..(158): n is a, c, g, or t
  misc_feature (161)..(188): n is a, c, g, or t
  misc_feature (204)..(614): n is a, c, g, or t
  misc_feature (637)..(786): n is a, c, g, or t
cttaacgatagttaattcgtatccgtgagagaatcttttctctttnnnnnnnnnnnnnnnnnnnnnnnnntacctccnnnnnnnnnnnnnncnnnnnnnnnnnnnncacatcacttctcccnnnnnnnnnnnnnnnnnnnnnnnnnnnnnnnnnnnnntcnnnnnnnnnnnnnnnnnnnnnnnnnnnntcgtaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactggattaatttgaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaga

SEQ ID NO: 10438 - DNA, 641 bp, Diabrotica virgifera
  misc_feature (48)..(67): n is a, c, g, or t
  misc_feature (226)..(313): n is a, c, g, or t
  misc_feature (321)..(344): n is a, c, g, or t
  misc_feature (347)..(379): n is a, c, g, or t
  misc_feature (393)..(450): n is a, c, g, or t
  misc_feature (452)..(468): n is a, c, g, or t
  misc_feature (472)..(501): n is a, c, g, or t
  misc_feature (505)..(534): n is a, c, g, or t
  misc_feature (549)..(562): n is a, c, g, or t
  misc_feature (564)..(608): n is a, c, g, or t
gtgtttaaattatttattcttatgacagcctcttgttcataatacagnnnnnnnnnnnnnnnnnnnncccgtgtgtcgatgttcttttttctcagtaggtttattaacggattatgtagtaccgaattgtatgccttgttatactctatgtaacatattttattgtaatgttgatcttctaaagaatttttctgtaatgaattgtgatgcgtgattgctatgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgagcnnnnnnnnnnnnnnnnnnnnnnnnctnnnnnnnnnnnnnnnnnnnnnnnnnnnnnnnnncgtattttagtacnnnnnnnnnnnnnnnnnnnnnnnnnnnnnnnnnnnnnnnnnnnnnnnnnnnnnnnnnncnnnnnnnnnnnnnnnnncagnnnnnnnnnnnnnnnnnnnnnnnnnnnnnncagnnnnnnnnnnnnnnnnnnnnnnnnnnnnnncatagaggaattcgnnnnnnnnnnnnnngnnnnnnnnnnnnnnnnnnnnnnnnnnnnnnnnnnnnnnnnnnnnnttctgtgccctgattaaattgaatggccgcctg

SEQ ID NO: 10439 - DNA, 121 bp, Diabrotica virgifera
  misc_feature (3)..(105): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtggattaaaaaa

SEQ ID NO: 10440 - DNA, 690 bp, Diabrotica virgifera
  misc_feature (8)..(688): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 10441 - DNA, 962 bp, Diabrotica virgifera
  misc_feature (706)..(706): n is a, c, g, or t
  misc_feature (875)..(876): n is a, c, g, or t
acaaaatacgtgatataaatgaatatttgccgtagatttagtcagtatgttaacaaaaacttagagaaaatgaagattgttcagtttaaacttaacgataacaaagttagaataggtgtactaagtggtgataatgtaatagacgttaatgccagtgatccaactattccgaattctttagttgaattcttacaagatgaaaaagctttggataaaattaaaagtattgcttcaaatccgaagaaagagcatacattgacgaatattaaacttttatctccaattaccaagcctgataaaatattgggagtcgcgtctaattacaaggatgactgcaacatgagaaatattccatatcccaaggaaccgatggtttttagtaaatttgcttctgtgataatcggacctaatgatcccattcccaaatcggatgcaacaaacgcgcttgactgggaagtagaacttgtcgcaattataggaaaaaaagcccaatatgttaaagcaaaggatgctatggattacatctttggctacacaatcactcaagatctgactgccaaagactgggtaatgagaaacaacggccaactggttatgtgcaaaaattttgatggattctgtccgctaggtccttgtattgtaacaaaagaagagctgggggatccctataacgtaaaactaaaaacttgggttaacagagaactanaacaaagtggtcattcagaaaatatgctacaaagaattgacactcttgtggaatatttaacaagtgtaatgacgttgcttcctggtgatctaatacttactggaacacccttcggcgttggtgccagcccaattccgccgcaatatttacagaaagggagattggtggnnaagtgaatagacaaaattgggaaaatgtctcaccggatagtgtagcattttttttttaacatatattactgtaatatagagattat

SEQ ID NO: 10442 - DNA, 787 bp, Diabrotica virgifera
acatgattacgatactattaaggggccttttatttatgatgctaagccaccaaaagatatttggtttgtacctcttaatcaagaaaaattctctgctgaagaattaatgacattgtattcgacccatgctcaattaaaacagtacctaccaataataaaggatagtccagtataccctgtaattacagacagtaacggtgttgttttgtctctaccaccaattattaacggaaatcattcaaaaattacattggacacaaaaaacgtttttattgagtgtacagccactgatttgacaaaggcaaaagtggttcttgataccatagtgtgtatgtttagccagtattgttctgattcacacaatattgagtattgtgaagttattaaccctgacggtacatcagcattgtatccagatctagaatacaggagtgaaaatgtttcggtcaaaaaatccaataaaaaaatcggaataaatgaatctccggagaatattgttcagttattttctaagatgtgtctcacaactgagttaacaaataactcagatattgtaaaagttaccatcccacctacaagacatgatgtactacacgcatgtgatatctatgaagacattgctattgcttatggttacaataatattaaaagaacctttcctaaaacaaataccgttggccagcaattttcaataaataaattaacagatttattaagatatcctatagctgaagctggatttactgaagctttagcttttaccttgtgttcaagagaggacatatct

SEQ ID NO: 10443 - DNA, 713 bp, Diabrotica virgifera
  misc_feature (202)..(220): n is a, c, g, or t
  misc_feature (376)..(395): n is a, c, g, or t
  misc_feature (507)..(529): n is a, c, g, or t
ccctgcgggccaccggcccggaatccccggggcccccctcgcccccgctatcattttttatattagtttattcgtttgtcatagttctctacaaatttgatttattgataccctaacaatcaatgtgacgagaatattcccattaatataagagatgaatccatatgttccaccttgggcttcggggcttgttaaataaggnnnnnnnnnnnnnnnnnnnctatgtcccaagaacgaaaaaatcaaaatacttattgacagatccatggtcagaatgattgttttgtaacgaaatgtcatgcagtttcgtatatatctgattctggagaagctaatacacttctgttagttcacgatatgtgtatccctacatccnnnnnnnnnnnnnnnnnnnngacttttgcagggatgcagctgagcgtaatatgattttcttattgattattcatattaggattactgattacagattgatcatatttcaaaatctgctagtagttattttcnnnnnnnnnnnnnnnnnnnnnnnataaatctctaaatacatgtcaacatatcctatctaaacttactagtgacgctaatattaatatcaaaaacatgtatataaagtaaaaatagctaactttcctcaagtcaatcctaaacattttggccacctgtaattctatacatgactttttgcatgaaattgtgtgtcccacctgcccaca

SEQ ID NO: 10444 - DNA, 498 bp, Diabrotica virgifera
cttaaacctaatcctctgcttgcttttctttcaatattatcttttaattgggttatagtaattggtcttttgtctttaatgtcttcttttttaataggtaggtaagtgttcttttcaagactttctcttgatttgaaatttttactaagatttacttctccaaccttcgtactttttcaggatctacttagttttgtatcctttggtgtccagtcattattccccaaaattctgactgaatttttgtattattcacttccgattagttatactgggagattcaggagtttcatgaagaatatacatgacatggaattacatgatccggctactgatatcatgaatgtagagagaagctattatcataatatggtagaagtatatcgtatcaatggacctcttacataactaacggttagaacctcgtattctagagaatactttcggaatagtcgcctttggattgattgaatatgtaagacgcttctattatattcc

SEQ ID NO: 10445 - DNA, 731 bp, Diabrotica virgifera
  misc_feature (88)..(115): n is a, c, g, or t
  misc_feature (167)..(206): n is a, c, g, or t
  misc_feature (253)..(274): n is a, c, g, or t
  misc_feature (291)..(421): n is a, c, g, or t
  misc_feature (423)..(436): n is a, c, g, or t
  misc_feature (438)..(498): n is a, c, g, or t
  misc_feature (564)..(641): n is a, c, g, or t
  misc_feature (647)..(664): n is a, c, g, or t
tttctgttgatacttcaagcgtatgctccctttgcggacaagaatggactcactccatttaacgatagtgacctagcattgtgagagnnnnnnnnnnnnnnnnnnnnnnnnnnnncattctttgcaccttgtgaatcagggattattatttactacttatatattcnnnnnnnnnnnnnnnnnnnnnnnnnnnnnnnnnnnnnnnncattgcaaaataaatattttacataatttcttttgtaatgtactgtnnnnnnnnnnnnnnnnnnnnnngttttttatgaaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnnnnnnnnnnnnnnnnnnnnnnnnnnnnnnnnacatagatttaaattattaaactttagcaatgacgataatattagcattaacaaattgtatattcnnnnnnnnnnnnnnnnnnnnnnnnnnnnnnnnnnnnnnnnnnnnnnnnnnnnnnnnnnnnnnnnnnnnnnnnnnnnnncaaacnnnnnnnnnnnnnnnnnncctgattaatatgaatggccgcgccattttcgaccgcgctaaggcagctaatccttccgtgttttta

SEQ ID NO: 10446 - DNA, 830 bp, Diabrotica virgifera
  misc_feature (285)..(302): n is a, c, g, or t
ccttttgcgtccggtgagaggtttagacgacgaatttgagattgctgaaagccaaaatatagcgagttttgactgggtagatcctccgttaacgaataaaaagattcaagaataccacgcccacgaaagtgccctgattagtcatggaataccgatatctccaggtgatatcatcaccaccaactccgatgttattgtagggaagccaggtagagttggtccaagaattccgtctattccagtgcaacaagtaagtcaagaaaacgagattcctattggtatgannnnnnnnnnnnnnnnnnaacattggaagaagaataaccatgaatataaaagaattcctgtaacgaataacttcgagaagccttctgagtatcgacatgaagattatttaggtcctcctccaccgatagcgccctttgagtacaatgcgcagaacgataaggtgaacgaaatatcaggaaatcctgtttatgccaaaaatcagaaaaactacgaaccagtacacccacaacaacattacaacgaccaacagtacaagtttaaggaccaacaactgcctgcattcacacataaccatcctgtgtatgcacaaacttttaatcatgaaccaccaactagggaaaaaccatttaaccctaacacaaaaccggtgtatagtttgcaagaaccagtacccccaaaacaacatagtaataatcgtccattgtatgttcctgccgattaccacgatattccaataaaccaaggagaaatactaacaggagcaattcctcatgtccaaatcaaacagtatgatcccccagatcatctgcatgtaaacataaaca

SEQ ID NO: 10447 - DNA, 438 bp, Diabrotica virgifera
  misc_feature (235)..(260): n is a, c, g, or t
  misc_feature (272)..(291): n is a, c, g, or t
  misc_feature (307)..(335): n is a, c, g, or t
  misc_feature (347)..(368): n is a, c, g, or t
  misc_feature (370)..(383): n is a, c, g, or t
  misc_feature (385)..(411): n is a, c, g, or t
gcaacatggacagcaaatgatcaactaatatacagtgataatggcaacttagtcctcctggatttaaggactaacacttcttcaatgctgcttaactctactgatagtattcttcttactgcctttgacttcagactctctgcagacggtctctatttattggaggatctaaactaccaaaagcaatttccacagagctatatcgtcaataatgttattgttgaacaaatattcnnnnnnnnnnnnnnnnnnnnnnnnnnatattcgtttgnnnnnnnnnnnnnnnnnnnnccaaataaattcaacnnnnnnnnnnnnnnnnnnnnnnnnnnnnntatttcttatannnnnnnnnnnnnnnnnnnnnncnnnnnnnnnnnnnncnnnnnnnnnnnnnnnnnnnnnnnnnnncataggaaattaggaataaaaattttt

SEQ ID NO: 10448 - DNA, 559 bp, Diabrotica virgifera
  misc_feature (11)..(11): n is a, c, g, or t
  misc_feature (13)..(14): n is a, c, g, or t
  misc_feature (21)..(21): n is a, c, g, or t
  misc_feature (23)..(23): n is a, c, g, or t
  misc_feature (25)..(25): n is a, c, g, or t
  misc_feature (27)..(27): n is a, c, g, or t
  misc_feature (299)..(320): n is a, c, g, or t
tcgagggcccngnnttgtttngngngngaaaggaaacgcatttactttattttgagagcaactggtttacatttgattctagaaccttgatatatacactgaaataatgtttcatcttggtctataattaacatagaaacatttaccacagcttagaatgtctcactatgatgggatctacaacttagattacgtagattgttagaatgtatctcttaattatggacatatcaatcatatatcggcatactcgctaataattacgaacttagccgtgacttctatcagacttaagtgannnnnnnnnnnnnnnnnnnnnnatgtatgcatatcatataaattatttttgctactttgttatatgatataatatttcagagcagatttagtatgtttatcgcacctaagaaaagagagtgttaacgtacaaagagacatattcctattttgccattgtctgcgtcttgaaatgtgttataacttacgttattacactcggaaaaaacttgacaaaacaccatcataggagagtatttccagatacacaatcatcaagata

SEQ ID NO: 10449 - DNA, 788 bp, Diabrotica virgifera
caacatctgttttgtttgtgttaaaaagtacgataatgtacttttggataatattagggtgttgtttaatacaaatagactgtactatcccaccaaaaaaattaaatgctttagttattttagctgacgatggaggttttgaaatgggagtatatcgcaacaaaatatgccaaaccccaaatctggataagttggcaagacagagtttgatatttaataaagcatttacatcagtgagtagttgctctccaagccgagctgcacttttgacaggaacaccatctcatcaaaatggcatgtatggcctgcatcaaggagtacataattttaattccttgtccaatgtaaatagcatatccaatatattaaagcaaaacggaattaggacaggtattatcggtaagaaacacgtaggtccagaagaagtgtatccatttgatttttctgaaacggaagaaaacaattctatattactagtaggacgaaatattacccatattaaattgttggcaagacaattcttaaatacttcagacccattctttttatatattgtatttcacgatccacatctatgtgcacacactaatcctgaatatggagagaagccggcccaaaattattagtggagaacccgaaatggacgagatacccagctgacacctattatctattagccaaagcaaatacgatgggccgtaacttatccccctcactcctgaaacaacaataaactgaaaacacaagtaaaaaactaatttaaaacttcctcacaatgcaggacaaaa

SEQ ID NO: 10450 - DNA, 937 bp, Diabrotica virgifera
tatttgtcttgacatgtacctatgtcttaaattacattttgtttgtaattcttggtctatgccggattatcgacagattagaacagtaataggttttgatgaaagtacagaaaagttatcaaatttttaggtaaaacagttgatgatgaccttaattttgctattgttttgtcgccaacagagatattccttccttcagataaacaaacgctcagcaaactgtattcttcaccgatccaccataccatacagcattaacgtaccgatggaacatgaggaattttatagctgtcatgcaaatcttctaaaaatttcataattaatgttgttattgctgtttgagcaatgattgatgaggtcattcttctgtaatgataacttgcaacttcaacttcgaaagcgcatgattaaatgttacattttggtcagtcctcttgtatgatgtcgaagcatggacattaaaaatatccaccattaatcgtttggaggcctttgaaatgtggctgcacagacgtatactgaaaataccatggacggctatgctgacaaatgtggcagtccttaagagagcaaatgctgcccgcgagctgcttgataacatcaaatttagaaagatggcctattttggacacgtagtaaagggagaccggtataatattcttcaacttattatgatgggtaaaatcgaaggacgcagaggaattggtagaaagcaggcctcttggttgaagaatatccgggagtggacaggaatgaagaaagcagaacaactatttagaatagctcgagacagacagtttcaccatgttaatcgccaaacgtcaggggacttgatagggcacgttaagaagaagattgctgttttgttaatactaccctatgatatataggtacgtgaggtgtgaacggtacgagaggtacggtagagtgaaatata

SEQ ID NO: 10451 - DNA, 103 bp, Diabrotica virgifera
  misc_feature (35)..(81): n is a, c, g, or t
  misc_feature (86)..(102): n is a, c, g, or t
cagaaaacccattaagtttataaaactattaaccnnnnnnnnnnnnnnnnnnnnnnnnnnnnnnnnnnnnnnnnnnnnnnnggcgnnnnnnnnnnnnnnnnnc

SEQ ID NO: 10452 - DNA, 212 bp, Diabrotica virgifera
  misc_feature (2)..(26): n is a, c, g, or t
  misc_feature (28)..(121): n is a, c, g, or t
  misc_feature (162)..(197): n is a, c, g, or t
gnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtacgaattaggattataagttttcatattttaagatatgnnnnnnnnnnnnnnnnnnnnnnnnnnnnnnnnnnnnctgcaaatttataca

SEQ ID NO: 10453 - DNA, 222 bp, Diabrotica virgifera; identical to SEQ ID NO: 7599
  misc_feature (6)..(28): n is a, c, g, or t

SEQ ID NO: 10454 - DNA, 793 bp, Diabrotica virgifera
  misc_feature (259)..(280): n is a, c, g, or t
atcaaatctaacattgaaactagaatgtcctttgaagatgatggaattccatattcagaccttgcttctggaggtccaccacttgaagaagatgattctgatggctgggatgaaatggaagtcaatggggagcaaacaacctgtctttttgcccgctgcaatttctcacaatcgctgtagctctagtccattgtataacagaacacaaatttgatttgcttgctttatagaataaatacaatatggattggtactcttnnnnnnnnnnnnnnnnnnnnnnaaggctgcataagccagatcccaaaatactaactgagtctacaattgcattgtgggatgatgatgtgtatttgaagcctggagagctgcaaccttggctgatgtatgactttgatgatttgggcagtgctccttcaacaccacactatgcgatagatggtaaaactccactcagtaatataaacttctcagatcttcgaagacagatccaagaccttaccatgcaggtgaagcataatgatctaatgttggagaactaccatagagatatggaaaaaatgaaagaagataccagaactatagttgaagctggagattctgctatcagaaagataccccacaatatagtttcttctggttgccaaagtggagattattttaattcatactcacattttggtattcaccatgatatgctcaatgataaagttagaactgagagttatagagatgcaatactaaaaaattcgaatctgttgtcaggaaagcatgtattggatgttggatgtgggac

SEQ ID NO: 10455 - DNA, 629 bp, Diabrotica virgifera
gaattccagttggaggagccagaagaagagagcgatggagaggatactgaagagaagagggaaaagaggctagtgaaggaggtgaagatgatcgctacgaagaatgctatatcgggtgttactatgtttatgttgtataataactcactgatttaccttgatgtacgtatcccgctgtgttaatattgaagaatctattaattgtttatccactatctttgattcacagaattaatttgtttattgaaaaagaagatcttttacatctttttttcgtactgcgatgttcttgctaggctactgtatctatgtttgcgatatttacataaggtttagttatcaatattgacatatagaatattatacgttctcataagtaaaaccaaacagttgtaggtgaagctcttattaacatagagatatagttcttattgaatactttaacaccaggtcaggaggatatgttttcatatggtcgatgccgcgtagtattaatacttatatataataattgttgtttttgacttagtacatgatcaccagccagagtgaaaattatcatctgttagcaatgacgtgctcatttccaatacccaggttgttgtttatttgccgttggctctttccct

SEQ ID NO: 10456 - DNA, 759 bp, Diabrotica virgifera
  misc_feature (2)..(80): n is a, c, g, or t
  misc_feature (82)..(750): n is a, c, g, or t
annnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttggatga

SEQ ID NO: 10457 - DNA, 293 bp, Diabrotica virgifera
  misc_feature (2)..(169): n is a, c, g, or t
  misc_feature (184)..(201): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccattttttttgnnnnnnnnnnnnnnnnnnttaaggataacaggggaatttttttggaaagtccaaaccgataaaaaaaattgggaccccccaaggtggattaaagtttaaattgggggaac

SEQ ID NO: 10458 - DNA, 731 bp, Diabrotica virgifera
  misc_feature (23)..(47): n is a, c, g, or t
agccccgccattgtttattgttnnnnnnnnnnnnnnnnnnnnnnnnngaaattggtttattagctatggaagataaaagtgaaatcaagaaagagtttactgaatatgaccaaacatgtatagaaggtcatctatcgccatcagtaggtctcaaaaactttaaaaatgaaccaaaggaagatcatccagctatggaagttaaagttgaaaatgaagaggttgcagaatttgaccaaaaagatatagataatctgtccacatcaatagatcttaaagacttaaaagatgaacctgaggaaaatcaacaaggttgtttacaaaacaagaacaaaatgaaaattcctgaaaactcatctccgaagatttgggtagatacgccgaagaagaaaaaactaaatatgaaagttcaaactggaaaaggaccttacacgtgtgcaatttgtttaaaacaattttctcagcgatttaatctgaaaccacacatgatgattcacactggagaaaaaccgcacaagtgtcaaatttgttttaagcagttttctctgaaatgtaatttgaaaggacacttgaaagtgcacactggagaaaagccttacaaatgtgatatttgtttaaaacaatttactcaaaaaaagctatttgaaatcacatttaagaatacacactggagaaaaacctcaccactggtaaatttgtttggaacaatttactgatgcaagtacagtgggaac

SEQ ID NO: 10459 - DNA, 212 bp, Diabrotica virgifera
  misc_feature (151)..(208): n is a, c, g, or t
ccttagggataacagccgaattttttttgggaaggtccatccgtaaaaaagattggggactccatggtggggtttaagattttaattggtggtaggagcttattttttaattttgttcgctttttaaatttacttgttttggggtgtaacnnnnnnnnnnnnnnnnnnnnnnnnnnnnnnnnnnnnnnnnnnnnnnnnnnnnnnnnnnccgc

SEQ ID NO: 10460 - DNA, 466 bp, Diabrotica virgifera
  misc_feature (82)..(101): n is a, c, g, or t
  misc_feature (167)..(188): n is a, c, g, or t
gacgaaggtaaacgaatcaaaagaacagacaagtacaagtatttaggtttcataatattaaacaaagaaacaactgaatagnnnnnnnnnnnnnnnnnnnnatatacaccatgacaagaagtatccaagaagtatccagtataacatatgggtgtgaaaacagtatnnnnnnnnnnnnnnnnnnnnnngaacaacagagatggaattcctaagaaggagaagattcagagtaacaaaaatagatagaataaataacaaagagattaagaaaagaatgggaatgaactcagataatatctatatctataatagactacataaaacagaaggaattaacctggtacaaacagtcataagagcagacaaaaaagatggataaacagaataacagagtggagccccataggaaaaagaaagagaggcagaccacgaagatctttcagagatgaagtggacgaagtaatgg

SEQ ID NO: 10461 - DNA, 641 bp, Diabrotica virgifera
gtaattaaagagaaaacaaaaaatttagtacaatatctgggcaagaaaataggccaggtacttcgaatgaaataaattgaatgaggccaaaacacctatagaacagctcaaccaattcaaatacctcggcgtagatttatccaattaccatgacccagttagaggcccaagactgcagataaataaggccatagttagatctggatgtttaagagatattgtctggaataacccatacatgcgaacggacagcaaagtaatgacttatgggctagaatcaccaataagatcaaaagtaaaagatggttttgcttgttttcgattcagagggatgcacaatcgccggacagctgtttccaccatttcaggctttatgaaaacagcgctaccgtgcactcctctgaatcgaaaaacagctcgaccatcaatttaagcggaatttcaaatatcattgaaattcccatcgggacgcggtccagcgacatctcttaacaaattgaaaagtctcagatgcagaaagtaaatagatatttaaatctgaaacttttcatgttgaaagttcttttctggtcgtcctttatcaattaaatgatcaaaattatgctatgaacaaacacaatggagatctcagatgcatacca

SEQ ID NO: 10462 - DNA, 218 bp, Diabrotica virgifera; identical to SEQ ID NO: 7300
  misc_feature (6)..(28): n is a, c, g, or t

SEQ ID NO: 10463 - DNA, 837 bp, Diabrotica virgifera
  misc_feature (26)..(47): n is a, c, g, or t
  misc_feature (266)..(600): n is a, c, g, or t
  misc_feature (606)..(623): n is a, c, g, or t
  misc_feature (625)..(661): n is a, c, g, or t
  misc_feature (663)..(685): n is a, c, g, or t
  misc_feature (746)..(784): n is a, c, g, or t
  misc_feature (792)..(812): n is a, c, g, or t
cacgccgtcgttcagcaagagcttgnnnnnnnnnnnnnnnnnnnnnngagagtattctctaatatttaaggacagtatggaagacgattggtgctgtggataatcagagtggtggagttgtcgcccctaaaattgtatgatctacctgtaaattattgttgttcgttagatgtaactgttatgattgtccaagatttatatttgttccttcttttgtactgtgatgttattcgattttaaagatatctatttttttcatacatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcnnnnnnnnnnnnnnnnnntnnnnnnnnnnnnnnnnnnnnnnnnnnnnnnnnnnnnncnnnnnnnnnnnnnnnnnnnnnnnatatccttttgttttttttatgaaactaggaaggataggggtggagtaaaaaaaaccttcnnnnnnnnnnnnnnnnnnnnnnnnnnnnnnnnnnnnnnngtaaagtnnnnnnnnnnnnnnnnnnnnnaagaagacccctaataaattttttt

SEQ ID NO: 10464 - DNA, 574 bp, Diabrotica virgifera
  misc_feature (9)..(39): n is a, c, g, or t
  misc_feature (51)..(69): n is a, c, g, or t
  misc_feature (71)..(112): n is a, c, g, or t
  misc_feature (314)..(345): n is a, c, g, or t
tctcgcccnnnnnnnnnnnnnnnnnnnnnnnnnnnnnnncctagtaaaagnnnnnnnnnnnnnnnnnnngnnnnnnnnnnnnnnnnnnnnnnnnnnnnnnnnnnnnnnnnnnccagaaaaatctatttttagtacctaagagtatcagggctaataatttcaaagttatagaatctatactctcaactcttggatagctaacaaatatacatttttattgtgtagtaacgatatgacatccttttttggacatatctgtgttatccggatataaatttatctagatttattgacgatatataaaaaatttctcnnnnnnnnnnnnnnnnnnnnnnnnnnnnnnnngtatcaactgagataaactatttttatagaagataatttctcaataagaattaggaataaatatttgcccattccagaatagggtactagtgatcttgatatatgcattctctgctatccatcaccagttatgtatgacagtatcagcttgcggcatcccaatttaggaatagggacgccatcattaggtgaaatgtagctacttatcacaaacatatgagttcaataa

SEQ ID NO: 10465 - DNA, 261 bp, Diabrotica virgifera
agaaagacagaatttaataagtttgtttttttgataatttcataatattgcggatagacttttctgattttgaccaaacacgcatactacgtccacccatgccgactctagcactcctaaactttaaaaatgatcctacggtacatcatccagctatctacgatatatttcacaatgtccgtgctgctccaattgttcattaagcacttagttactgtgaccccctccctccgtccctgtatatcctataattttaccccc

SEQ ID NO: 10466 - DNA, 501 bp, Diabrotica virgifera
ccattagttaaatacgtacatgaatctgcggtatggccaaaagaaggtttcgcataacaataggccgtgacacgaaatctacactgccagacactagaccatcgactaccacgaggcgtgaacctcccgaggccgataccagattttggatgccattacgatgattgttagctgaaaacgccctgtaaactcgcatggacggaagaggaagtcggccgctgctctctctcattttgtgatgcggacctaggacatgccgaacgagaagctcaatgcagcagagctattaaggacattatgataaaatataataatgagtggtgtgactgaaccatgttaaatgttactcaccctattcttatatcgaagattatctatcaagcgagagcatcttatacggagtagaacaaagacctagatgacttcacaatttcgttatggaatgatgataacgatttttacgactttagaattaatatataatacatgttctgaatattt

SEQ ID NO: 10467 - DNA, 593 bp, Diabrotica virgifera
  misc_feature (75)..(95): n is a, c, g, or t
  misc_feature (97)..(109): n is a, c, g, or t
  misc_feature (125)..(192): n is a, c, g, or t
  misc_feature (194)..(206): n is a, c, g, or t
cggtccccctttcacgttcgagtcagaaagagacgacatcgagggaggattagcctttattttaaatcgtaagcnnnnnnnnnnnnnnnnnnnnngnnnnnnnnnnnnngtaattgctttatatnnnnnnnnnnnnnnnnnnnnnnnnnnnnnnnnnnnnnnnnnnnnnnnnnnnnnnnnnnnnnnnnnnnnannnnnnnnnnnnngttcgttaggtttaccatttcaattataatatctctcgtaaaagtagtatgtagggaagtggtactcggagactgatgaatcccattttggaacgcttatattggatatggcggttctgctgataaattcaacccatgttaattaatgacattatgataaaacattttaacgagttgtgtgacagaaccatgctagatgttactcaccctaatcttatatcgaagattatctatcagtaaaagtatcagatatggaaaagtacaaagacatagatgtcttcactatttagttctggaatgatgaaaacgttttttacgaactttgaattaatatataacgagatttactgaatatttataacaaatttctggtccagtgagatgcta

SEQ ID NO: 10468 - DNA, 1170 bp, Diabrotica virgifera
  misc_feature (8)..(51): n is a, c, g, or t
  misc_feature (53)..(95): n is a, c, g, or t
  misc_feature (103)..(709): n is a, c, g, or t
  misc_feature (719)..(719): n is a, c, g, or t
  misc_feature (731)..(759): n is a, c, g, or t
  misc_feature (761)..(800): n is a, c, g, or t
  misc_feature (805)..(865): n is a, c, g, or t
  misc_feature (867)..(867): n is a, c, g, or t
  misc_feature (884)..(884): n is a, c, g, or t
  misc_feature (890)..(930): n is a, c, g, or t
  misc_feature (1064)..(1083): n is a, c, g, or t
  misc_feature (1118)..(1158): n is a, c, g, or t
ctttttcnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggaanggggtggatgannnnnnnnnnnnnnnnnnnnnnnnnnnnnannnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnntnattaattggggggatanaaaatnnnnnnnnnnnnnnnnnnnnnnnnnnnnnnnnnnnnnnnnnccacttttttgattttagaataaattacttaggataacgcgtatttttttgggaaagtcaatccaaataaatgtggccccccaggtgggtttagattttaattgggggggcgctttttttttatttgtgtccannnnnnnnnnnnnnnnnnnntggggtttaaacccgggggggggccccggtggggnnnnnnnnnnnnnnnnnnnnnnnnnnnnnnnnnnnnnnnnngaggggagcccc

SEQ ID NO: 10469 - DNA, 770 bp, Diabrotica virgifera
  misc_feature (26)..(50): n is a, c, g, or t
  misc_feature (59)..(96): n is a, c, g, or t
  misc_feature (110)..(132): n is a, c, g, or t
  misc_feature (168)..(210): n is a, c, g, or t
  misc_feature (234)..(255): n is a, c, g, or t
  misc_feature (262)..(279): n is a, c, g, or t
  misc_feature (282)..(333): n is a, c, g, or t
  misc_feature (337)..(437): n is a, c, g, or t
  misc_feature (439)..(460): n is a, c, g, or t
  misc_feature (465)..(539): n is a, c, g, or t
  misc_feature (562)..(588): n is a, c, g, or t
  misc_feature (617)..(639): n is a, c, g, or t
  misc_feature (641)..(656): n is a, c, g, or t
  misc_feature (660)..(688): n is a, c, g, or t
ctcccccccccccgataaagagggannnnnnnnnnnnnnnnnnnnnnnnngtactcccnnnnnnnnnnnnnnnnnnnnnnnnnnnnnnnnnnnnnngtgtgagatagtgnnnnnnnnnnnnnnnnnnnnnnnctatttgttgattgtttgtaacttgtgattaatggnnnnnnnnnnnnnnnnnnnnnnnnnnnnnnnnnnnnnnnnnnngatctatatattgtaatttttaannnnnnnnnnnnnnnnnnnnnngttttgnnnnnnnnnnnnnnnnnnatnnnnnnnnnnnnnnnnnnnnnnnnnnnnnnnnnnnnnnnnnnnnnnnnnnnntacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncaacnnnnnnnnnnnnnnnnnnnnnnnnnnnnnnnnnnnnnnnnnnnnnnnnnnnnnnnnnnnnnnnnnnnnnnnnnnnctaaatttagcaatgatgatacnnnnnnnnnnnnnnnnnnnnnnnnnnnctaaaaatatccaggtttaataaacgacnnnnnnnnnnnnnnnnnnnnnnngnnnnnnnnnnnnnnnnctcnnnnnnnnnnnnnnnnnnnnnnnnnnnnncctgattactttgaatggccgcgcaatcttgaccgcgctacggcagctcaaccatctaccttttcatcgaaagccgcaatga

SEQ ID NO: 10470 - DNA, 717 bp, Diabrotica virgifera
  misc_feature (204)..(216): n is a, c, g, or t
  misc_feature (219)..(232): n is a, c, g, or t
  misc_feature (517)..(536): n is a, c, g, or t
cctttaatgtccgctatcgctagtcctataatcaggaaatagaccccttttataatgatattgttacagatcatgcatttattataacttgctacatagtgatacctattataattggtggttctgtaaattgacttgtacccttaaaactagtcgctcccaatagatgattccctcccataaacaatataagattttgattgnnnnnnnnnnnnntgnnnnnnnnnnnnnncagaaaaatagtatgaagggaagtgtgaatcggacagtgataaaccccattcttggaacacttatattggatatggcggttcagcagcacaatgcacccatgttattttatataattatgataaaacattttaacgagtggtgtgacagaaccatgtcaaatgttactcaccctactcatataacgtaagattatctactcatcgtaactatcagatatcggagtatatattgacatatatcactttcctatttatttatggattgttgatcacgatatttacgnnnnnnnnnnnnnnnnnnnngagatcgactgaatattatgaacaatttctagatccaaagaacgatatatacatatagtaacatttttcctctaaattgcttgcaccctggtttttacaacctgcctctttagattaaataagaagtctcgcctggcccccgaatacttttccatggccgcggtatttttgaacgtgccaa

SEQ ID NO: 10471 - DNA, 943 bp, Diabrotica virgifera
  misc_feature (3)..(18): n is a, c, g, or t
  misc_feature (20)..(62): n is a, c, g, or t
  misc_feature (70)..(784): n is a, c, g, or t
  misc_feature (786)..(854): n is a, c, g, or t
  misc_feature (864)..(885): n is a, c, g, or t
  misc_feature (888)..(921): n is a, c, g, or t
cgnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnattgggggcnnnnnnnnnnnnnnnnnnnnnnccnnnnnnnnnnnnnnnnnnnnnnnnnnnnnnnnnncttttttgaatcccattttctt

SEQ ID NO: 10472 - DNA, 145 bp, Diabrotica virgifera
  misc_feature (10)..(76): n is a, c, g, or t
  misc_feature (89)..(116): n is a, c, g, or t
  misc_feature (118)..(132): n is a, c, g, or t
accctatagnnnnnnnnnnnnnnnnnnnnnnnnnnnnnnnnnnnnnnnnnnnnnnnnnnnnnnnnnnnnnnnnnnnggattaaaaaagnnnnnnnnnnnnnnnnnnnnnnnnnnnncnnnnnnnnnnnnnnncccccattttctt

SEQ ID NO: 10473 - DNA, 739 bp, Diabrotica virgifera
  misc_feature (18)..(18): n is a, c, g, or t
  misc_feature (159)..(171): n is a, c, g, or t
  misc_feature (174)..(188): n is a, c, g, or t
  misc_feature (203)..(229): n is a, c, g, or t
  misc_feature (232)..(245): n is a, c, g, or t
  misc_feature (281)..(305): n is a, c, g, or t
  misc_feature (314)..(327): n is a, c, g, or t
  misc_feature (330)..(382): n is a, c, g, or t
  misc_feature (409)..(469): n is a, c, g, or t
  misc_feature (474)..(532): n is a, c, g, or t
  misc_feature (534)..(553): n is a, c, g, or t
  misc_feature (556)..(592): n is a, c, g, or t
  misc_feature (605)..(632): n is a, c, g, or t
  misc_feature (653)..(705): n is a, c, g, or t
cctcccaggtccggggangtttgtgaataatttaggttttaccttttaaaagacacatttgatttaacgataggtaattagtatcgtgagacaatattttatttttctcatagaagaccctattttttgtacctcgcgtatcagggattattcattacnnnnnnnnnnnnnccnnnnnnnnnnnnnnncagagctagaaaacnnnnnnnnnnnnnnnnnnnnnnnnnnntcnnnnnnnnnnnnnncaatgaaatggtactcgttcttacctatctccaacnnnnnnnnnnnnnnnnnnnnnnnnnctatcaacnnnnnnnnnnnnnntcnnnnnnnnnnnnnnnnnnnnnnnnnnnnnnnnnnnnnnnnnnnnnnnnnnnnncaattttattcaaactcactctttacnnnnnnnnnnnnnnnnnnnnnnnnnnnnnnnnnnnnnnnnnnnnnnnnnnnnnnnnnnnnncactnnnnnnnnnnnnnnnnnnnnnnnnnnnnnnnnnnnnnnnnnnnnnnnnnnnnnnnnnnncnnnnnnnnnnnnnnnnnnnnccnnnnnnnnnnnnnnnnnnnnnnnnnnnnnnnnnnnnncggaattcggctnnnnnnnnnnnnnnnnnnnnnnnnnnnnctgtctttctgtattacatannnnnnnnnnnnnnnnnnnnnnnnnnnnnnnnnnnnnnnnnnnnnnnnnnnnncgctcaggtaacctaatcctctcgtttttttatt

SEQ ID NO: 10474 - DNA, 432 bp, Diabrotica virgifera
  misc_feature (5)..(47): n is a, c, g, or t
  misc_feature (53)..(75): n is a, c, g, or t
  misc_feature (266)..(339): n is a, c, g, or t
  misc_feature (344)..(409): n is a, c, g, or t
tttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgtctttt

SEQ ID NO: 10475 - DNA, 743 bp, Diabrotica virgifera
  misc_feature (5)..(132): n is a, c, g, or t
  misc_feature (134)..(147): n is a, c, g, or t
  misc_feature (154)..(171): n is a, c, g, or t
  misc_feature (179)..(480): n is a, c, g, or t
  misc_feature (482)..(535): n is a, c, g, or t
  misc_feature (537)..(556): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnacggcgnnnnnnnnnnnnnnnnnngattaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnngnnnnnnnnnnnnnnnnnnnngttaccttagggagaacagcgtgaattttattggagagttggaatcgataatatagattgcgacctcgatgttggattaaagtttataagtggtgtagcagcgatattaattaagtctgatgggctttttagaaatttagatggatctgaagttaaacggaggggtgaaaggtttgggaatgtggaa

SEQ ID NO: 10476 - DNA, 65 bp, Diabrotica virgifera
  misc_feature (7)..(64): n is a, c, g, or t
ggggtgnnnnnnnnnnnnnnnnnnnnnnnnnnnnnnnnnnnnnnnnnnnnnnnnnnnnnnnnnna

SEQ ID NO: 10477 - DNA, 777 bp, Diabrotica virgifera
  misc_feature (65)..(87): n is a, c, g, or t
tgaatataaatatttttgtgtccgttttacggacattatttattaatcgtttgtttttatgtagnnnnnnnnnnnnnnnnnnnnnnncaagcagatttatttaaagaaaattagtaacgaatggatttttatctcaataatatatgtttttaaaaccgtgctgcacacacttaacattccaaagagaattataattttggtttaaaaatgtttgtaggagaatttggaaaaatagtccattggggaccgttaactgctttaggaatcatcaaggttgtcacagccatgactatacactgttccaatatgtggtggccaagaagtactataggtggaaaacttaattttttagtttttgtgggtttctctggtctcactttgtataattttctatcttctatgtatcatggtccaggctatttgatacttaattggagacctgagaaagaagagcactgtaaaaatttacagttttgtttagaatgtcagggatataaagctcctagatcacaccattgtcgaaagtgtggtcgttgtgttttaaaaatggatcatcactgcccgtggatcaataattgcgtgggctggggtaaccacgcacattttatcttcttcttaacctttgcaactgctggatgcctgcaagcctcagtgatattaggatgttgtttgtataaatccatacatagagtagggtactattatcaaggagatacgtcagtaagttttggtgtgaatggcatgatagtatgtgatcttgcacttggcttgtccatt

SEQ ID NO: 10478 - DNA, 589 bp, Diabrotica virgifera
  misc_feature (16)..(36): n is a, c, g, or t
  misc_feature (55)..(67): n is a, c, g, or t
  misc_feature (69)..(84): n is a, c, g, or t
  misc_feature (135)..(154): n is a, c, g, or t
  misc_feature (167)..(228): n is a, c, g, or t
  misc_feature (395)..(413): n is a, c, g, or t
  misc_feature (437)..(481): n is a, c, g, or t
  misc_feature (565)..(585): n is a, c, g, or t
gtatcaataggtccgnnnnnnnnnnnnnnnnnnnnngttttttttcctttaaggnnnnnnnnnnnnngnnnnnnnnnnnnnnnntgaaaatattttgagatttaatagagtaatgtattttttgtttgttgtggnnnnnnnnnnnnnnnnnnnngtagaagattacnnnnnnnnnnnnnnnnnnnnnnnnnnnnnnnnnnnnnnnnnnnnnnnnnnnnnnnnnnnnnngatttatgtgaattgaagtggtatttgttaaaaattatatctaatttgggaagaattatatgaaatgtatgatatgaagatgtattttataatttaagattattttatgatgattgtaatatttttttagggatgtggttagaaatagatattttttgatatttagnnnnnnnnnnnnnnnnnnnattaagaattttaatgtttttagnnnnnnnnnnnnnnnnnnnnnnnnnnnnnnnnnnnnnnnnnnnnnaatttttagtaagattgatatgtaattattataagtttaaaatgatggtgatattagtattagaaatttgtgtttgtagtaatnnnnnnnnnnnnnnnnnnnnntatt

SEQ ID NO: 10479 - DNA, 73 bp, Diabrotica virgifera
ttctactaggtcgggtgtttttgttgttgtgagggtgtcttaaaaaaggagaagagagagaaagggagagaaa

SEQ ID NO: 10480 - DNA, 1067 bp, Diabrotica virgifera
  misc_feature (41)..(90): n is a, c, g, or t
  misc_feature (92)..(104): n is a, c, g, or t
  misc_feature (133)..(528): n is a, c, g, or t
  misc_feature (530)..(578): n is a, c, g, or t
  misc_feature (618)..(618): n is a, c, g, or t
  misc_feature (655)..(655): n is a, c, g, or t
  misc_feature (658)..(678): n is a, c, g, or t
  misc_feature (680)..(846): n is a, c, g, or t
  misc_feature (850)..(881): n is a, c, g, or t
  misc_feature (955)..(974): n is a, c, g, or t
  misc_feature (1008)..(1034): n is a, c, g, or t
attaatcaattcatcatcatcttatccctttcgaaatcttnnnnnnnnnnnnnnnnnnnnnnnnnnnnnnnnnnnnnnnnnnnnnnnnnncnnnnnnnnnnnnntcgaaacgttattcgtttttcaaatatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnatatcatttaggtttttttatggaagctggatggaagggntggaatgaaaaaaaaacggtctttattaatttaatanagnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatnnnnnnnnnnnnnnnnnnnnnnnnnnnnnnnnaccttagggataaaagcgtaattttattgtggaaagttcaattcaaaaataaaatggggaacctccaaggttgnnnnnnnnnnnnnnnnnnnnggggaacagcgtatttattttaaagttggtttcnnnnnnnnnnnnnnnnnnnnnnnnnnngagattaaaaacgggggggggggagcggggggg

SEQ ID NO: 10481 - DNA, 56 bp, Diabrotica virgifera
ggaacccctcggtgaaaagtacaaagattctttgtactattcaccgagtcttgaat

SEQ ID NO: 10482 - DNA, 924 bp, Diabrotica virgifera
  misc_feature (159)..(190): n is a, c, g, or t
  misc_feature (192)..(747): n is a, c, g, or t
  misc_feature (749)..(832): n is a, c, g, or t
  misc_feature (891)..(913): n is a, c, g, or t
ctctaccaggtccgctcgattgatatagggactcatctcttctcctttaggtacaacactatcgtaaattctctattttcactaaaagaaaaatgtatacattccatggtatatttttactaatgaattgctaggtctcactgattattgaatacaacnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnccaaaaacccccataaatgtctatacaacctttactcaacttttttacctataatttcnnnnnnnnnnnnnnnnnnnnnnnctgggggggtt

SEQ ID NO: 10483 - DNA, 278 bp, Diabrotica virgifera
  misc_feature (14)..(43): n is a, c, g, or t
  misc_feature (62)..(84): n is a, c, g, or t
cctccctcgtccgnnnnnnnnnnnnnnnnnnnnnnnnnnnnnnctatttggtcctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 10484 - DNA, 804 bp, Diabrotica virgifera
  misc_feature (232)..(252): n is a, c, g, or t
cctcctgcgtccggacatttgaatgaataatcaggaaaattacaataaacatgcaagaaacgatatttaaaaacggccaccaatacgtagcatttgcagatgatctgacaatactagcaacatgcaagaaagaactacaaaagttaatgaaaaacataataacagaagccacaaaatttggacttaaaataaaggaaggaaagacaaagtatttgataatgggagagatcannnnnnnnnnnnnnnnnnnnnatcatattacaaatagatggataaaaaacatactcgttcaaaaaagccaaagaaattaattatctgggagccaaaatagatgaaaatggtcacgaggaaggggagataaagacaagcatatctaaaggaaataaaaagtatggagaattaggaacattaatgaaatccaaatacgtatccagaaaaacacaaatcaaactattatttatcaaacacaaatcaaactataaattatttatgagactgttatcagacctacagtaacatacgcatatgaaagatggatactgaaaaagtctgaaacagaccattccgaaagataggagagaaaaatgcaaataggtagtaatagggaggtgtgaaaatacaaggacagtggagaagaaaaaccaataaagaattggaagaactgtataaaaggccaacgataacgacgacaatcaaagcacagagaatacgatatttgtgacacatcgaaagaatgggaagtgaaaaatgccagaaatggtacccatacgaagaccaatacaaaagagaaggaaaggcagaccc

SEQ ID NO: 10485 - DNA, 216 bp, Diabrotica virgifera
  misc_feature (2)..(17): n is a, c, g, or t
  misc_feature (19)..(86): n is a, c, g, or t
  misc_feature (88)..(121): n is a, c, g, or t
  misc_feature (131)..(184): n is a, c, g, or t
  misc_feature (190)..(213): n is a, c, g, or t
cnnnnnnnnnnnnnnnncnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnngggggggatnnnnnnnnnnnnnnnnnnnnnnnnnnnnnnnnnnnnnnnnnnnnnnnnnnnnnncccctnnnnnnnnnnnnnnnnnnnnnnnnccc

SEQ ID NO: 10486 - DNA, 619 bp, Diabrotica virgifera
ccccttcgcgcccgaaaccgttggattgattaggaatggacctcccttttaatgctattgttacagctcatgtatttattataacttgttacatagtgatacctatatacaattggcaggttttggaaattgacttgtacccttaaaactagccgctcccactatatgattccctcttataaataataaaagattttgattgctaccaccgtcactgttattattattattcagaaaaatagtatgaagggaagtggtactcgttctgagctatctcccatcttcgaacacatacattggacatagaggacaaacaacataaagaattaatatatatttacattatgatgataatacattcttacgaatggtctgctaaatacatgttaattgatactcaccctacacataatatattaagattacgactaataatattattagatataggagtatttatttttctatatcactatcctttatttcctttataaattgttgattacaatattaacgaactttaaatcaatcccaaacccgatgacttaataccattacctaatcgtagtatctaggaaacaatatattacgtttaattaacggaattccgctaaaattc

SEQ ID NO: 10487 - DNA, 479 bp, Diabrotica virgifera
  misc_feature (151)..(169): n is a, c, g, or t
tcccctccgacggaaagttcccaatcggacatccaaagacaatatatattggagcaggaatgcaatgctgtatacattactgagttatctggattaataaagcgtaaagtgcttcctcctacaaagctccatcatcctagacttcctcccnnnnnnnnnnnnnnnnnnntgtagatggagagcaggaatataaaaaacgtaccgtgttagtatgacatgcggccgtactgccttctgaaccggttgtagctaaccacggcgcagactagaggattatcaccgggaccacctgcgaggtgaatcgcgatattgctttgaaagaaaattatgggcaagcacatgatgaatatgttttttatcctgttcattattatttaattatgggagcaggtttaaaatatttctctatctcagataatagaggtattgatgttggaatcttatagattttataatgggaagattttgaggcggtacat

SEQ ID NO: 10488 - DNA, 451 bp, Diabrotica virgifera
  misc_feature (7)..(7): n is a, c, g, or t
  misc_feature (16)..(36): n is a, c, g, or t
  misc_feature (38)..(38): n is a, c, g, or t
  misc_feature (51)..(53): n is a, c, g, or t
  misc_feature (62)..(62): n is a, c, g, or t
  misc_feature (66)..(88): n is a, c, g, or t
  misc_feature (93)..(167): n is a, c, g, or t
  misc_feature (172)..(227): n is a, c, g, or t
  misc_feature (404)..(441): n is a, c, g, or t
gaagggnttggatgannnnnnnnnnnnnnnnnnnnnantttataagaattnnntatttttangtannnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnncattttttgattaaaagataaattacctagggatacagcggatttttttgggaggtccaaccgcaaaaaaaatgcccccccccggggggattaaagttttaatggggggcccgcttttttttataccggttcccttttaaattttccttgctccgagttaacccgcgggggcccccnnnnnnnnnnnnnnnnnnnnnnnnnnnnnnnnnnnnnngcagggcccc

SEQ ID NO: 10489 - DNA, 619 bp, Diabrotica virgifera
  misc_feature (539)..(556): n is a, c, g, or t
tctatgagtataaaaatgcaacatctagtccattcaaacctttgaaatgtgcagcagctccaaagtcacacatacggtttgataacgagactgaagtcaaggaagaaaccggtgaagtaaatggagaaaaagaacaagatgacgtcagtgttatttgcatagataaccagaagatctatgagtataaaaatgcaacatctttgttcaactggcatgccataactggactgccggatgttgaagatgtagttgcatttaaggtatttaaattaacggatgaactaacaccaggtatatcgtctgaaatagtaggaactgttaaagaagtgttagaaaataattgggtaacgatttttatatgggatggtcttgaagaacttcaaaatagctgtgctgaaactatggagagtgatgaattaaatgatgaactttctccaatgaagactcttcgatggtttgatttaatacaccccaaacgcggtgaaaaaattactaaatattaatcattaactttttattagatgtatattagttattgnnnnnnnnnnnnnnnnnngctgatattttgtatgttattttaaagttatacttagataaataacatacaaaatatcagcag

SEQ ID NO: 10490 - DNA, 381 bp, Diabrotica virgifera
  misc_feature (3)..(48): n is a, c, g, or t
  misc_feature (56)..(131): n is a, c, g, or t
  misc_feature (172)..(196): n is a, c, g, or t
  misc_feature (209)..(227): n is a, c, g, or t
  misc_feature (252)..(270): n is a, c, g, or t
  misc_feature (294)..(329): n is a, c, g, or t
ccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnctaaaaaaattagatatatttaataacgaagaacatttcannnnnnnnnnnnnnnnnnnnnnnnnctattttacaatnnnnnnnnnnnnnnnnnnnctcttttaaattctaaaataatacnnnnnnnnnnnnnnnnnnngaataccctgatacacaagggacnnnnnnnnnnnnnnnnnnnnnnnnnnnnnnnnnnnnctctcacaaaactaattaactatcattatataagatttttctttacttttac

SEQ ID NO: 10491 - DNA, 981 bp, Diabrotica virgifera
  misc_feature (14)..(747): n is a, c, g, or t
  misc_feature (754)..(791): n is a, c, g, or t
  misc_feature (811)..(824): n is a, c, g, or t
  misc_feature (827)..(849): n is a, c, g, or t
  misc_feature (857)..(879): n is a, c, g, or t
  misc_feature (911)..(939): n is a, c, g, or t
  misc_feature (950)..(978): n is a, c, g, or t
cctcccgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttcnnnnnnnnnnnnnnnnnnnnnnnnnnnnncaaagggcccnnnnnnnnnnnnnnnnnnnnnnnnnnnnnaat

SEQ ID NO: 10492 - DNA, 61 bp, Diabrotica virgifera
  misc_feature (4)..(33): n is a, c, g, or t
accnnnnnnnnnnnnnnnnnnnnnnnnnnnnnnctaagggataaccgcggaaattttattg

SEQ ID NO: 10493 - DNA, 593 bp, Diabrotica virgifera
  misc_feature (36)..(71): n is a, c, g, or t
aaaaattacatttttcggaattaaatagtgcccaannnnnnnnnnnnnnnnnnnnnnnnnnnnnnnnnnnncttggatgaaccaagaccagaattaaaagtatttgcactgaagaaactagattccatagtgggtgagcttccagcacatggaggtgaaacgtacatacacctagaggagtaccatgtacctcatgagatatatctagtactgaacagggttgatgataatgcaaaatcgggttgtgaggatggcggcactgcttactcgtgcgacaatcaactaccatggacagagaaaaccactatgtcctatagggtgaggtgcagagtctttcagaaacagaattgaagtatccttatgttgcgctagagtattactaaacttcatagatcatacatcaaacaagataaagattgtacaaatgacaaacactgtatctgattttaatcaaaatcattatgacattgctcttcccgaagatgctgttgaaatttccacactgcgatgtcatgacaaatggaatgccccatggatcgggtgaagtgaccatatgctaggagatcttaataagcggaaatgtgcttctcttc

SEQ ID NO: 10494 - DNA, 564 bp, Diabrotica virgifera
tctccttttaggccaaattaggcttcctataattataatcatatacctttataatatctttattttttagagatatctcactactaattcaactgaatctactatatttatagaaactaccactaatccttctacaccgtgtgcttcaaccatcctacacaacgagttatgagatcaatagtttcgagattatactatcaaaaaccataatactaatattgcagcatatgctctttacatcatatggttgaaacgaaaagaaatccgccccgatctctcttcctataatttcttacctacttgacacaaatttactacctccatgtagttatttattatatgtatatgatagtcaaattaaatattcttactcagcgctacaatacaaataaacctcattaaaccctacgtagaaaatgttgaaaatgaccaaaaacccacctatttaacgaagtagaatctacgtctttatcaccttcaccacctagtataacttttgaaactacatattgccgtcacatttcaactaatctccacctacgcagagaggacagaatgaccaaa

SEQ ID NO: 10495 - DNA, 609 bp, Diabrotica virgifera
  misc_feature (506)..(550): n is a, c, g, or t
  misc_feature (554)..(575): n is a, c, g, or t
gcatattatctttccacagtgtatgttatatgcgatttcgatagggtattgctttggtgtacgagtccgcttaggtcagtcaatgtagcatgaaacactcaacattccataaatatcagtggttatgtatcccttgaacgcgcttaaaactacctaggatttctcgaactttgttcaccgacgcaatggggataaggatcatccaccgaaaaccagatgcgacactcagtgcatattatctttccacagtgtatgttatatgcgatttcgatagggtattgctttggtgtacgagtccgcttaggtcagtcaatgtagcatgttgttgtttttaaagttttcattggtactaaaacttttgttcaccaacgtagtattataaaaatcatagtaatataaataacgctgcaatgttatgaatcttaccaaattattttatggttctgttgtattagtgatttgaatttaaaaattgtacacatttactatgaaataaagtgatttannnnnnnnnnnnnnnnnnnnnnnnnnnnnnnnnnnnnnnnnnnnngacnnnnnnnnnnnnnnnnnnnnnnaccaaaaaattgccttcggaaaaaacaaacttgg

SEQ ID NO: 10496 - DNA, 679 bp, Diabrotica virgifera
gaaaaatcaaagaagcggctctaattatgctgaatgaagccaattgtgtcgcaggttcctcggtggaatgcggtaggatgtggttacccatactgaaggaggaggtcaatagaaggagaataccaggattggtgagtcaataatatcgagctagtacgtgttttatgttttagtattacttatatatctggtattattgatattgtttatagtttagacatgttacaggtcagagtttggtattgttttttgaaagtaaattgatgtaggaccgagtacttacgatgtcgggatggtgtcacaggtttttcctggttttcccttgtgatttgctatgaggtctctaacgcgagagttttgctgtcgttgcatttggttgtctttttggagacatgtcacatgctatgattttttgtgacggatgttcttgagttggggttgatttcatgtagtcgaatgaactatctttcagtgggtcgtcccaggagcgcaactcatgaatattggcggtatcattttgaagtcttctactttggaatgtataatatgtgtctgagttgccggtgtgaatgagtgagattaaataaattattggaagaatttttttgcttggcaacagcactttgttttattttggtaatgttttgtgttttgacagcggcacccgatttgggcgtcg

SEQ ID NO: 10497 - DNA, 949 bp, Diabrotica virgifera
ctcccacacctgttctaacactagtcgttactccctcatacatatctctcacaatctttacatattcgccagggacttctttcttgttgagtgcccaccacagaatctctcgaggaactctatcatatgttttctcaagatcaatgaatactatatgagcgtttgtttctttactcttgtatttttccatcaactgccttataataaaaattgcatttgttgttgatctaccctgcataaagccaaattgattctaggatatttcagtctcttcacgtatccgtctatcaattactctttcccatattttcatggtgtggctaagcagttttatagccctggagtttgtacattgttgtatatcgcccttgttttttgtagacaggtactagtatactgcttctccattcatctggcatttgtccaacttccataattctattaaataaacctgctagccaccttgttcctgtctctcccaatgctctccatacttccccaggaatatcatctggtcctactgcttttcctttctttattttttgaagcgctttagccacttcctcgtttgatattgtgttgaccattactgttactgactccacaggctgtctgtcaaattcttcatttaataagctgtcaaagtacatcctccatctctttttgacatccttttcgtgaactagtattttattattttcgtttcgcgatcatatcgttttgaaaatctgtgtcggatctggtttcttgtcactttttatataattttcccttcttttttatttttccttgtacttcgtttgaccaccaccaagtctctttatcctcgaaaatgttttcctgacgttttcccaagtatttcagtagcagtctctctaatactactggccatcttgtctactattctttccctgaatagaccttctttctcatcttttagcatcaacca

SEQ ID NO: 10498 - DNA, 922 bp, Diabrotica virgifera
  misc_feature (433)..(452): n is a, c, g, or t
  misc_feature (594)..(612): n is a, c, g, or t
  misc_feature (614)..(631): n is a, c, g, or t
  misc_feature (884)..(885): n is a, c, g, or t
acgggacataacctaatgtttacttgtttgggacagcaatgctttgtttgggtccggggaaatggatgtaattgcattatagagagtggctagaggtcttaaatgtgtatttttaggttcgttttacattctacatcatatttccattccacccataatatggatacttagctggatttttttatggttaaatataccttatataactaatttggatacttaattggatttttttttatggataaataaatggataaacatactttatataactaatagtaggacatcataaaccattaccgacccgtttcaccaaatacatccacagaacctctcaacttcagaccgctccacacagatgttatagtgcccagagatttcccaaatctagtggaccttcctatgaatatacccaggagttgcaaaagataannnnnnnnnnnnnnnnnnnncaattcatacctataaatattttggtttttactctacagtaataaatttgtgtaaactgtttatatgcatataacaggtacctatactacactatatacataggtttttgaagtaggattttaaataaagctaggtaatggnnnnnnnnnnnnnnnnnnncnnnnnnnnnnnnnnnnnngataagggaaaggggaattaagacatatataaagattgtcgataggttttaaataatatttctggataagtctttaaccaaactcattttgttagttttatatagcttctagcatctatgtttaattacgtatagtacttagacatagatctggtatttcgattgtttcggacacttaatagttcgatgggtgagtacgtcaccctttaagtctctgctagataaggtataaaacttttttgtgtaccattanngtgtctagtattactatacttatctagtctaggatca

SEQ ID NO: 10499 - DNA, 1109 bp, Diabrotica virgifera
  misc_feature (8)..(90): n is a, c, g, or t
  misc_feature (97)..(132): n is a, c, g, or t
  misc_feature (142)..(159): n is a, c, g, or t
  misc_feature (161)..(273): n is a, c, g, or t
  misc_feature (295)..(335): n is a, c, g, or t
  misc_feature (356)..(374): n is a, c, g, or t
  misc_feature (376)..(388): n is a, c, g, or t
  misc_feature (471)..(499): n is a, c, g, or t
  misc_feature (505)..(591): n is a, c, g, or t
  misc_feature (604)..(692): n is a, c, g, or t
  misc_feature (694)..(732): n is a, c, g, or t
  misc_feature (739)..(765): n is a, c, g, or t
  misc_feature (784)..(801): n is a, c, g, or t
  misc_feature (807)..(826): n is a, c, g, or t
  misc_feature (852)..(879): n is a, c, g, or t
  misc_feature (884)..(965): n is a, c, g, or t
  misc_feature (973)..(1101): n is a, c, g, or t
tttttacnnnnnnnnnnnnnnnnnnnnnnnnnnnnnnnnnnnnnnnnnnnnnnnnnnnnnnnnnnnnnnnnnnnnnnnnnnnnnnnnnnncaatatnnnnnnnnnnnnnnnnnnnnnnnnnnnnnnnnnnnnaaattttagnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagaaaatgaggataaaannnnnnnnnnnnnnnnnnnnnnnnnnnnnnnnnnnnnnnnngggtttaattaaggaattcgnnnnnnnnnnnnnnnnnnngnnnnnnnnnnnnnctggcctgtttggtttaaaaataaaagccccccggcccccttgttaatttgaaaggggccggggattttgccccggggaaagnnnnnnnnnnnnnnnnnnnnnnnnnnnnngggaannnnnnnnnnnnnnnnnnnnnnnnnnnnnnnnnnnnnnnnnnnnnnnnnnnnnnnnnnnnnnnnnnnnnnnnnnnnnnnnnnnnnnncccccccaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnncgcaccnnnnnnnnnnnnnnnnnnnnnnnnnnnatcctcccaggagaaacannnnnnnnnnnnnnnnnngggggnnnnnnnnnnnnnnnnnnnncccgcccccgcggcgggggaaaaaannnnnnnnnnnnnnnnnnnnnnnnnnnngtgtnnnnnnnnnnnnnnnnnnnnnnnnnnnnnnnnnnnnnnnnnnnnnnnnnnnnnnnnnnnnnnnnnnnnnnnnnnnnnnnnnncgggccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgttg

SEQ ID NO: 10500 - DNA, 67 bp, Diabrotica virgifera
  misc_feature (5)..(56): n is a, c, g, or t
ggggnnnnnnnnnnnnnnnnnnnnnnnnnnnnnnnnnnnnnnnnnnnnnnnnnnnnccccaattttt

SEQ ID NO: 10501 - DNA, 819 bp, Diabrotica virgifera
gtgttttattttcatttaatgtattagctgtacatctatttattacataatttgaataccatattgcttctccccataattgttttggtacccctaattcttaaataattgttctagcccgttctaccaatattctatttttcctttcagctttgccattttgttgtggcgtatatggtgtagtatagtctaaaacaactccattatctaaacaaaattttcgtaattctcccgatatatacatattcacctccattatcgcaccttaattttgaaattccaaaaccaaattttgcttttgccatattatagaattctacaaatttttggaaaacttcattcttttgttttatcatataggtatactgcagtaaaatttgaaaaatcatcaataaacgtaacaaaatacttactaccgtcatgacaaattggagtgatggggccacacacatcactacatattatttgtaataacctcgtacttttagttctagtaccaaatggcctttttgatattttcccttctacacaaggttcacaaaactcaatatttgatattcgaacattttctatgccatttactattttgttttttattaaacttttaagatctgaaaaatttatatgtgcaaatcgtttatgccattgtaaaaattcattatgttcagtaaccacattttgacattcatgtttatcaatctcaaatgtaatttcatataagttatttctatttcctattcccataattcctttatcatttacaaatttaactataccgtctgcaaaaattatttcattccggacatttctattcttttt

SEQ ID NO: 10502 - DNA, 121 bp, Diabrotica virgifera
gatgatcttcctgatatttcgatggatgtcccactggcttatattattttagatcgatttgtagaacgctgtcacaccgtcggttttctgaccgaaaacgttataaagaagatgccatctc

SEQ ID NO: 10503 - DNA, 90 bp, Diabrotica virgifera
  misc_feature (2)..(21): n is a, c, g, or t
  misc_feature (23)..(47): n is a, c, g, or t
tnnnnnnnnnnnnnnnnnnnngnnnnnnnnnnnnnnnnnnnnnnnnnctttataaagactcgccggccctctggttaatatgaatgcaca

SEQ ID NO: 10504 - DNA, 942 bp, Diabrotica virgifera
  misc_feature (110)..(143): n is a, c, g, or t
  misc_feature (242)..(287): n is a, c, g, or t
cttttatttttgtttatcaatcctgctttgttttctttcctctttttctttgatttctttagttttttttttcgatatctaaactttgttgcagatcctgagtaacaccnnnnnnnnnnnnnnnnnnnnnnnnnnnnnnnnnntgggttaaagggcacgagcccacaagttcgaaatccattttgtattgtttttgaaaagtgacaattttttaataacgcttcatttagaattggagcaannnnnnnnnnnnnnnnnnnnnnnnnnnnnnnnnnnnnnnnnnnnnnttgaataagttttttgtaggttgatttaagagaatggaataaagccacatccaatggttgcatgatgtgggtagagtttggatataggctgatcagaactattccatttttggagcagaatcggctgagctgaagggttagatgagaagtgtgaccgtcaacaaataaaataattggcctttgaattttgttatcatgtaactgcttaataaatacattcgcaatatattaaaaaaaagtttcctgggtcatccatgcattttcaaagcgtcccattgcccaacctttgggaaagctggaactgatcagttttgaaactcgttgcattgcgtaaactaccataggaggaggcaactggcctagagcattaaacattattaatgaagtaaggcactctcctttgtctccttttggagacagaaaaaaagccgtctcgtcacaattatacaccctacttggatctaggaggatatctaagaagccgtcttttttaaggtagctacttatttctgcaaaccagttacgtatctgttcttccgatactttagaacgttgtttagtcaaattttgggatatccttagacttatattggggtgccttctcataaatctgtcataccaatccctaccaggccggtttgttgtgaaaaggatt

SEQ ID NO: 10505 - DNA, 298 bp, Diabrotica virgifera
gagcggggcggaattccccgggccaccccccccccccgcgtgtattagatattcacttagtgtgtattcgaagtagtcatcaacatgatataatgaaaccttattgtcgtaatagtatcagctttctttcagctccaagaagaattaatcctttatggctcgtgacctaaaccataagattatttggtaatctattttcatcgaaaatgcctgcaacttgaaagttctaggcttctcgtgtctctgatacaattcttgtgaactggtgggcctctaatgggataaattcagctgctcg

SEQ ID NO: 10506 - DNA, 238 bp, Diabrotica virgifera
  misc_feature (7)..(24): n is a, c, g, or t
  misc_feature (36)..(122): n is a, c, g, or t
  misc_feature (126)..(202): n is a, c, g, or t
  misc_feature (210)..(227): n is a, c, g, or t
taatcannnnnnnnnnnnnnnnnngtggaatggagnnnnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnnnnnnnnnnnnnnnnnnnnnnnnnnnnnnnnnngggggtgnnnnnnnnnnnnnnnnnncctttttttta

SEQ ID NO: 10507 - DNA, 192 bp, Diabrotica virgifera
  misc_feature (32)..(50): n is a, c, g, or t
  misc_feature (60)..(83): n is a, c, g, or t
gggccccgcccccgccccccgttctgaagcgnnnnnnnnnnnnnnnnnnnatagtgttcnnnnnnnnnnnnnnnnnnnnnnnncttactattgtgagataacattatattgttataaaataaaacttcattttattgtaccttgtgtagtcatccagtattaatgcagtaatcatctatttattattttcga

SEQ ID NO: 10508 - DNA, 146 bp, Diabrotica virgifera
  misc_feature (2)..(132): n is a, c, g, or t
  misc_feature (138)..(138): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttanaagacgag

SEQ ID NO: 10509 - DNA, 657 bp, Diabrotica virgifera
  misc_feature (6)..(6): n is a, c, g, or t
  misc_feature (15)..(15): n is a, c, g, or t
  misc_feature (34)..(34): n is a, c, g, or t
  misc_feature (45)..(222): n is a, c, g, or t
  misc_feature (225)..(225): n is a, c, g, or t
  misc_feature (227)..(227): n is a, c, g, or t
  misc_feature (233)..(315): n is a, c, g, or t
  misc_feature (332)..(353): n is a, c, g, or t
  misc_feature (415)..(444): n is a, c, g, or t
  misc_feature (462)..(462): n is a, c, g, or t
  misc_feature (485)..(513): n is a, c, g, or t
  misc_feature (535)..(582): n is a, c, g, or t
  misc_feature (585)..(601): n is a, c, g, or t
  misc_feature (606)..(656): n is a, c, g, or t
aaatanatattttanataatttttttggtatganatgttattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaananatgggnnnnnnnnnnnnnnnnnnnnnnnnnnnnnnnnnnnnnnnnnnnnnnnnnnnnnnnnnnnnnnnnnnnnnnnnnnnnnnnnnnnaatggagagatatttannnnnnnnnnnnnnnnnnnnnnaaaatatatatgtttataaagggattcggccaaattttttcacctgttatttaaaacatgcnnnnnnnnnnnnnnnnnnnnnnnnnnnnnnactgagtaatttgatggncgcggtatttgaacgtggctaannnnnnnnnnnnnnnnnnnnnnnnnnnnngctggatggaaggttggaatgnnnnnnnnnnnnnnnnnnnnnnnnnnnnnnnnnnnnnnnnnnnnnnnnagnnnnnnnnnnnnnnnnncgagnnnnnnnnnnnnnnnnnnnnnnnnnnnnnnnnnnnnnnnnnnnnnnnnnnna

SEQ ID NO: 10510 - DNA, 217 bp, Diabrotica virgifera
  misc_feature (2)..(18): n is a, c, g, or t
  misc_feature (33)..(53): n is a, c, g, or t
  misc_feature (65)..(99): n is a, c, g, or t
  misc_feature (117)..(190): n is a, c, g, or t
gnnnnnnnnnnnnnnnnncagaagaccccatgnnnnnnnnnnnnnnnnnnnnnttttttaagccnnnnnnnnnnnnnnnnnnnnnnnnnnnnnnnnnnnggtttaaaaataaggttnnnnnnnnnnnnnnnnnnnnnnnnnnnnnnnnnnnnnnnnnnnnnnnnnnnnnnnnnnnnnnnnnnnnnnnnnnccctaaggggaaaaaaggggaaatttt

SEQ ID NO: 10511 - DNA, 1173 bp, Diabrotica virgifera
  misc_feature (991)..(1017): n is a, c, g, or t
  misc_feature (1052)..(1074): n is a, c, g, or t
  misc_feature (1102)..(1127): n is a, c, g, or t
  misc_feature (1138)..(1171): n is a, c, g, or t
atttccgagtatcatgttctttgacttttcctggtttatttttaggtcaaagtattttgcttccttgtataattttttcataacatttcttaattattttcttgttttcgttagcatagtaagatcatcagcgaaggccagacattgatgttcatattgttgaaaacggttccggtcgttttaactcggctatttctgattattgtttaaatacaaattaaaaaccaccgtggataatggatcctcttgcctaagacctctgttcatcgttcgatgagaatcctcttcgtactaccggtaccatagtaggtaccacctgtaggtaccatcatacttactacactgcttggctgtcttcgacaaccacttggctggaccctggttggatggttaatcggtttatgagtatcacgatgtatcctttgcattctttttctggcgaggatatctctggtcttaaggagtcttcttgtggcctggtggaagaaatttctggtcttattcacagccgactctctcagtggtgtgtactggagcctttcatggatggttatattaggtaaaccatgtcttaaggtatccatacgttagtgctccgtgtagcagttccacaaagtggatacgttggtgctagccgctcactctcttcgattcaaccgagtttgtggttttatgtaggggagcgcatattcatttgagcagctacacgagcaccaacgtatgggtacgtacctttacaatgatgattctagagatatgtggtatgtggattatatatgatgggataatgttcttgcttttaatattttcaaaaaatctgcccttcgtacgaaggggggtgctaaatctgtttttaaaccaaaaaggaggaattccaaattcccccgaatttcccacttattggcatttcattaggtaatttaagatattttaacgggtttggttgtattttctaaaaaaaggtggtttttaaaactctttaaacaccgcnnnnnnnnnnnnnnnnnnnnnnnnnnnggaattaaccggccaaaaacccgataatgattccnnnnnnnnnnnnnnnnnnnnnnntatttgggggataatttttaatggtgannnnnnnnnnnnnnnnnnnnnnnnnncccccctttgnnnnnnnnnnnnnnnnnnnnnnnnnnnnnnnnnncg

SEQ ID NO: 10512 - DNA, 932 bp, Diabrotica virgifera
  misc_feature (900)..(900): n is a, c, g, or t
gtcaatttacaattttattaacattttattaacacaaaaatgaactcctcctattctaactatttataacgtacatatgtgaaagtgaatgataatgacttttaccccttttaataaataaaccagtgaacatgtttacatcactgaaaaacaaaattcgcgaagaaacagggagtgatctatccaaactcacagctaaaatcacctcttcaacggtgcaaaagatcgaatctttaagaggaagatcaacgcaaggctctacttcaagcctaaactctatagtttcttcagaaggcgtcaaagaagatggtggtattgagtcggatgacttcaaaaaacggttgatgaagctagaggcagaatttgtgaaaaaactggaccataaagaaaccgaatggcgcgagttgttgaaagacaaggataagaggatacaagcgctggaaaaagatagggaagagtttcagagccagctagggagcctcaaagaatctttgagaagtgctgaagaattcaattcaaagatactactgcacaaagaaaacaatgaacagctagaaaatctccaatgccaagaattagctaaagtaaaaagtttagtcctgttacgagatcaagaaattttagaaaaatccactgccctcaaagatgccaacactcaattagataagctacgaagtgaagtggtgcggttaaggaggcaagaagaaatactaagcgatgtgcaggacgacctggaagcattgcggcacagcacttctagagatctagcgcatttagcgtcggagctatcgaagagtgaacaggagaagaatatctgccagaatgttgttgtgattctgcgacagaataacaacgatgaaggcgtcgatagcaaaagcgcttctgaaaggaactttttgnagcagaggctcgaggaagctcacttgcattta

SEQ ID NO: 10513 - DNA, 582 bp, Diabrotica virgifera
  misc_feature (19)..(383): n is a, c, g, or t
  misc_feature (390)..(427): n is a, c, g, or t
  misc_feature (447)..(460): n is a, c, g, or t
  misc_feature (463)..(485): n is a, c, g, or t
  misc_feature (493)..(515): n is a, c, g, or t
  misc_feature (545)..(576): n is a, c, g, or t
cgaaaggaccaaatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10514 - DNA, 512 bp, Diabrotica virgifera
  misc_feature (2)..(510): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 10515 - DNA, 480 bp, Diabrotica virgifera
attatgatccacgaatctgttttattattggagaaaaattgaacaaattacctacgaagatgaagtctgatggcccgagtttatccgatggaggattaatccgaacgaagaggctgcgtgccgagaatactgatagacaggttattataaatgttatcagtatcgataccgtagattgcagttcgccagtgaacataaagagataggcgtcgcagcgggtggtgagccgatgaggactcgcatgatgcggcagatcacaacacggacctaggaggacagccgccttgcctctaaataagatagtgctttgtcttaacaatagctctcaaatgggtccctcattgtatgcaatagggagtcgggagagtgagtgtcttctaatcagaagattctcatggagtgcgtggacctgcatgtggttcttgtccgagttgttgcatcatttttagattctgctgtatctttactggagagttcctc

SEQ ID NO: 10516 - DNA, 796 bp, Diabrotica virgifera
  misc_feature (2)..(50): n is a, c, g, or t
  misc_feature (52)..(548): n is a, c, g, or t
  misc_feature (550)..(661): n is a, c, g, or t
  misc_feature (663)..(789): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttttt

SEQ ID NO: 10517 - DNA, 866 bp, Diabrotica virgifera
  misc_feature (116)..(132): n is a, c, g, or t
  misc_feature (533)..(547): n is a, c, g, or t
  misc_feature (779)..(800): n is a, c, g, or t
gaccagcccatgtcaccataataaacaacaacaattaccatcatcaagttatacctccgactgtacattataacagttatggacctcctccagtcggtatatctataactacccannnnnnnnnnnnnnnnncttcttcacgttatcacacaacttatcattactctagtcaagatactggaagtactgcattaggattcttcttgggctggcaattgggcaaaataactcgaccaagttattattatcacagtacttcatacgtaaacaacgaatatgttcccagatatgatcattataccgttcaccactattaccataatagcgagtcagtaccacaagaagcacccattcaacccaatgctgttgtagtttgtgctggtgatagtagttctatatgtcctcctggtacaataccattctgcacaaacaacggtgtagtcatgtgcgtcgttaacgctatagacacatctccttgctctacaaacaaacaacttaagtgtactacctcaacgatatcatgtgagggcaannnnnnnnnnnnnnntagacagaaatcatcgacagctgtggccataccttgcgtatctactgctaccattccagcaggagtcggagtcagagataatagtctggttgtaacagaccctaatgattcttcacttataacattctgtgtgacgggcctagccacgccaactaacaatgaaataaaatctggtagaaaagaccaatcagtgacacagattaatgaaaacttccattatactacaaatcannnnnnnnnnnnnnnnnnnnnntattacttgggccacaaattgcaaaaattacttcaccctagattttcttttctaaatatgaccaaa

SEQ ID NO: 10518 - DNA, 836 bp, Diabrotica virgifera
  misc_feature (2)..(285): n is a, c, g, or t
  misc_feature (287)..(760): n is a, c, g, or t
  misc_feature (762)..(796): n is a, c, g, or t
  misc_feature (798)..(827): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnngnnnnnnnnnnnnnnnnnnnnnnnnnnnnnncccttaagg

SEQ ID NO: 10519 - DNA, 600 bp, Diabrotica virgifera
gaaccatagttttatttccccaatttaataacgaaatcgatggaataatatattattaatgaaaagtgaaaacgataccgtcgatgaacgcgatctcttccttcgctttcaatgctatttgtctattcgttggatgcttaagctttaatccgtcaaagtttttaacggtgttgtgattcttagtacaatgattaggttttcgtgaggaaataattgaaatggtcgcagttaattgtgatggggaacaccgcgagcgtcgtgcaacaagtgtgttgtgcccatatggataatgtggaaaaaaccataacggaactattccactcccaataaacattattattctaaccatggaaagagatcgggcaggaaataggggaaatgaatgagcagacgttactggatgattatgcggactgtaaatggtttcctcgatgcctctgtttaaaatatctctatttaactatttctatcaaaaatggataaaggaacctgtggggacgatcattctataatagaacattttggccttccaatttggtccccgtacctagatacgccgtcgaaggatatgacatatatggcccgagtgccgaagttaaa

SEQ ID NO: 10520 - DNA, 535 bp, Diabrotica virgifera
aacggttagtcataactgggatcttccgacagtttcattttatttgcttggattaatccaacaaattccgctttttgacttattttcgagtgttgtttcggatcggacaaaacataaacaacgtgcgacaacggcaagtattgaaagtgtgaagtgatcaaattagatcaatgaaagaagctaaatagtaagatgagtgctaaattgcgcatgcgtactccgtctccaaaaactgtcactttcgatccttctccaccaactactttggagaggccgaggaaacttatattcaggagtcgcgccgaatgggagcgttatcttgatgctctgcttgccgatctccaaaatacagtttcaggatcatcaggaataggatcaaattattctggatatggccagagaaacgtccggtattctcccgatagcgatggacattattcaaaaacagacagctattcagtgaaatctggaagttacgggaaggtgccgccaaattccggtaaccggagtccgagctacgccctaaacgcaactg

SEQ ID NO: 10521 - DNA, 389 bp, Diabrotica virgifera
  misc_feature (13)..(110): n is a, c, g, or t
  misc_feature (112)..(133): n is a, c, g, or t
  misc_feature (293)..(310): n is a, c, g, or t
  misc_feature (319)..(370): n is a, c, g, or t
gttttttagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnttaccctaaggatacagcggatttttttttggggaggtcaatcgaaaaaaagagggggcccccccgggggtggttaaaagtttttaaattggggggaccctttttttttaaaatctggtgtcccctttttaaatttttatatggagtgggggttataaannnnnnnnnnnnnnnnnngcggggggnnnnnnnnnnnnnnnnnnnnnnnnnnnnnnnnnnnnnnnnnnnnnnnnnnnnaagggggggggcccacccc

SEQ ID NO: 10522 - DNA, 107 bp, Diabrotica virgifera
  misc_feature (7)..(86): n is a, c, g, or t
  misc_feature (93)..(106): n is a, c, g, or t
taaaatnnnnnnnnnnnnnnnnnnnnnnnnnnnnnnnnnnnnnnnnnnnnnnnnnnnnnnnnnnnnnnnnnnnnnnnnnnnnnnnnatagagnnnnnnnnnnnnnng

SEQ ID NO: 10523 - DNA, 733 bp, Diabrotica virgifera
  misc_feature (30)..(51): n is a, c, g, or t
  misc_feature (85)..(124): n is a, c, g, or t
  misc_feature (248)..(272): n is a, c, g, or t
  misc_feature (301)..(576): n is a, c, g, or t
  misc_feature (578)..(695): n is a, c, g, or t
ataatagactatttcttattataagtagcnnnnnnnnnnnnnnnnnnnnnnattcactactactgcgacaaaacattctatttcnnnnnnnnnnnnnnnnnnnnnnnnnnnnnnnnnnnnnnnnacattattcagcaacaaccatatatttattatttgtctcactgaagagcacctatgaaattacaattcttattgtacaatcaccattttaaatactttttttgtaccgacctgttattcgtacnnnnnnnnnnnnnnnnnnnnnnnnnctatacacccaatttatttattagcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcatactcattagtctgtttaatgcaagctggaatg

SEQ ID NO: 10524 - DNA, 948 bp, Diabrotica virgifera
  misc_feature (2)..(811): n is a, c, g, or t
  misc_feature (813)..(944): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngata

SEQ ID NO: 10525 - DNA, 803 bp, Diabrotica virgifera
  misc_feature (753)..(780): n is a, c, g, or t
ggcaatggtgaattgcttagtttgcagtctaaaacactcttaaactaagtatatgacgcatttatgcgtcacgatgtatgtgacgcataagttcgtcttcgtcataagatcgcatagtccctactacagcgttgatcgatcatttgaattacctatatttaacggtcatggcgcataagtgcgtcacatgttttaataacgctgcgattaccgtactggtgacctaatagaccaaatttaacaagaaatgtaacagcagatataaggaaatggtatttatttaagttttgattttctagccaattacgccttccagtaggaatcagtgagtgagcaatgacctggatttgagaccgtagtcccttaccccaatctaatccactgtttgcctgtcactgctcttatgtcatctagcaatctattggtctccattctatgtgaccggcccagcgctatttcatttctgtaatttcttccctgatcttcgttctacgtcttatctacgttttgataacgcgtgttaagcgcttgtcatgtgaacgtacccttagtcttaaatcatagaattatagaaagtgaaaaacatttctaataaaaaaattgtctataatttagttgtatgtatatgacgttattgtttctttcttgttacttttgagtgaatcatcgcaatatttatttaagcattggtgatgtttgtaatatttaaatttaaattgttaggaccaaaatagatttccacatttcatattnnnnnnnnnnnnnnnnnnnnnnnnnnnnattataatgaagttaaatattgg

SEQ ID NO: 10526 - DNA, 694 bp, Diabrotica virgifera
  misc_feature (2)..(229): n is a, c, g, or t
  misc_feature (231)..(381): n is a, c, g, or t
  misc_feature (383)..(438): n is a, c, g, or t
  misc_feature (440)..(541): n is a, c, g, or t
  misc_feature (545)..(569): n is a, c, g, or t
  misc_feature (580)..(580): n is a, c, g, or t
  misc_feature (582)..(613): n is a, c, g, or t
  misc_feature (650)..(672): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcnnnnnnnnnnnnnnnnnnnnnnnnncatgataaaangnnnnnnnnnnnnnnnnnnnnnnnnnnnnnnnngtttacgttagaaagcttatatttttttgatagatcnnnnnnnnnnnnnnnnnnnnnnncaatattaatacgtttttttag

SEQ ID NO: 10527 - DNA, 912 bp, Diabrotica virgifera
aaggctttactctttaaaaatcattttagagattgataatatttatgtatgatgcgtttgtgtatcaacataaatattgattatctctagaacactgaaaaattactcactcaaattacattgatttatttatcatacatcagttgtcataaattatggtaaatatttttgtcataattttactaaaagtaacgtcctaaaagttgctcaaattcatttttccgtgatttatattcctcacaaggacccagataacactgcagaggcaaatattaaaagcaagatacctaatgaatgtcaactcagaaatacctactccctaatatagaatccttcggaataaaacaagttatggcacaactaaagaacaataaggctccggacctagatggaatactttccgaaattttgaaggaggggagtgaaattattctcgaagaattgaaaaatccccccaacgaatgccttcacagaggagaagtcccagatgattgaaatgaaagtttgacaataattctcttcaaaaaaggagacagggaaaataagaaaagaactataggccaatcttcctgctgtcccaaatatacaaactgtttatgagagtaataactaataggttaacgttgaagcttgataactaccaattggtagagtaggcaggattctgaaaggattacaatacagcggatcatcttcttatagtcagaacgctaatagagaaagccaatgaatatcagttgaacttatacattggcttcgttgattatgaaaaggcatttggctacatagaactttgggccatagtgacagctgtgaacaactgcaggatatattcccgatacagaatgctctttacgtatatgtacaagaaagctacaatgaaaatacaaatagatgggaacacgaaagatg

SEQ ID NO: 10528 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
  misc_feature (196)..(196): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnnganagg

SEQ ID NO: 10529 - DNA, 983 bp, Diabrotica virgifera
  misc_feature (872)..(895): n is a, c, g, or t
gaaatacgcgtacctataatttgtatagtcatcctttaacaacaggaaatacctatttccccctaaagactcttcttccatagggccacatacgtctgtatgcactaattgtaatggctcacttgctcttgattcacttaacttgaatggtattctgtgttgtttacctgttaaacactgttcacacacgaatttttcgtctataaaatcaatgttattttgccttaaaaagtttctcacatatgtagtattttgatgtgctagtctgcagtgccaaactctcaaactttctgttgtttttgcagaattacactctgataaaaatacatctactaaacagctgttttcttgaacttgaccgtcagacaagttttcgttaggggtgcgttccgaaattaaaatatttgcaaaggtttcagtgttttgttcttgtgagaataacattttgtataatttgttatcccgtgttgccaatgctcttatttctcctttgtcattataaaattcacatttttcattgtttgaaaacatcttataacctttatctaaggcacatccagctgagaataaattaaattgtaaatctggcacaaataatacatctgacagggttgactttataaatttcttaccattaaatgcccatagagttatttttccaatacctttaactggtaatttttctccatttccgacttttacttgttttttatagtttatctctatcaattcttcaaacagatcttgattccagcacatatgttcgctagctcctgtgtccaagcaccattcatttttatttttcttactcccagtatataccatgaatgcattactgtcaattttattttcttccctgcttggcctgttgnnnnnnnnnnnnnnnnnnnnnnnnccacactccttggtaagttgtgtcctcgtcttttacattgactgcaatactttttatgtctttctgggctattattatctctctcctt

SEQ ID NO: 10530 - DNA, 149 bp, Diabrotica virgifera
ttagccctatggaaaactggttacctaatgattaagaatagatcccgcaggagtggagatctagactgatcaagaaccggtaaagatggtcgcgaaaaggtgagcccggaaggggacgaagtgtgcgccgagaaacacgatgtacatat

SEQ ID NO: 10531 - DNA, 124 bp, Diabrotica virgifera
  misc_feature (7)..(34): n is a, c, g, or t
  misc_feature (51)..(95): n is a, c, g, or t
  misc_feature (97)..(121): n is a, c, g, or t
taatcannnnnnnnnnnnnnnnnnnnnnnnnnnngaagggggttggatgannnnnnnnnnnnnnnnnnnnnnnnnnnnnnnnnnnnnnnnnnnnngnnnnnnnnnnnnnnnnnnnnnnnnncga

SEQ ID NO: 10532 - DNA, 62 bp, Diabrotica virgifera
  misc_feature (2)..(55): n is a, c, g, or t
gnnnnnnnnnnnnnnnnnnnnnnnnnnnnnnnnnnnnnnnnnnnnnnnnnnnnnnaaaaata

SEQ ID NO: 10533 - DNA, 930 bp, Diabrotica virgifera
  misc_feature (62)..(79): n is a, c, g, or t
cggggggttcactgatgatggactgatgggtccggggacgttctgaacgtgatccttttggnnnnnnnnnnnnnnnnnngtttctattaagtataccgactgcaccggggagttttgcttcacgttggattttatttaactagatggtacacagccaaccttcgggtattatcccgttttaattatgatattaggtatttgctgaatggatatgcttcttcataatatcacaattttgattttattgtctaccatgattttaacatggactttgttgatttttctggagcacccggatggtcatcatctaacacactacgacaaaaagaaaattcagttttccaaagattatctgttgttactgacgatgcagacttgtcgtaaatactagaataactttgatttctgcattgttctcgccttttaagtatactcaacttcttcttcttgtgccactcctgtcggagattggaaatcatcaaggttatgctgaccttgtttacagctgacctaaaggtttcattagtggtgcagccaaaccactccctctcaaattccgcaaccctgacattcttctacggcctggattccgtcttgtctctatttttccttgcattatattttgaagtaatgcgtatttatgtcctctcatcaggtgacctaaatattcgagttttcttcgttttatctgtttcttttatctgtttctgtatcttcgttttatatgttttattttatcgcaaaatttctgggtcttttgatatccttcgtattatacttaactagttaagaccaaattcattgttgtttatttttgaaagttggacctattctgtcacacaatgtgtcatttttgacatatgtcaaaaatcaggatcaaattgttctcaacgccatctcattgtcgtatacataaatattgaagaacac

SEQ ID NO: 10534 - DNA, 734 bp, Diabrotica virgifera
  misc_feature (421)..(439): n is a, c, g, or t
  misc_feature (467)..(491): n is a, c, g, or t
cctgtcccctaaatggtaattcctaacaagttaaaaaattacaatatcaatcattaaacgacgtaaaactacctacttacctatttcataattttatcccgggtgcgcttaggtacgtgccttgttaccgtttgcagatcaccgctcggcagattggtttctgccgtacttgccattcaaataaatacgggaaatgtataattggttgcctatccgctaatattccatagcttcttattacaagcaaatcttcaatctggggacggcttaccgaaaacacacaatcgcaatcgggtgcatggctataggatcatttttgaaaagtctcttacgcacagtgcacagggatcacttaacctatgggatcgatcgaattcttttaaaaacaatgaataaaatttagtctgtattatctcacagnnnnnnnnnnnnnnnnnnnacagaaacgaatatcatcaactctgatnnnnnnnnnnnnnnnnnnnnnnnnntaatgtgtccataaatggtgtgggtcggtactgccgaccctgccgaccctgacgagccgtcactggcttacgcattggcattattattgttattttaacatttatttgacaaattagcgattttagtctgtgttatttatttagatgattgtatatttaattttatataccaataatagtacatcatcaaggttaatagaaatcattaaacattttaggaatgctactctaaattaatttact

SEQ ID NO: 10535 - DNA, 107 bp, Diabrotica virgifera
  misc_feature (4)..(4): n is a, c, g, or t
  misc_feature (11)..(94): n is a, c, g, or t
ctanatttacnnnnnnnnnnnnnnnnnnnnnnnnnnnnnnnnnnnnnnnnnnnnnnnnnnnnnnnnnnnnnnnnnnnnnnnnnnnnnnnnnnnncgccacatttttt

SEQ ID NO: 10536 - DNA, 717 bp, Diabrotica virgifera
cttagttttataggcattaggaatgcttaatgaatagaaaagaaagtgtttgcttctcttatcacgttgtaacactacgtagatagaatggataccgtgtatgaaaaaaaataaagtcaatgtatggtttttaagacatttaagaaaatacttattctaggtatatgtaatcgacggttatttttacaattaaaatatgttcagtgaaatttaaaatagaattcatccagatttttgaattctattggaatatcctggtttattttaatttagaaggtgtatgttgcgcatcactgaatctgcaaaatcatttcttttttttacttccatacaacctgtaatcgagaaacacctgcatcttttttaaaaatcctctttcacttcatcgggtaaatcattaatattttacattcctaattcctagatacgtgttgttaatgttgacccattttttaatatcttaatgatcaattgtttcgacattaagttgtctcacatattttgtgggtccatgtaataagcaataaatctttatacagtgtgatcattcgctgtgcaaatttgtggtaaccactttatcgctctgaacaaatggattaaactctaccaattttggtaaaacccattctaaaaataaggaaataagttctccttccactttccatattcctatttcactataatggttaccatccgaaggaaagaacttaacatttt

SEQ ID NO: 10537 - DNA, 717 bp, Diabrotica virgifera
  misc_feature (26)..(44): n is a, c, g, or t
  misc_feature (686)..(709): n is a, c, g, or t
agcgtagttcaaataatttgaaatgnnnnnnnnnnnnnnnnnnngctgtttttttataatttctttccttagcatggaagtcgagttcccttctatagatcccaatgaggatttaacccagattttgcccattcaacagaaacgtactatagcgtttgttaatcatttcataatgaacacagtgtcgcatttaaataatttcgcacagtcgtgtgagtcccggttcatggaattcgattataaaattcagaagattgaagcttccctttctatattggagtcacaattgtcatcaatatctggtttggataatgtagaaagcaaaaaagataatttagaccatgtcgataatagttcccaaaatgttgtcgaagtagaattgcccgagatcaagcagcaaaaagaagaggaaccaactattgtggttgagccagaccctcctcagaaaactcaaggaatcgcagctaaagatgaccctagatttaagaaattctttaaaatgctacaatttggagtgcctgagccggctgtcaaattaaaaatgaagaatgaaggcatagatccatccattttggaaaaacctcatgatgttgtgccaggattaacggaagatctgatacaaaatgagtctgaagaaaaatcagattgattctagacaaattcgtatttaatatgttcctagacannnnnnnnnnnnnnnnnnnnnnnnccgtaccg

SEQ ID NO: 10538 - DNA, 917 bp, Diabrotica virgifera
  misc_feature (124)..(143): n is a, c, g, or t
  misc_feature (171)..(190): n is a, c, g, or t
  misc_feature (202)..(221): n is a, c, g, or t
  misc_feature (754)..(776): n is a, c, g, or t
  misc_feature (782)..(803): n is a, c, g, or t
  misc_feature (816)..(816): n is a, c, g, or t
ctaaaatataggtccatatattcaataaacaattcaaaataataattgctcaggactaagaagacatacatacaattactagatggcactagaagaaacctaggtcataacaatgggagattcnnnnnnnnnnnnnnnnnnnnctagttttgtttcttctgcaaatgttcnnnnnnnnnnnnnnnnnnnnatcgactcccannnnnnnnnnnnnnnnnnnnctgagttatagtgtgtgtatttacatttagcaggttatttagcaatttttatggctgcagtgttgtcagatactgcaaaggtactgtaataagaaactgtaagaaatatttactattgaacatttttggttattaaagtgttttggatgacacaagggaaaacctaagcggactcgtacatcaaagtaatatccaaacgcaacatgaaacacagggttaacatcagggtggccacgtcagtttttatttcttcagtagttttgctttcaaaaaatcagtagaaaccagtagtttttaagccttgtataatacagtaaaatctgtgttaacggccacctgtcaaaatcgcccacctgtactaacggctagtttcaaaataacggcccctttaaaaattctccaatcaattatgtaatgtagatttccttatttttgacctggtatttacggccacctttataatacggacgcagccaaataatctcatattatattttaaagctttcatagaagttgacctgttaagcttgtcnnnnnnnnnnnnnnnnnnnnnnngtgatnnnnnnnnnnnnnnnnnnnnnncgtaattaattanaatttaaattaaataaagttgaggggtatttctggtgaaaactggtgtagtaacaaaaaatatgggcgtcagatgcttttcaggtgtcattgtacttgcat

SEQ ID NO: 10539 - DNA, 230 bp, Diabrotica virgifera
  misc_feature (2)..(229): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10540 - DNA, 1040 bp, Diabrotica virgifera
  misc_feature (145)..(180): n is a, c, g, or t
  misc_feature (413)..(434): n is a, c, g, or t
  misc_feature (462)..(481): n is a, c, g, or t
  misc_feature (855)..(855): n is a, c, g, or t
ggaacgggtaacctctggtgttagtttttaatacatatttattaaataacattttatagattttcgaccatggccacagacgctaaaactcctcgtattcttaaaagaataggtacccatagtggcgtttttcattgtgatgaannnnnnnnnnnnnnnnnnnnnnnnnnnnnnnnnnnntatgcggatgcagagattataagaaccagggatccgaagattttagatgaatgtgacattgtagtagatgtaggtggagaatataatcccaaaaaacatagatacgatcatcatcaaagaggttttgaagaaacgataagtactgtacgtccagatcttataaaaaacaaatctataaagttaagttctgctggtttagtttatgctcattttggttttgaagtattagacgnnnnnnnnnnnnnnnnnnnnnnacctacaaatactgaatgcttaagatcnnnnnnnnnnnnnnnnnnnnagggatttgtggaagaattagatgctatagacaatggagttccaatgtttactgaaggtaaaccaaaatatagaataaacacccatttaagtgcaagaatacacagattaaatccagaatggaattctccaaatccagttcctagcaatgaaactttctttaaagctatggagttagtagggacagaatttaatgaaagagttatagatagcgcaactgtttggtggccagctagagaaattgtaaaaaaatctatagaaagcagaaatcaagtacatgaaaacggacagatagttttactaaacgaaagatgtccatggaaagatcatcttctggctttagaagaaagatttggggatttccggacaaattanatttgttatttttcatgatgctggcgattcatggagagtacaagctatacctatcccaccctgatagttttatatgcccgagtttttctacataaagattgggcgaggcgttccgtgatgaccaactcagccctataatcgggcataaaaaaatgcatattttggcatgccaacgggtttttata

SEQ ID NO: 10541 - DNA, 944 bp, Diabrotica virgifera
  misc_feature (4)..(36): n is a, c, g, or t
  misc_feature (38)..(50): n is a, c, g, or t
  misc_feature (65)..(92): n is a, c, g, or t
  misc_feature (296)..(314): n is a, c, g, or t
  misc_feature (321)..(338): n is a, c, g, or t
  misc_feature (381)..(409): n is a, c, g, or t
  misc_feature (536)..(561): n is a, c, g, or t
  misc_feature (623)..(708): n is a, c, g, or t
  misc_feature (722)..(743): n is a, c, g, or t
  misc_feature (765)..(781): n is a, c, g, or t
  misc_feature (783)..(796): n is a, c, g, or t
  misc_feature (799)..(814): n is a, c, g, or t
  misc_feature (820)..(858): n is a, c, g, or t
  misc_feature (877)..(907): n is a, c, g, or t
  misc_feature (920)..(943): n is a, c, g, or t
gaannnnnnnnnnnnnnnnnnnnnnnnnnnnnnnnncnnnnnnnnnnnnnccaaccccctctaannnnnnnnnnnnnnnnnnnnnnnnnnnnttattaggactatgtttaggaatgcaaattatgacagggctatttttagcgataattacctgcacactagtttcgaatttattatagatgagtaattaatgtttttatagaaaaagacacataccaaagaaatgattagcaatgaaatgtaattcacctctcagtgtatcacctcttttgtacgaattaacttaacctaattgnnnnnnnnnnnnnnnnnnnctcaagnnnnnnnnnnnnnnnnnntcagatatttttagggaagaacttaaacataatatctgattannnnnnnnnnnnnnnnnnnnnnnnnnnnnagatgattctcatattgtatgatacgttatcatttattgtatgtgtatgattatttttattttgtactcactttgttgttataacataagttcacattatttagattgagttctgatgatgatattnnnnnnnnnnnnnnnnnnnnnnnnnngaaatatgtaggttccagagaggaactcggcaacattgttctcgcctgtttattaataacgnnnnnnnnnnnnnnnnnnnnnnnnnnnnnnnnnnnnnnnnnnnnnnnnnnnnnnnnnnnnnnnnnnnnnnnnnnnnnnnnnnnnnnctcattagttttannnnnnnnnnnnnnnnnnnnnnagtggatgaaaaaagaatgtcnnnnnnnnnnnnnnnnngnnnnnnnnnnnnnngannnnnnnnnnnnnnnngtttgnnnnnnnnnnnnnnnnnnnnnnnnnnnnnnnnnnnnnnncataaagctttttcagatnnnnnnnnnnnnnnnnnnnnnnnnnnnnnnnctactcggggggnnnnnnnnnnnnnnnnnnnnnnnnt

SEQ ID NO: 10542 - DNA, 475 bp, Diabrotica virgifera
  misc_feature (2)..(22): n is a, c, g, or t
gnnnnnnnnnnnnnnnnnnnnnattaaccacttcctagaattctatcggcactcaaagtttattgtgtcataactatatataacactctaaggatataaaaaagataagccggcttacccgacaagctcctcgttatccagcatcaaagtatatagtcagatattacacggaagaactaacatattctaaattcatattatttcaagtatgcaaaaaaacataagccgcatccgctttataaagcactatcactcggtaaatcatataagcaaaaacatctcatcatcgcatgaactcatatgtattaacagcataataatagtcagactgtctccatagttcgtaatatgatctgatttcaagtgcgtacgcttatggatctaagctttatctctttctaatattcagctattgcacagtgaggcggagatctcctctataccagggtgatcaaagacagcacgacttatgata

SEQ ID NO: 10543 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10544 - DNA, 1008 bp, Diabrotica virgifera
  misc_feature (6)..(1007): n is a, c, g, or t
cacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnt

SEQ ID NO: 10545 - DNA, 547 bp, Diabrotica virgifera
cgagttctcccggggcccccccccgcggccgattttatttgtacatgataaaaatatagtgctgggagctggtgtaaacttcttaattattgttgaagaagatgttgaggagataccaatcattcgaacgaaagctcaattattattataaacctagtgatttagactatattttatgtgatgaatggttgtgctggttctcggtatatctaacgctaggagacataaatatggagaatattgtagctagtaaactagattcacatatgttcatatcagccacagttgacgagtactggcaacgagctgacaaataagatgtgtttgagattgatttttaggtaatacataaaggtatccatgtatttcatgagaacaaatgatcaccgaccggtgttaaatattatgctatatgatattaatcaatataagactaaatgacgatatggtagtcatttaagggaggaagtgtcgaaagattcgaatgcatatttgtagtaccttgagcgaggactgtaatatatgccggacatcatgaatatagatt

SEQ ID NO: 10546 - DNA, 211 bp, Diabrotica virgifera
aatctagacaccattgtcgcctcggtgaaaactgaggagttgacgtggatttaaaacagaagcattatgcgtgagtaaggagcagccaaccgtagtacatcgaacagtggatgtgagctatgtatgacaaatataaactaaatgatgataaatatggagacaatcgaggaggctgaaagagatcaaatgaaataggtctcgcgcgtgagtt

SEQ ID NO: 10547 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (138)..(138): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttnaaccggtgtgagccaggttggttnnnnnnnnnnnnnnnnnnnnnnnnnnnnnnnngaaagg

SEQ ID NO: 10548 - DNA, 58 bp, Diabrotica virgifera
  misc_feature (2)..(3): n is a, c, g, or t
  misc_feature (8)..(54): n is a, c, g, or t
anntaagnnnnnnnnnnnnnnnnnnnnnnnnnnnnnnnnnnnnnnnnnnnnnnnggtg

SEQ ID NO: 10549 - DNA, 979 bp, Diabrotica virgifera
  misc_feature (599)..(616): n is a, c, g, or t
  misc_feature (873)..(873): n is a, c, g, or t
  misc_feature (937)..(937): n is a, c, g, or t
  misc_feature (966)..(966): n is a, c, g, or t
acgacgtagtttatggatgcccccttttatgcttaacatcacttttctctgacacaacagctgatttggaacttccttcacaaatttacttggttgcctatacattccatgcagaaatattaattaaactttaaagtttaccaagctgatgttgggtttaagatagagcaacaatatcaaaactgagctactagcttctctactattgttattcgcttaactgtgattttgttgatttaaaataatgtattaaactgcaacttttcaatatatgacatattacctaatacaatttttgcatagatattgatgtgattttgtaaacattgtgatatttattgtttttcaattacagtagtcaccttctcctaattattcacagctactgcatactgcttactgtatacaatgtttcacttattatgtgtattccgtcaaaagtaggtcgttttagcaatgacacaaaatgtactagtctgtagattcagttttattactttattatgcttattattaattggagattgaagtgattgacctacgttataggttgtatggtaaattaaaatacctttactttttagtggtcatgtttaatnnnnnnnnnnnnnnnnnnggatcataaaactatcaactagattaatttagttgtaagtgataggtatataaaacacatgaaacaaaataaatgagagcagtcagttacaaaaaatacaacaaaaaattaggtcactttgttttctagtaaaaaagactaaaaataattatcttattaaaccaataaatcggtcaatctaagttaaaacattaaaagaagagatcactcttcttagaaggaacagtagtcgtagaaaaatgtcctcgtagaagttnggcagaaagtaagaaattaaatggtgaaatatacagtcatcacctactatttgaatcatctcanaactatagtcacattctttaagcagcggntctcaaacttttt

SEQ ID NO: 10550 - DNA, 871 bp, Diabrotica virgifera
  misc_feature (591)..(606): n is a, c, g, or t
  misc_feature (846)..(846): n is a, c, g, or t
gagaatcattctggacctggttcaaatagtgtgctgtgatttcattttagcttctaatagcaagctgaagaagtcgtagtggtatagacctagcattcgtaggttagctcagttataattttaactctagtgaattagactatacaaaatcatgaagcttcttggaaaagtcctggtaattttattgatagggtacagtaagatggagaatattgattctaataaatttgatccacagaatatcgattttgacagatttgacaggcataaatttgatattgacagatttgacatgccgaatattgattttgaggaaatacataaaagaatcaatgatatacaagagaacaaactaaacataccggaatttaattttaagccatatgatattaatcaatataagccaataagtttagatggtagcaatttttgggaggacgtaccgaaagatccgaatgcatatttggaataccttcaagaggaatgtagcaatgctggacatcctgatatattaaatatgaatagtgaaatataccgtcaagctaaaatctgcctcggtagcagagcattatctagaaacgatcgcgaaannnnnnnnnnnnnnnngactcattgctatcagccaaattgatgttaaagaattctgtaaggtgtggcccgaagttcataactgcattaacccccttgtgagttcaatgaaggaatgtttgaacagtgatctaaaagagattgttgatggtttacttaaattcatcgacgagtccaagagtttcttctgcgttgaggaccgtatatcgacattagtcatcaatgggtctgtacaacaatgtttcagcttagtcagcnaagatcttaacgaatgccaaaataa

SEQ ID NO: 10551 - DNA, 831 bp, Diabrotica virgifera
cctagtgaaagaagctcaatgcttttgtttatttgattctttatcttatcatttatcattgtttttttattttataacaagtaaagagggaacgggaatttgttcttttttgaggttattttacagtattttatttcaagataaagattactgaaagatataaaatcatgtttattgggaatgaagtaaaacaagaagatgctgaactgacttgcaaaagggaaatagctaatgaagtagatgaaattacagaggattctttgaagattgaaattaaagaggaagctgtctgggaagatacaactgacacatttgattatttagatgttaagaaatgttctataaaagctgaaatagaaccagatgatggtttcccttgtaaagatgtgaaaactgatgccagtagcctattaacaaatcatgatagaagtggcggtaatttcaatcaacatatgacttccaccaccaaagtgaagactgaagagcaacattttatatgtatcatttgcaagaaatcattgtcaaacaatgatcgtttagaacatatgtgtatacagactgaggaaaaatcctttgcatgtgagatttgcaccaaacaattttcaacaaagaactatttaaaaaggcatatgaaagcacatactgatgaaaaaccgtttgaatgtgaaatttgcaccaaacagttttcattaaaggcttatttaagaaaacacatgaaattgcattctgatgaaaaatcatttaaatgtgaaatttgcaccaaacagtttccaaagaaacggtacttagaaacacacataagaatgcatagtggtaaaaaatcatttgaat

SEQ ID NO: 10552 - DNA, 684 bp, Diabrotica virgifera
  misc_feature (5)..(27): n is a, c, g, or t
ccttnnnnnnnnnnnnnnnnnnnnnnnaaaaggatgattaacttcttaatgattacttggtataaatattgcagaattgatatatcgtttctagagtggtccaaggtgtcgaagagtacattaaaaaatgagtgcaatgaaatttgtagttttagcattttgtttggcctttatggctctaactgcagtagaggggcagcaaaccaattggctcaaacacgacctttatgactgcgtcaggtgcttgtgtcatgctagaagtggatgctggatcagacaaaattgtgccaggtactcaatttcagaggattactggaagaaaggaggttccctcactgtgtctccaaatgaaaaatcaacagatccatcagcgtatagcaattgtatgaaggatgaaaactgtattgtcggtactatcattcagtatacaggtcgcttcggagaagatatggattgcaactgcgatggagttttcgattgcaaagatagagcagccattcatcttatgggagccagttgcgaaaatcctaaatttggtggtacttttgcccggcgattcaacgaatgttcaaacatggttggtactaagaacatgttgtcccaagaaggaaatgataagtgtacagtacctacagtattctaaaagtgtaatataatgtttgagtaaatatatgatttatttat

SEQ ID NO: 10553 - DNA, 315 bp, Diabrotica virgifera
  misc_feature (13)..(47): n is a, c, g, or t
  misc_feature (66)..(88): n is a, c, g, or t
  misc_feature (126)..(146): n is a, c, g, or t
ggtatcagggatnnnnnnnnnnnnnnnnnnnnnnnnnnnnnnnnnnntataaagaagaactaatgnnnnnnnnnnnnnnnnnnnnnnnactattagaattacatctttttattgcaatgtgtatgnnnnnnnnnnnnnnnnnnnnncctcgtatcataaaaatgagagtcatttattatgtattaactttatattaatcattttcatattattagagtagtatgtcctgactgacgtcactgaatgatcaattcccattaaactttatttatgaattatatattaagaataaaagagcgcttattaccctacata

SEQ ID NO: 10554 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10555 - DNA, 808 bp, Diabrotica virgifera
  misc_feature (2)..(41): n is a, c, g, or t
  misc_feature (61)..(190): n is a, c, g, or t
  misc_feature (192)..(205): n is a, c, g, or t
  misc_feature (207)..(594): n is a, c, g, or t
  misc_feature (596)..(613): n is a, c, g, or t
  misc_feature (615)..(671): n is a, c, g, or t
  misc_feature (673)..(759): n is a, c, g, or t
  misc_feature (775)..(797): n is a, c, g, or t
cnnnnnnnnnnnnnnnnnnnnnnnnnnnnnnnnnnnnnnnntatattttgaaccttgtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnannnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaaaacccccatannnnnnnnnnnnnnnnnnnnnnnggttttttaag

SEQ ID NO: 10556 - DNA, 943 bp, Diabrotica virgifera
  misc_feature (883)..(883): n is a, c, g, or t
  misc_feature (918)..(918): n is a, c, g, or t
gccgagagcacaagattctttcgcccaacccacttcagacaagataccaaatgccaaaaccaacctaataactcaggagacttgtaaagaaaatctagaaaattctccggaaccaatggtggatgtgaaagttgaacagaaaatggcagtaccatctatagatcgagagctttcagaatgtgtaatggaaagtatgtatataataatgagtcgagtatcctcttttaaaacaaagttatttgttgaaaaagttactaaagagcggactcggcagataatggcggactatatcaacgaaatagtagcacaaaaaatattgtttgagaaacctggttggaaaccgacttctgccaattgtaccagaaaatcacttcagtggagatgtgcacaagaaattatccaacaattggtttacaacactacgattgtaagagtacaactttttagattcataggtgtagataaatttgtgagattaatgaaacaagagattgataaatatctaaaaattccaaatatacatgaatggatattccctgttgatgataagccacgagagattaagattaatttgaatattaaacacaaaagaccaaattattctaaaaaatatgattcgttatttggtccagatattaaagactattgtcatctgattttaacacctgaagagatcaatagtttagatacgactccactacaaagtgcaaatatttcgacatccttcaaacctacagatacagatagagagaatacatctccttcaaatcctgaaaagttgagtacagataccgaatgcattccaagcagtagttctttaagccctgtccaaggtaatcaaacaaagtctaaggatctggttaacaataagtctgatgcattngaggaaaacacaggacttgcgaaacagtcatatgntaaatcagtggttatcaagattcca

SEQ ID NO: 10557 - DNA, 984 bp, Diabrotica virgifera
gctatggagacctggacaaagaagtaagaaatcaactacagaaagcgaatagactggcaggatgccttaataacactatatgacgaaaccgacatattaacaccgagatgaagtcaagaatttcaataataattatatatgcatcagaaacaaaacccgatacagtcacaacacaaagattactggaaacggcagagatgagagtactgagaaaaattacaggaaatttgctgagagatggaaaggggagtgaagacattagaaaaaaatgtaacgtagtgtataaacgaatggacactaaatagaagaacagaagagagatccgtgtggtaaaatattaggtcctgtcgccaggggggtgcagcggcctccttggttcagatggacttactcaggtttttttatgtatttttacccgtagaacacgaattttttgagtaagagtttgaggaaacgcggttgaactttcaaaaaatcgaaaaggtgcaatttttgaaccagaatagcttttgattgataaataaaatagcaattctgcttactgcgtttgaaagttcaagtcagattctatcggttttgattatttgcattgttaaaaattaagtttttatttgttaaacaaagccataaacagatagtgtttcccgtgcccaatgcatgcgttttaatgtacgtaatctacgaagaaaattgtgtgtatgcgcgcctacttcgttcgatttcaaatgagaattgcatttgaaaacatcattcaatcactatgtattcatagctttggttaacaataaaaaacaattctttttttggcaatgaaagttatcaaaaacctatagaatttgatttgggacttttcaagtgcgggaagaagaaattgctgggtttatttttcaattaagagtttgtttcgggttccggaaaatggaattttcttaattttttgctaaggaaaacaagcccttttttcttttgattgtgccccccatc

SEQ ID NO: 10558 - DNA, 204 bp, Diabrotica virgifera
  misc_feature (8)..(45): n is a, c, g, or t
  misc_feature (97)..(114): n is a, c, g, or t
  misc_feature (170)..(198): n is a, c, g, or t
taacagcnnnnnnnnnnnnnnnnnnnnnnnnnnnnnnnnnnnnnntgcgacctcaatgttgaataaagtttataattggtgaaacagctatattatnnnnnnnnnnnnnnnnnnaaaattttacatgaatttgagtttaaaccggtggggagccaggttgggttcaatcnnnnnnnnnnnnnnnnnnnnnnnnnnnnnaaggcc

SEQ ID NO: 10559 - DNA, 911 bp, Diabrotica virgifera
  misc_feature (408)..(425): n is a, c, g, or t
  misc_feature (509)..(537): n is a, c, g, or t
  misc_feature (542)..(859): n is a, c, g, or t
  misc_feature (870)..(909): n is a, c, g, or t
atgaatattacttttatttatggtatatactttatatataaataatactagatgcaaaagtttacatctttccatataatatatatgttaatgaatccttttacaagtatagccttaaaaatcagtcatgattgaagaagaactggatgccttatcagacttggcttcaattcatgcagatcctccggtaatgagagatatatgctctaagtgccatcgtccttccacagtttgctattggaaatggataccagttccacctatgtgcccaaaaagtagtattatactgttacaacatccagcagaagaaaagaggagccttagaactgccactatgttacaattatgattaaattcttcaaaaagacttgtatattaagggaaacgctttccgggaaagtatagaannnnnnnnnnnnnnnnnnctgcatgatataatctattgttatatactatcattactattgtttatatattatatatgataatatgaatttacactatttatnnnnnnnnnnnnnnnnnnnnnnnnnnnnngaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttagnnnnnnnnnnnnnnnnnnnnnnnnnnnnnnnnnnnnnnnngg

SEQ ID NO: 10560 - DNA, 702 bp, Diabrotica virgifera
  misc_feature (55)..(75): n is a, c, g, or t
  misc_feature (590)..(614): n is a, c, g, or t
gccaagtttaggatttaggttagactaaaaaaagtgtaccgtgtacctatttggnnnnnnnnnnnnnnnnnnnnntgctataaacaatattaataaatagtgttaataattgcacaacaatggacgaggaagaatatttgacaaggcaagcacatttggaaaaaaacataagagaattacgacttaaacagaaagaaatagcacaccagattgcaatattaacagctgagaaagaagagctgcagaaagaacattatgtatctaaaataaaaacacaagctaatagtagcaaatggatagaaaaagaatttccatggaccagacaagtaaaagaaatcttaaaaaatactttcaaatttgataattttcggttaaaacaattagcagctataaatgctactttatcaaaaaaagatgttctgctcctgatgccaacaggtggaggaaagagcttagtttaccacttaccagctcttgtaaataataatgttacattggttgtttctccacttatatctttaattgaagatcaattaatggcattgcaacagttaggaataaatgcaaatactctaaattctgggtcttcnnnnnnnnnnnnnnnnnnnnnnnnnactgatatggactcatacaatccaaaactaagactttttgtatgtaactccaaaatgggtactaaaagcaaaacgttcatgacccatt

SEQ ID NO: 10561 - DNA, 978 bp, Diabrotica virgifera
  misc_feature (423)..(444): n is a, c, g, or t
  misc_feature (579)..(596): n is a, c, g, or t
  misc_feature (850)..(850): n is a, c, g, or t
  misc_feature (871)..(871): n is a, c, g, or t
  misc_feature (937)..(937): n is a, c, g, or t
gtatttagacagatgagttgttattgtcattatattgttacttctttccttaggcaaaagttgttgtttagattcaggtatatttcctagataatcctacatatgtgagaacatatcataaatctacagttttatttaaaattgtttgcttgttctcgacatttttctgttacccagatagtggtatcacagaacagaatattagttcaccactttatttttacttattattgtgtctggttattggcatacatctgctgtagcaacatgctataactagcgaataccagcacgaatcaattttatttagtcaccgaattcctttagttgatatactttaggtatttatcttattatcggtttaattgattacatctcttggttagtatggataagtgtgacatacattacctcacactttgnnnnnnnnnnnnnnnnnnnnnnagatttggttcatggatgctatggtaactcgatataaggatggaatcgatctatggctgtccttttgttcgaaaccataaattctatatctatatccaatagattagtttggtataaggtttaggtagacctaannnnnnnnnnnnnnnnnntgttaatgagaattggtccataaatcttcctgatcgttcttctctggatatgcttttatgaatctggtgtccattgttagtccgattttggatagcgtccgattgctcttattttgtgttaattatttccttgttatattagtattatttggtattagtgagaattgttccaaaaatcttcctggttgctcttctctggatatgctgttataaatctggtgtccattgtgagttcaattttggattaagtgttncattcttcatttcctttagtncatcattactatgattttattttagtatagctactagttccttattgtgcgaattggatcacattnttgcctgggttgtcgtccttggatatgcatcataaatttga

SEQ ID NO: 10562 - DNA, 604 bp, Diabrotica virgifera
  misc_feature (2)..(34): n is a, c, g, or t
  misc_feature (479)..(491): n is a, c, g, or t
  misc_feature (493)..(505): n is a, c, g, or t
cnnnnnnnnnnnnnnnnnnnnnnnnnnnnnnnnncatcactattcaatttttaattctttagcaagagtagttgcacaaacatgcatcatattatgtctattagatttaaaattttcaatagctctatttcgactaacctcccattggaataattctctatataaaggttttacaatgttggttgagaggaaaattattagtagattggtatcaccacaaatgcaagactttgacgcctacacgggcataagtgatttaaaagaagctatagaagtgttgggcgctgatagtcctttaactaatcttatagtagatttaaaaggagtccatccagatgaagcattttcaacagtcccatatgaaaagggtcacacattccttaggtatttagaaaaaactgttggtggtccagataaggtcgagccgtttttaagatcctactttgataccttcaaatacaaaataaattgacaccacnnnnnnnnnnnnncnnnnnnnnnnnnnccttttgaaaagtggacccgaaaataaaaaatatccgattggggacaaaatggttgcattaccccgaagaaatgaccttaacccttcccggattacgat

SEQ ID NO: 10563 - DNA, 395 bp, Diabrotica virgifera
  misc_feature (27)..(47): n is a, c, g, or t
  misc_feature (285)..(302): n is a, c, g, or t
  misc_feature (305)..(333): n is a, c, g, or t
  misc_feature (361)..(379): n is a, c, g, or t
ctatttttacggatgagacttaaatcnnnnnnnnnnnnnnnnnnnnntatttaaaatccccatatcgattgaaacgttaccatttcttacatatatgattatgtgtattttgtatcaacttttcagttatcctatagattccacattatttagattgagatctgatgagggtattaccatcacaagactatatatctacgaaaatatgtagcttctagagacgaactcgccaacattcttctcccctgtttattagtaacatgtcctgtttgtattctagatacnnnnnnnnnnnnnnnnnnccnnnnnnnnnnnnnnnnnnnnnnnnnnnnnagctaagatagcatcttcccttatttcnnnnnnnnnnnnnnnnnnntagggtggatgaaaaa

SEQ ID NO: 10564 - DNA, 665 bp, Diabrotica virgifera
  misc_feature (579)..(635): n is a, c, g, or t
gtaagtataaaatctatattgtaattatgaaatatacaatattcttcaaagtttttaacaactttataatacatttgatatctacaaactactaaaattaaatttaacctagatcagacggcttcacttctttagtggtagcattcttctgtgttgtttcttgcagcaagtttttgctaaaccattgcggccttggtttattcatttctactatcctttttccctcaaagaattccgctggtttgtcatttttttcgccttcatataaaacaacaatctctttttccacaggttccaattttaattcgttttgaatctgctcttgcattgcctttgtttcatcaataactttcttgtagcgtggcggagcacctcacaagcgcctttccaccaacaaacacgacgtctccgtagtcacactacctcaagcgccttttaccatatacttatatatttcacaatttctacgattattaacctgcaagattgttgctaatattattattactcattgtaatattaagagaacatatatagaattaatatatgaattcgaaaacatttttttctcctgtttcnnnnnnnnnnnnnnnnnnnnnnnnnnnnnnnnnnnnnnnnnnnnnnnnnnnnnnnnntgaattggacgtgatattctgaccgtgcta

SEQ ID NO: 10565 - DNA, 930 bp, Diabrotica virgifera
  misc_feature (6)..(925): n is a, c, g, or t
cgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtg

SEQ ID NO: 10566 - DNA, 900 bp, Diabrotica virgifera
  misc_feature (96)..(119): n is a, c, g, or t
  misc_feature (366)..(383): n is a, c, g, or t
  misc_feature (554)..(575): n is a, c, g, or t
  misc_feature (718)..(735): n is a, c, g, or t
  misc_feature (796)..(815): n is a, c, g, or t
  misc_feature (858)..(875): n is a, c, g, or t
gacccacgcgtccgcgttaagatattttgttttttgcatgaaaacgaagcgtcgtatgaacaaacggtaagatagattgttagaaattgaacaggnnnnnnnnnnnnnnnnnnnnnnnngaaatgtctcagtggcgtactattgtttttttctttaaaaaatttcagaccattaccggtacgcgcgccaatggtgaatgtagggttctcgattgtgtgtcaaaaaatgcgcaataactatgtcttaggaaccaccaaatttcatttgcacacctcaaccggttttggagcaatcaatgaatcgtcagtttgtaggaaaaataacaccccgtatctcggaaacaaatgaagatcgaataacaacagnnnnnnnnnnnnnnnnnngcgtgtattatacagtctgaaagtttggtgcgtttctccccgctcaccctggatactgggatgcttatctgtggatatggaagttattttatggtattggtggctcaccctggatggtcttttgaagatattggttaccatatgataatttccggacctaatttaattggnnnnnnnnnnnnnnnnnnnnnncatcataaccaagtagagttaagtgatttatagttatttcatatatgtttaatttttatgataatttctcatctgttagattttaaaacgaaaatcgacttgaataactcattcgcaaaaagtagaaaaacgtaattttctcnnnnnnnnnnnnnnnnnntacagttatccgatccccttttttaaagaaaatagcgtttaaaaatggacattctaaaaannnnnnnnnnnnnnnnnnnngagaaaattactaaggttgaagttcatttctatgaagtgtccnnnnnnnnnnnnnnnnnnttagtataggagtgatagtaactat

SEQ ID NO: 10567 - DNA, 360 bp, Diabrotica virgifera
aaaattcaattactatatccaattacaaaaaaaattctatatctaccgactcagaattttaacgcttggtatccacgctcattgtaatgtaatcattgtaatatacagtgtgacctcgataagtcggattaatcgggaccgtggcctatacgggttatcgaaaatccgggttagccgaagactatggtaaaaattaataaaatagagtaatacttacagataaactccattataattgcaaaaacatgaaatacataatattatacatagaaatgaatagaaatgcatagtacatctgaattacagtaggaaaaatgaaagaatactcatgaacgaacatataaaacacgctgtattttc

SEQ ID NO: 10568 - DNA, 568 bp, Diabrotica virgifera
  misc_feature (234)..(261): n is a, c, g, or t
ggaattcggaaacatttttttctcctgactctttcaatcaaaactgttgggactcaaaaggattcgtaaaggtggctatctatcccggtatgtttctgaagaattaccagatcggctcataaaagaaacaacacgtatagggcatttggtgatagaaaaaaatgtaaacatcgttttctcctcttttatatttgatggttagacgtgtgactgaaatcagaaacattccaggannnnnnnnnnnnnnnnnnnnnnnnnnnncgaacaatgaatgtcaacatggtatgaccaatatggactaaatgattcaaaatacccacgctatcaaggtgactcaaggagatcaagggagagaaatccggctcgagagaagagtaggatctaataagaggatagaagtttaaaaaaagaatggccgcggaatccttttctatgcggtaattatgataatggattcttagattaaaaaaatggcactctcctcgtctcagatgatcgtatagggccgacgtcattttgatcaggctaaggaagggtaatgatgataacgtttgacagactgctgcag

SEQ ID NO: 10569 - DNA, 94 bp, Diabrotica virgifera
  misc_feature (21)..(88): n is a, c, g, or t
ggaatgaaggggttggatgannnnnnnnnnnnnnnnnnnnnnnnnnnnnnnnnnnnnnnnnnnnnnnnnnnnnnnnnnnnnnnnnnnngacgag

SEQ ID NO: 10570 - DNA, 602 bp, Diabrotica virgifera
ctcttgcctaacaatatgagaaattaatcctagtccggataagattaaaatatatacttatcgatgaccatgaaatccaactagatgcccatacaaaattctttaccctccagccaaatgtcctcacaaaatgatgaatgtcatgatacgattcggatccgacaataaatctgtcttccaatcacaggacctaaaatgttttatccaacatatatatatcatcaaatacttctatatctcctatattaaatatctcgactgcaagttgtaaagcaaattgtgggataagttcttggatgtgatggaaaccctcatgactccactgcccctattgtatgccatgtaattgcacaatgccgtatacgaaatgtgtaccgatgatagaaactatcatctagatcttgtgctcattgtccatctacggaatccgtgccgtcactctaattattgaacaattgtatattaaacctttatatataggttgaaaggagatactccacgacatttcttacagctgtgtgtttctttagtgcctgctatcatatactataaacgatgcgtctgtgaactgctagacctcaacgaccgcgaaattttgatcg

SEQ ID NO: 10571 - DNA, 919 bp, Diabrotica virgifera
  misc_feature (342)..(361): n is a, c, g, or t
  misc_feature (391)..(433): n is a, c, g, or t
  misc_feature (435)..(584): n is a, c, g, or t
  misc_feature (586)..(715): n is a, c, g, or t
  misc_feature (717)..(747): n is a, c, g, or t
  misc_feature (749)..(805): n is a, c, g, or t
  misc_feature (827)..(917): n is a, c, g, or t
caactttggaaaattgtgataaacaatttgcgaagtgtaactttaattactacacagttgattttatttcgacgattacagtaaataccgcgatgtgctaaacatacgagatgtcaatgcctacgcatttggtcaatacaaataaaccaccgaaaaatctaaattagaatggccgagggtcacagcagtgacgattctgatctggaaaacctaaatgagtttgctggggtgttgagtaaatggacgaattatatacatggctaggcaagacagatacttcgtattataaaacggattattatcttatcactatagtgatcaggaatgatattatagaatgtnnnnnnnnnnnnnnnnnnnnggaggaggttataaagaaacttttattagnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnngnnnnnnnnnnnnnnnnnnnnnnnnnnnnnnnnnnnnnnnnnnnnnnnnnnnnnnnnngaaaaaagcttagattttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 10572 - DNA, 478 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcttcc

SEQ ID NO: 10573 - DNA, 433 bp, Diabrotica virgifera
  misc_feature (86)..(99): n is a, c, g, or t
  misc_feature (101)..(113): n is a, c, g, or t
attttatggagaataactttttttcgttgcctttataataggatagatatcaataggttccaagttgataagacatactgtattgnnnnnnnnnnnnnngnnnnnnnnnnnnngaagcacctggtcggacagggcatcttgagcgagagattatatccacattattttcgaattaacaatagatgaagaattatagacgatattgaaaaagaaccataccacatgcataattggcatcgtaacgttatagagtctttctactgtatgagattattgtatgaattaacttatcctaattgatcaacattgaaatcattactctatatgatgatattgtcgacatgagctatgtctccggaggaggataagtataattgaatgctgatttgatcttgtatataataaatactgtataaaatgttcacagggtatg

SEQ ID NO: 10574 - DNA, 198 bp, Diabrotica virgifera
  misc_feature (7)..(44): n is a, c, g, or t
  misc_feature (79)..(101): n is a, c, g, or t
  misc_feature (109)..(131): n is a, c, g, or t
  misc_feature (154)..(154): n is a, c, g, or t
  misc_feature (164)..(190): n is a, c, g, or t
taacagnnnnnnnnnnnnnnnnnnnnnnnnnnnnnnnnnnnnnntgcgacctcgatggtggattaagtttataattggnnnnnnnnnnnnnnnnnnnnnnntggtcgannnnnnnnnnnnnnnnnnnnnnnagtttaaccggtgtgagccaggntggtttctannnnnnnnnnnnnnnnnnnnnnnnnnngaaaggta

SEQ ID NO: 10575 - DNA, 1038 bp, Diabrotica virgifera
  misc_feature (826)..(845): n is a, c, g, or t
  misc_feature (949)..(968): n is a, c, g, or t
aaacaatggttaaatgctataaaacgtaaaggttttattagcgaaatgaaaattaagaatgattttgtgtaggtactctaatcattttatatctgtatctttaaaaactacacaaaatcaacaacaatgttgggaaaatacacctaaaaactatagaggcacattgtggtacaaatataaacaaatacaatgcttgtctcccagcaatcatattggagtcataaatgtcaaagtcttggaatgcccattgtcattttacccgttgacattgtgaaagtactgtcaggataaattacttttgtatcaaattatctttatccgcatcattgattggttatctatttacactaatgtaatcgtcaaccaattgtacatctatagtataaatcgctgtaatatacaaatacctgtcaacgaatacataattttcgaagttctatgtataataattatggacatacgtctttttctgtcactttgaacttaatcccttggagagaatttgacaaactatgaaacactgaaaaaagggttcggtatgaacttatagactatattgtattgttgatctcattctttaattgaatgagcaaggttgtgaagatgaatgtattgaataaattttcgtttgtcagaactttcagttggtagggctcgtatttatttaactagataaacaacatacttaggatattcaattcaaataatggaaacggcttctcttaatttacaaatcgatatttcttatttattttttctttcaattattttgttcggttcacatagaaacagttttatgttttacacagttcttttctgactctgnnnnnnnnnnnnnnnnnnnncaatcgtttcagtttattttgtttttcaccgccattcgtgcgtttttgctacttaggaatttttagtaaagaaatggtatgtcggaacagtcaaaaatatatgnnnnnnnnnnnnnnnnnnnngtatttatgaaacgtgattataaggatcgagattaattctttaaaaatggttttaagttttttattttat

SEQ ID NO: 10576 - DNA, 111 bp, Diabrotica virgifera
gttgaaatcatttgaagtcccgaaatgacgattatagccatcgaaagaagatgcttatgtactaaaaataaagagcattagccgcaggacttacgaacaactttatttttt

SEQ ID NO: 10577 - DNA, 596 bp, Diabrotica virgifera
caccttgtgaagcagggcataattgttgcaggaaatgtatttattatttcttcatatgaggtgctattgaacatatcatattaacggtaaactgctaataatggacagtactcatgtgatgaaccgactcacatccatagacagaggatagatttatagatatacgataacttttgtattaaacacaactaccctttcactcttagtattattctataaacacatatactatagtgtcttgaacccactgatttactattgttaatatatcaatagaaaccactaatctagatttagtaaacatcaagtttggaatctgtaaaattagtcatagaacgttatcgtacagtatccactcctattatcaatgagtataaataaagcttactagttatgccacttgtggattgataagagacagtgttgttatgaatgagtgtagagaggagtttgaatattttacaacgtgtttgctaaaagctgcttaccatgctaatgactagaatttaactagcataatggtgccggtgtgagagcacatatctgaccattgcttatatacaaggtctcttaatatcttataattcctagaatag

SEQ ID NO: 10578 - DNA, 751 bp, Diabrotica virgifera
  misc_feature (5)..(552): n is a, c, g, or t
  misc_feature (559)..(596): n is a, c, g, or t
  misc_feature (616)..(629): n is a, c, g, or t
  misc_feature (632)..(654): n is a, c, g, or t
  misc_feature (662)..(684): n is a, c, g, or t
  misc_feature (718)..(745): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctannnnnnnnnnnnnnnnnnnnnnnnnnnngaaagc

SEQ ID NO: 10579 - DNA, 882 bp, Diabrotica virgifera
gcgctccgggagaattcaaacaagtgatgtaactgatacacgtggcaatgaatttgaagaattttgtttaaaaagagaactacttatgggaattttcgaaaaaggctgggagaaaccatcccctatacaggaagcctctatccctatagcactgtctggaaaagatgtacttgctagagcaaaaaatggaacaggtaagactggtgcttacagtattcctgtgttagagcaaatcgaccctaaaaaagactgtattcaagcactaattatagtaccaacgagagaattagcattacaaacttcacaaatatgcatagaactagccaaatacctagaggtacgtgttatggtgacaacaggtggaacaaacttacgagatgacattatgcgtatataccaaaaagtgcaagttatcatagcaactccagggcgtatacttgacttaatggaaaaaggagtagcagttatggaccaatgtaaaattcttgtattagatgaagctgacaaattactgtctcaagattttaagggaatgcttgacactgtgattaaaaatttaccacaagagaggcaaattttactattttctgcaactttccctttgacagttgaacaatttatgagaaagcatttacgagatccgtacgagataaatctcatggaagaacttacattaaaaggtgttacacagtattatgcatttgtccaggaaagacagaaagtgcactgtttaaatactctattttccaagttacaaattaatcaaagtattattttttgcaattctacacaacgagtagaattgctggcgaagaaataacagaactgggttactcatgttattatatccatgcaaaaatggcacaagcacacagaaacagg

SEQ ID NO: 10580 - DNA, 943 bp, Diabrotica virgifera
  misc_feature (625)..(625): n is a, c, g, or t
  misc_feature (696)..(696): n is a, c, g, or t
  misc_feature (741)..(741): n is a, c, g, or t
  misc_feature (832)..(832): n is a, c, g, or t
agtacctacaatagaaagcagggaagtccagagaataaataacttgataatatctaaatccttaaggaactaaggttatcatcattgttggttgtaaatactgaatcatcttcaaagcaaattatggttttctccttgctgtactacaatcgtcgatttttctttattattccgtatacgataatactgaaaagtaaaattgacgatcccatttttcctctttggacgacatttttcacacgcattcaatcgacaaagaagaacctatgcggctgtttccctaaaactttgctcgaaaagctttttccagaaacagtcaacttaccatgtgatatttgtaatagccatggcttcattcatttcgaagaagatattgctaatttaagaaccaatcttacattcatggtaaaagaagaattaaaacgaaatttggaaatcaagctaaatacaacaaaaaatgacaaaatatcagcttgtgttccatctctaactggtcataacatcgaaggtaacatcgaaaataacatcgaaagtaacatcgaaaggaacatcgaaagtaacctagaaagtaatatcgaaagtaacatcgaaagtaacatcgaaagtaactacgaaagtttcatcnaaagtaacatcgataatgaatttttccaatttttcaaagagtttgactatatttacaagttagagcctgtnaatgaacattcggtcgaatttcagagaatccaacagcgttcttgngcaacatataaatagaatacatagcattgagaagatacataatccatatttattgctgcaatatgatttttaagaagagggaatataatanaaggggaataatatatgaagagaaaaagttgtttcacggcacaaagaagtctaaaattgattgcatttgcaaaggaaatttaattggagattactggtacttcacaggaca

SEQ ID NO: 10581 - DNA, 962 bp, Diabrotica virgifera
  misc_feature (101)..(122): n is a, c, g, or t
  misc_feature (318)..(341): n is a, c, g, or t
  misc_feature (489)..(507): n is a, c, g, or t
  misc_feature (538)..(557): n is a, c, g, or t
  misc_feature (602)..(626): n is a, c, g, or t
  misc_feature (628)..(641): n is a, c, g, or t
  misc_feature (778)..(778): n is a, c, g, or t
  misc_feature (782)..(805): n is a, c, g, or t
  misc_feature (888)..(888): n is a, c, g, or t
  misc_feature (895)..(895): n is a, c, g, or t
ggaagatttatttgaaaatttatgtcaaaacagtaaatttttaaatgaggattatagaaaaaatttgcgttgagatacagaatccgatatttttagaccannnnnnnnnnnnnnnnnnnnnngtaaacgtaaaactaaattggcatataaatcaactttaataacaatatggaaacaaaacaagaagctagtgggaaaacttgtaaaatagaaacagatattgagacatatgatggttccctggatgtcttcaaaattgaaattacggaagaacccaagagagagtgtgcatatgacgcatttgattatgtagacttnnnnnnnnnnnnnnnnnnnnnnnntgaagtagaagatgaatataaattgacattatttgaagaaaggaaaaagagtgaagaaggttgttcccaggaggagaatagaatgcaaataatggaaacgttacattcatcggataaagggaaatatacaggtcaacaagtcgaaggnnnnnnnnnnnnnnnnnnngtagttgcgactgtacaaagacgttacaacnnnnnnnnnnnnnnnnnnnnatttactcacataagtactttgaaaaatcatttaaggacgcacannnnnnnnnnnnnnnnnnnnnnnnngnnnnnnnnnnnnnnatttagtcaagcaggtactttgaaaaaacatttaagagtgcacactggggaaaaatcttacatgtgtgaaatatgtttaaagcagtttattcaagcaggtgatttgaaaaaacatttgagagtgcacactggagaanaacnnnnnnnnnnnnnnnnnnnnnnnnagcaatttagtcaagggcatttgaaaacacatttaagagtgcacactggggaaaaaccttacaagtgtgacatttgttttaangcatttnactcaaaaagtacttttgaaaatcatttaaggatgcacactggttgaaaaccatacaaatgtgaaac

SEQ ID NO: 10582 - DNA, 1259 bp, Diabrotica virgifera
  misc_feature (8)..(826): n is a, c, g, or t
  misc_feature (828)..(829): n is a, c, g, or t
  misc_feature (841)..(841): n is a, c, g, or t
  misc_feature (846)..(912): n is a, c, g, or t
  misc_feature (916)..(916): n is a, c, g, or t
  misc_feature (919)..(920): n is a, c, g, or t
  misc_feature (928)..(928): n is a, c, g, or t
  misc_feature (944)..(944): n is a, c, g, or t
  misc_feature (947)..(947): n is a, c, g, or t
  misc_feature (969)..(969): n is a, c, g, or t
  misc_feature (1099)..(1145): n is a, c, g, or t
  misc_feature (1156)..(1223): n is a, c, g, or t
  misc_feature (1230)..(1256): n is a, c, g, or t
agtattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanntaaattatttanttggnnnnnnnnnnnnnnnnnnnnnnnnnnnnnnnnnnnnnnnnnnnnnnnnnnnnnnnnnnnnnnnnnnnattnttnntgatatangaaataattaccttanggnatacagcgtatttttaattggnagagtcaatcgattataaaatggcggacctccaggttgggataaatttttaaatgggtgtacagtatattttatttaagtctgttcacttttaaaatttaaatgactgaggtaaaacggggggggcggcnnnnnnnnnnnnnnnnnnnnnnnnnnnnnnnnnnnnnnnnnnnnnnnaaaaggggccnnnnnnnnnnnnnnnnnnnnnnnnnnnnnnnnnnnnnnnnnnnnnnnnnnnnnnnnnnnnnnnnnnnncggcccnnnnnnnnnnnnnnnnnnnnnnnnnnngga

SEQ ID NO: 10583 - DNA, 198 bp, Diabrotica virgifera
  misc_feature (7)..(30): n is a, c, g, or t
  misc_feature (107)..(128): n is a, c, g, or t
  misc_feature (164)..(185): n is a, c, g, or t
taacagnnnnnnnnnnnnnnnnnnnnnnnntcgataataagattgcgaccctcgatgtggattaagtttataattgggtagcagctatataattaagtctgttcgannnnnnnnnnnnnnnnnnnnnnagttaaaccggtggaggccaggttgggtttctatcnnnnnnnnnnnnnnnnnnnnnnagtacaaagggac

SEQ ID NO: 10584 - DNA, 494 bp, Diabrotica virgifera
  misc_feature (2)..(26): n is a, c, g, or t
gnnnnnnnnnnnnnnnnnnnnnnnnngtaaaaaaatgaaactaactaaaatttttattggattatagatattctgagtgattatgtaagaaggaattgacgaacaaggatggcgcagagtgcagcgatagaatcatggaatgtagcgggaagcatgtcttgcgttcttgtggtccttcttgagaaaaagagaagtgaggccagaatccgacagattacgcgactgacttaccagaaccctaaacactataactgataatatcgctacagctgaacgtacagaacaactaaagcatacgaagcggaatagttgacaactttgagcttactgtcgccgaacgcctgtagaatattgagaccggaaaagatgtgaatcgatatcgaagaaatcacgacaatgacccactcacaccatcgaaactcttccagtgaaatgataaaagcttccatttataatgatacttttctggcatatagcgacctctattttaagca

SEQ ID NO: 10585 - DNA, 520 bp, Diabrotica virgifera
  misc_feature (18)..(35): n is a, c, g, or t
  misc_feature (163)..(180): n is a, c, g, or t
  misc_feature (460)..(477): n is a, c, g, or t
cgttacagtgtttggcannnnnnnnnnnnnnnnnngagaacggacacgaacggacacgcagtgcatgagttgtatacatcagatgacaatattgggtactttagtaccggtgcaacaaatagatgctaatcctcgaactgctaattccccactattaagatannnnnnnnnnnnnnnnnnaaaacagctaatgcatgtaacgaactatgtcttacagaaaggacataacacatataaacggagatacctagggtgagacagtgtattctattgaaaaggttcctaggtgaagtattgctgatattgctaagcaaagatattatatgactacgctagggatgactgactattatgcgtcatttatgatgttttagatttattagaaaaagaattatgatgaaaacaattacatttaagacaatgaaataattaagtatgtaattgttatgtccactttggnnnnnnnnnnnnnnnnnncaactttttatattgaagaatctactgaatggacatatttgca

SEQ ID NO: 10586 - DNA, 1192 bp, Diabrotica virgifera
  misc_feature (767)..(767): n is a, c, g, or t
  misc_feature (832)..(832): n is a, c, g, or t
  misc_feature (836)..(837): n is a, c, g, or t
  misc_feature (931)..(953): n is a, c, g, or t
  misc_feature (1019)..(1043): n is a, c, g, or t
  misc_feature (1050)..(1071): n is a, c, g, or t
  misc_feature (1090)..(1106): n is a, c, g, or t
  misc_feature (1108)..(1121): n is a, c, g, or t
  misc_feature (1146)..(1176): n is a, c, g, or t
gatttcgttggtttcagtttcagttcataaaagagttaaagtgtaactgtatataaaatacatcattcttattttacattccatagttttatagaaatgtatgaacttattaatatgatcctattctctttcttttgtgttctttaaaatcaacggtaacttagtgattgtaaaactgaaattaaacacagtaaaagtaataattagtgggaagaaaaggcaaaaatagatcaattttgcttcaaattccagatgctttagtttctgttatattttagaggaatagtaccgtgtagctaaggaacataaaaacttaaggtaaagaatgtattatcaaaaaacccggctgcaaaagcctacactctttggcaatttattttgttagggcgcctgattttttagtctctagctactttatttcatctaggatttttcctttaacttctattgggttcaaccacttctctctatactcacgctattgtcttaatcttcctatactgaagatcttattaatatttatcttaattttagtaagtacgtcctttatttagcactaaattcttgcccacagttatgtttattccaatagcaaatgccgtttaccggaaaaagaatccaatagtcttaaatatcattaggaataggaaaacgttagcaaagagatgattactagtcactttcaactactttctataccttcatttcattaatatgaactaaaaatgccgaatacaaatatatttaatcagtcaatgtatactgtntttgtggctttgactttttaaatgttgttacaactatcatcccctctttggcctgtagcccgtcnaggnngtatcggcacgtccccaattaatgccaaaaaatcacagaccctccagggggaattttaaaggttggggcccaaaatttctttacccgggcgccnnnnnnnnnnnnnnnnnnnnnnngtcaaaattttattcccccccccaccaaaggccacaaaaaaggggctactggctccaatacccgannnnnnnnnnnnnnnnnnnnnnnnngtttttnnnnnnnnnnnnnnnnnnnnnnaaatggaaagttttttgcnnnnnnnnnnnnnnnnngnnnnnnnnnnnnnngggggccactttttgtaagggagcnnnnnnnnnnnnnnnnnnnnnnnnnnnnnnnatttttaagggggtat

SEQ ID NO: 10587 - DNA, 930 bp, Diabrotica virgifera
  misc_feature (720)..(720): n is a, c, g, or t
agttctttgtccacgctttataaaaaaggaagcacttctaaaatgggccagtggcagacttcccccgacttggtcttcgcattatacaaaaactttatctggtggtatagaagacttatggcgagacggatccttgctgtgtactttgattaacgcatctatcccaggagcatgtccaaatcctcatagacattggaagaaaccaccagtgcatgcacaagccatggcgtataagtattttggagtcataccgattttttcaaacgaagacttacagaaggctcttagttctcaactggaaagaaagtttatcaagtacctatccgaaattcaaatatcaatgaataaaatcgcagaaaataacgaaaaagagaaaaagattaccgaacgatacatagtaagaggaatgggagttttttccggagaacagtacaaaatggccgaattctacgtatatttagacgagaactgtgacgacgacaacgaaagcaacatcataatccaaataagaggtcctttcggatcattcggagaagctatttctccaaaactgatcaacagaaagcgcaaatttacaagaaaaattaaatcacggcgtaggtcttctattaaacttatcgaaaatctccaatctttccaatggaacttttcaagaagccaaaagaaagtacctagcgaagaaatagacgtcgaagctactttagaaaacgacaggattanagtttgctatattccgaagaactatggaatgtacgagatcaacatgattgctggtggtgaactaatcaaagggtgtccttttaatgtccacatttttgtcaacgaaaagaatgaaagtgaagtaaactttaagtcgttgcggcattcaagaactgtcagaaaagttatagattcatctgaagaaaaaatgtcgtcaacgataagtcaagc

SEQ ID NO: 10588 - DNA, 886 bp, Diabrotica virgifera
  misc_feature (617)..(634): n is a, c, g, or t
  misc_feature (665)..(665): n is a, c, g, or t
  misc_feature (795)..(795): n is a, c, g, or t
  misc_feature (861)..(861): n is a, c, g, or t
gcatagtggaatttccattgcattaggaggcagggaaccctggactctgaaacatggagatcctgacaacaaaagactgaaaccagcaaaagagtgtaaacctatcgaatatccaaaacctgacggcaaaatcagttttgatcttctcacctccgttgctttaacgggcaccaatcacgagggtgaccaacctgctcatcttacattgttaaatgacgatgtcccagtcaatgtaaacttgaacacttatgatggaccggaaggaagattttgtcctgcgggtgtttacgagtacgtaccactggagtccggcgatggaatgagactccaaatcaatgctcaaaattgcatccattgcaagacttgtgatatcaaggatccgactcaaaatattaactgggttgtaccagaaggtggtggcggaccagcttacaatggaatgtagttaattatcctcatacattacgcagtccatgaaaaattgttgtcataatatatgttccaagataactagttatgggcatctagaagtgctactcaatattgcgattggatgttacaacaaaaattggtattttaacttttttctctgttttcctgccaaaataatatccccnnnnnnnnnnnnnnnnnnatagattcgggtaacttctatcacattttgngttagattattttaatttgttagatactcgttattagactttttaaggcaacaagtgtataatggtgggtaattgatacttaatttattgcaaatctgcaacccttagtaaacatatctggtatacagangttgcgataaagtatgggaacaagcaaatatcttttgaaatgaaaagaacaatatttatgaaactntgcatggcagtacagtgacgcaaag

SEQ ID NO: 10589 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10590 - DNA, 615 bp, Diabrotica virgifera
cctcgaatattttattcaaatacataaaggtttttctatttttttcttaaacaatatacaaggacatatatctatttctcatctcctggtttggagaagacaagagtgtaaccgcacttgccacagtaatgcctgtcttccatggctgccatgaagacaccagctccacattgttcagcggggcattcacgtctcaatcggtggattttaccattttcaggatgtcttgttatttgacgatacctcttctttgagcccttaccacaaggtgaaccacgagtgtcacatttactccatatagaccagttcgtcgttttgcagtttacaacacgaccgtctggaccttgctcaacgatcagactttctctatcattacaaggaatgtgacattttacaatttcagaagtagaacaactatcttcttcatcttcgcctttctcgtcattgtctttgtcgttttcagatggtaatcgaagtcttcgcttcactccctttccacaagatacactacagctagaccatggtccccaattcgtatttgtgcatttagactcactctcttcactgcattttccgttttcacctctacatcttcggatatcttgaagttatata

SEQ ID NO: 10591 - DNA, 1173 bp, Diabrotica virgifera
  misc_feature (38)..(62): n is a, c, g, or t
  misc_feature (92)..(112): n is a, c, g, or t
  misc_feature (543)..(567): n is a, c, g, or t
  misc_feature (737)..(737): n is a, c, g, or t
  misc_feature (789)..(789): n is a, c, g, or t
  misc_feature (1046)..(1091): n is a, c, g, or t
  misc_feature (1096)..(1133): n is a, c, g, or t
  misc_feature (1158)..(1172): n is a, c, g, or t
tttttaccaaaatcaacaagtttgaaaatgaatttagnnnnnnnnnnnnnnnnnnnnnnnnntacatgcaggatttgccttaagatttcagnnnnnnnnnnnnnnnnnnnnncactaataatccataaagacaatacatcagctgtagaattcataagaaaaatgactgatttaaaattgttatactccgataccctgccgtcaaacatttgtagtgaatgcactcaagccgttttcacagcctttgatttcgtggagatatgtctagcttccgatgcaaggctgagaacccaggaaacaagaaggatgttgcgagaaatagaggctgaagctctggaactggaagatgaagacccactaaaatgtgatacaccctcagaactagaacattgttcaaagcaagatggattggtcaaaactggcaaatcggaagaacggagtcagatcgttcaagagaaagtaaatcctttaccaaaggaattacaatttacaacagctagaattaaagataaatacaaatgtgatgtatgcaagaagaaattnnnnnnnnnnnnnnnnnnnnnnnnncataaacggattcacgaagataatgcttttaagtgtatgacttgctcactcagttttagcaggaaactgaatttaaaggcgcatttgacaacacatttagaaaacaaagataaaaagtttgaatgcaaagagtgtaacaagttctttgtctttgagtatctactgaaganacatgagttgagacatagcaatgttaagccatttccctgcaccagctgtgantaaggatgcttgacagccgaaagtctaaagaggcatatgcgaacacacgacaaaaattatacaaaatgctacacatgctacgtatgtaacaaatcatttgcgaatcccagtttttttagcagaacacatgaaaaatcacactggaagagaaaacacccatatgtaacgggggggggggaaagggtttttaacaaaagggggggtctttcattttccccaaaaaatcccccccgggaaaaaaacccttttctttgttnnnnnnnnnnnnnnnnnnnnnnnnnnnnnnnnnnnnnnnnnnnnnnaaaannnnnnnnnnnnnnnnnnnnnnnnnnnnnnnnnnnnnncccggtttccctttgtttctcatcnnnnnnnnnnnnnnnc

SEQ ID NO: 10592 - DNA, 764 bp, Diabrotica virgifera
  misc_feature (428)..(446): n is a, c, g, or t
tgataaataagcttagcagatacaacaaagtttgggtcatacagtttgatcattccttccgacgcttttcaaaatttattttgagtttttggcaaatatttactaaaattaaaagacttaaaagagagctctgccttttttatgctgacagaaatttaaaaaatggtaatttgcaagaaattgttataaaattacaaccaattaaagacattgttacagaagcctataatttgttatgtttaattccgacaattccatcgaataccgtatctgtagaaagagaagtttttcgtgcttaaaaaggctaaaaacttttagtttgactgttatcgcactcatagagaactattatataaagtttgcacaagcatcctttctacgaagatatcattgatagatttgcttccataaacgatcaaagaccttgnnnnnnnnnnnnnnnnnnngtcagttttattaatctatctaatacatactgcttttttgtttaagtatctcttcatcctcgtctctaatataagtgccataaaaaagttttcaagttgttagggcctaaactctaaacgttttttaaagcatttttaatgagatttgggcgcgtcataggtataagtataccgaaatttctcttgggtccggcagactttcctcatcttcaccttttttaagccacgagccgccgctgggtcaattggaaggaaagtctggtgccattcaccgcgataattatagctcaaatagcggatattacagttagtggagtt

SEQ ID NO: 10593 - DNA, 815 bp, Diabrotica virgifera
  misc_feature (674)..(674): n is a, c, g, or t
  misc_feature (776)..(776): n is a, c, g, or t
  misc_feature (794)..(794): n is a, c, g, or t
gaagattgggcatacaaaggtgactatgacaattccaatcaatcagaagatccttcagtttcacatggatttaactatcatcaaggccccgaatgggtatggcctattgggttcttccttcgagccaaactcatttttgccgcacaaaatggagcgttgagagaaacagtcgctagtacgaaactgatcctttcgaaacacttcgtcgaattacagacttctgattggcgaggtctgccggaattgacgaataaagatggtgcctattgcaacgatagttcaaggactcaagcgtggagcatgtcttgcgttcttgaggtccttcatgatttaaagaaaattgagtccagtatagacctactaggcaactgacttaccagtaccttagacactaagacaaataatagcgttacacaaaaacatacatacaacaaaaccatacgaagcgaattagttgagaacaaaaaacttttgtcgccgaaattttgtagaatattgagacggcaaaagatttacaccgaaatcgaagaaatcaaaataatgaaccactcagacgatcaaaattcttccagtgaaatattaagttcttccatttttagtgatacgtttctgccatacagcgacctctattttaagcataatcaaacattgcctaacgcgggttgtaagtttanataagtttatacagagtgataatttattattaagcaacgattctctcatttgttcgtctaattttgtgccttttaacacaagaggttcccaaatattgcatnaggaatattagacagcanacacggacattggacataata

SEQ ID NO: 10594 - DNA, 489 bp, Diabrotica virgifera
  misc_feature (17)..(33): n is a, c, g, or t
  misc_feature (35)..(109): n is a, c, g, or t
  misc_feature (137)..(157): n is a, c, g, or t
  misc_feature (159)..(247): n is a, c, g, or t
  misc_feature (264)..(290): n is a, c, g, or t
  misc_feature (394)..(412): n is a, c, g, or t
tgtaattgaaatgatcnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnntgcttaactttagaattttagtagcacnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttcaattattgacnnnnnnnnnnnnnnnnnnnnnnnnnnncgtacattgcatatttagtaaacttatatcggcttaatataggaattcggtaacatttttttcccctgtttcttccaccgatgggctttttgtattatctattnnnnnnnnnnnnnnnnnnncatagtttgaatggccgccgtattttgaccggcgctaaggtacctagtccctttaggttttgtattgctcctggaat

SEQ ID NO: 10595 - DNA, 746 bp, Diabrotica virgifera
attgtaaggtacaaaaatgagaataataatacattgcattaaagcatatttatgactgaagatacccaggtaatttcatcctcatgaatatccaagtagtgaaaaatgaaaccaagacacaaatgaagccaacagtagttaataatagtctgtttagtttcggagtacttgtagtgtgtatgtggtccagtacaataaatcctaatcctcccaacgagaaaagaaaacttgaagccaggccttccattatgtattggccattaaccctatatggcataaaagcaacaggcctagaatgtccatgttcgtcagttgttgatccaacactcggaggctcaactatcacatcataaatgattcctcctgtgacaagaaaatatgaaactaatactatagagaacacagtcatggcagagggctgtttcacccaggaaggttttttaattctcatctgaggtatttccaaaattgtaaacggtaacgtaaaaaattgctccatcttgattacttaatagatagggtgtagaagaactatttgctattataaaaacagtataaaaatttgttgattgttggcaatcacgatctgtttatgcgacgacgaaaaccagactctatggaactgcaacagatgaaagcggcggctaaagaggaaaaacaaagacggcaggtgcagagaaatagactatctagagaaaaacagttacgggaataagccgaacgtgaaagggcgagcatggagcaga

SEQ ID NO: 10596 - DNA, 809 bp, Diabrotica virgifera
  misc_feature (681)..(703): n is a, c, g, or t
  misc_feature (727)..(756): n is a, c, g, or t
gctgtttaccaaaagtgacacaacagaaatgtaaatacagttttacttaattttgtaataattatcaatatgggagacattgaagctaggagggaagcacgaaggaaaaagattcttcaaaattcagagagtagactacaaagaataacaggcgttgaaaataaatccaagatagaaatagaaggtatcagtagcagtcctgaccaatttcaaccagatgcagtagccacagaagccataccacgtaccatccatacaacagagaatcacacattttttaataatgtagatgaacctaccaactttaacattcaaaccaataatttcaacaatgatgtgcaaacaatcttttataacactagaataaatgaagatacatcagtggcacagatagttccccctcctcagaccaactctagacatttatatattcttctgattccgatcttatggagccttctaatagcagtatgtgatattataaatgtggacattagtgtcttttatataaacaagatttttctgcctttgatagccttcgaaatacatgatttttatttttcgccagatattccagtttcttcgactgtactctcttcgattctacttctgtctggacgtccatattcgaggaagttaaacatatttattcagtactttatgagattggttcaagatgtnnnnnnnnnnnnnnnnnnnnnnntggttagtcgtttatgtatgatcnnnnnnnnnnnnnnnnnnnnnnnnnnnnnncgaataaaagaatattgtggatatttgtattataataaagaaatagttttcac

SEQ ID NO: 10597 - DNA, 934 bp, Diabrotica virgifera
  misc_feature (311)..(328): n is a, c, g, or t
  misc_feature (500)..(517): n is a, c, g, or t
  misc_feature (687)..(687): n is a, c, g, or t
  misc_feature (727)..(727): n is a, c, g, or t
  misc_feature (803)..(803): n is a, c, g, or t
  misc_feature (840)..(840): n is a, c, g, or t
cggtttcatttcaaataacaacgactgtatctagcgaaaaaagtcaatagctagccaatctttggctgctttacaaatataccgatactatatacaagtaattaaaaatgtcgcgcacatatgcacttttcgtgtgccttttcgctggttttcttctcgtagatacacaatttaatgttgatattcaagaacctaaattaactacatttttaaataggataaccaatacaacttttgatttaataaaaagtggcataagcgtttttggacaaacaatagaaaacataattaccacattctcaaaaatagannnnnnnnnnnnnnnnnnaatagaactgattagagatcagctaataaagggtgttcctgagctcagtataccagtgttggatccgctacatgttaacaaaattgagtttgacgtaaggcatgaagcagccatattaaagggaaaggctgaagacattacaattaggcaaatatccaaattcatagtcgannnnnnnnnnnnnnnnnntttaggaaaattacgatttagattggatttaaatttgaccttcccatctattaaagttaacggaacttaccaggtgaacggtcttataggacaaacgtttaggattttcggaaatggacctttcaagctaaacataatatatctaaaagtagcaactacaacaatcctanagtttaatttgcctggtcaactgcaagtagaaagaattanaattaatcccagaataaggaaacttgaaaacaacttcgagaacatgatgaatgatccagacacaggagcacttatncacaaagctatttcagggctagccccagaagcattanagattttgtggcctgagttgaagaagccaatcgaaatacacttttgaagtacataaacaacatccctggataacgcatcagtcgtcaacatttg

SEQ ID NO: 10598 - DNA, 224 bp, Diabrotica virgifera
  misc_feature (7)..(51): n is a, c, g, or t
  misc_feature (53)..(95): n is a, c, g, or t
  misc_feature (103)..(216): n is a, c, g, or t
cttttcnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgt

SEQ ID NO: 10599 - DNA, 375 bp, Diabrotica virgifera
  misc_feature (7)..(153): n is a, c, g, or t
  misc_feature (328)..(366): n is a, c, g, or t
cgagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataataaccttaggaatacgcgtatttttattggaaagtcaatcgaaaataagatgcgcgaccccaggttggattaagtttatatttggggaacagctatttttttaagtttgttccactttttaaatttttatctgatttgggttttaaaccgggggggggcccgggttggnnnnnnnnnnnnnnnnnnnnnnnnnnnnnnnnnnnnnnncaaaggggc

SEQ ID NO: 10600 - DNA, 183 bp, Diabrotica virgifera
  misc_feature (6)..(108): n is a, c, g, or t
  misc_feature (111)..(174): n is a, c, g, or t
cttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnncaatttttt

SEQ ID NO: 10601 - DNA, 372 bp, Diabrotica virgifera
  misc_feature (2)..(25): n is a, c, g, or t
gnnnnnnnnnnnnnnnnnnnnnnnnattctacccgccaccctcattgtggccatagatgccaattaatctgcctttagagcatagaagagtgctacctagaaatgagtttttgttattaacgcgtagcacaggtcccgtgcaaatatcaattctatttttattatctgctatgctatgtgaagagcaaatagcttgtcaatttaattgagtataaagaaatgtacctggtagttaaactcttgacaagatgtgctgtgtccatttaatagactcccctacgccataaaattatcttaaattacctgaacaagaacctagttaaacatcggaaacatatgaacatcatagaattgttgagatgggataccttt

SEQ ID NO: 10602 - DNA, 753 bp, Diabrotica virgifera
  misc_feature (2)..(44): n is a, c, g, or t
  misc_feature (52)..(164): n is a, c, g, or t
  misc_feature (174)..(583): n is a, c, g, or t
  misc_feature (592)..(661): n is a, c, g, or t
  misc_feature (682)..(682): n is a, c, g, or t
  misc_feature (694)..(710): n is a, c, g, or t
  misc_feature (712)..(724): n is a, c, g, or t
  misc_feature (729)..(729): n is a, c, g, or t
  misc_feature (746)..(746): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnggaatgaaagggttggatganaaaaaaactggnnnnnnnnnnnnnnnnngnnnnnnnnnnnnngttanaagctttaattttttanagacgag

SEQ ID NO: 10603 - DNA, 874 bp, Diabrotica virgifera
atttgaaattagtcttaaattacacaaagagaaaatacttgaaatgaaattggagtttgtgtacatagttttgacactagtggatggagaaagagaccctagaaatttattgtttttattcaaatggatgaaagtgtttctggaccactttgatctgaaacatttaactgaagacatttttgatgtattggcatgttactttcctgtggattttagagcacctccatctgaatcgtccataactcgagaagctctttctgaagctttaactccctgtctgtgtgccaaacccgaatttggagattcgtgtattacgttggcccttgaaaagctagattcatcattagaaattgcaaaaacagatagcttaaaactactgacaggaggctgtgtgacatttccgacttcaatttacttagaaaaggctcctgaaatatggtcattgctacaaaaagaaatcttaactaatacgccagacaatataagacaggaatgtcttacaaccctgactataatcatatcaaaaatttcagaaggtcgaactgacgaattttagacgttttacaaaatatactggatactctaaaaggaaacttgctacctgattccaaattgtttgagaaatcttcacagattttactttacgtagttgcaggatctgagcatgcctgtaattatattataaaggaagtagtacctatcctaacaaatatttatagtatgactgcatataataatcaaaaatctattatagtgcaaactctggttgaatttgccaaacatactatcaagtttaacaagactttatatgtcagagaagttccagagctcttaaaatcccttctgtgtgtttggaatacttaattatgatcat

SEQ ID NO: 10604 - DNA, 667 bp, Diabrotica virgifera
  misc_feature (73)..(91): n is a, c, g, or t
  misc_feature (287)..(299): n is a, c, g, or t
  misc_feature (302)..(318): n is a, c, g, or t
aaaaaattaagatgcatcttcagtattcggtctctctgctgtttggattgtttatgttctgctctggaggacnnnnnnnnnnnnnnnnnnntgcgcggatactgaagtttgattacgacgactcaggcaaaggcacatatcggcgggatatcgctttttttctttgacttgttagctatgtgtatgccaaatttcatgtcaatccaagtggttctttaaaatttagaggttttgcaatattttaccgttaaagtacggactactcatacataaagaaactacgaagnnnnnnnnnnnnngtnnnnnnnnnnnnnnnnnaataataaggtgcaatgaaagttagagaacaactgtattttaacagaccattaacttatttgtgatattattagtaggttattaatattttgggtatatccattaaaatgatttggtggtagtagctaaaatgattgttataaattgtaatccagttttgtcttatttttaaaaccttttttctacaaccgtgttaaaaataccatttttataactccatacgagagttatagatgctactttaaggcactagagctttataatatgtttaaggcactgacgtgtcgtattgaccgtataggtgattttgatgttatgtcaaatagatataaaaatgttatgtcagacc

SEQ ID NO: 10605 - DNA, 468 bp, Diabrotica virgifera
gacgcgtgggttttggtatataaacataaataagtgaaataggtacatgaaatcaagcttaacaatatggaaatatcacaagttaatgaacaattgtgtaaaatagaaacaacaaatcatgaggtgggtgaaactcttttggatacttttaaaattgaaattacagaagaacccaagagagaaagtgtttatgatgatgcatttggttattttgatttaaaagaattgcctgtaaagactgaaattgaacaaaatgaatataaattttcactatttgaagaaaaagaagcaaataaagaaagaaacggtaaacatgagagtaacgggccatgcttcaaaaaagaagactatacaccttctcctacttctattaatggaatctaaggactattgaaagtgtgattctcgcttctctgataaggctgctgtgactctcataattgatggcttgtaagcatatgccaccgg

SEQ ID NO: 10606 - DNA, 884 bp, Diabrotica virgifera
  misc_feature (481)..(502): n is a, c, g, or t
  misc_feature (603)..(622): n is a, c, g, or t
  misc_feature (839)..(839): n is a, c, g, or t
cacttcgcgtccgataatttgcccatatgctaaaatgcatttagggcagagaaaataagtagattttttaaactattaaacatgatttgggcaatgtctaggttgaagtttttattcttataaacatgtagtcacttgacatccagcacaaagatgattgatctgactgaatgaaatgaaaagtcgataaaagtatgactacgtggtaggactatgaggcaagggctccgtatatctgatattttaatgttaatatggaggatgaattaatgtaactgaaattcgtactatagtaaagtatatggggtatgtaagggttactcaacactgatttgtaatcatagttgttataaaaggtttagaatagttattctgtccttatatgtgtatatctaggacaatgaaatattaggtataattttctaaattattacctttgtggagaaaataaagaaagagggtgttgagtaaaagttgtcgnnnnnnnnnnnnnnnnnnnnnngatattaaaaagttaaagattagattgatgaaaagtaattaaatgcagttaagttgtggaataagtaaatcagacagcagagtgattgagattgatgattnnnnnnnnnnnnnnnnnnnnatgagttccggagcgtatatttcctgggccaggtgatttgccattcttcaactgtttgcatatggtttcgacttctctctcatttactctaattggtgatcctatcaacctgacgccttgtataccgttggattatatctgtttgaagggctctcttgtctctgttagtaaatcttcaaagtatccttcccaagtttgtggtgatacgcagggccgncgcagagggatgagcgggccccgataaaagtcaacggcgggcccc

SEQ ID NO: 10607 - DNA, 214 bp, Diabrotica virgifera
  misc_feature (22)..(59): n is a, c, g, or t
  misc_feature (79)..(92): n is a, c, g, or t
  misc_feature (95)..(117): n is a, c, g, or t
  misc_feature (125)..(147): n is a, c, g, or t
  misc_feature (177)..(208): n is a, c, g, or t
aaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10608 - DNA, 235 bp, Diabrotica virgifera
gccctgcatggtccatcactacatatagaccttatagagtgccataaacttgtggtatgttatcatcgacaagttatgcaacgaaaagagtatatattgctaaaaaaacagatatggcacgtaccgggaggccaaggtcccggcagaagatccctacagaacgtttgttctttagttttgtgtttattcgagccaggagaattctgatgaggaagaagaagagtccatggctgaa

SEQ ID NO: 10609 - DNA, 617 bp, Diabrotica virgifera
  misc_feature (411)..(439): n is a, c, g, or t
  misc_feature (460)..(490): n is a, c, g, or t
aatcctctgttacaaaatgaataagttaacagagttcactttattgtttgctattggtttcctatcatcagccgaattccgggcgtttttcatatactgtatagatgtgcaaaaaatggtgcctgtatatatattatctctataatgtcaaactgcagatcaaactcaatattatagaataacagctgttttaaatatataatttgtaccgcgaagagatttgcctctaccatatatatatactgcaaataaatacataaaatgtatatattgacgttatatctataattatatttttctatattattacaattaaaaatttatacgaatgagctgttatagaatagtttactaacatttaattcttaaaaaaaaattaggatgaataattgtcatattctaaaatatgcnnnnnnnnnnnnnnnnnnnnnnnnnnnnncattatttgtaaattgtttannnnnnnnnnnnnnnnnnnnnnnnnnnnnnncatccggtgataatattagtattgaagtatcgcatattgtagttaaattatatatgttttttgaagagctaccagagccattgtacttgctagtttattaataaacaagtttttttgtattaggtat

SEQ ID NO: 10610 - DNA, 366 bp, Diabrotica virgifera
ctttttcattctgacactctcctttataaagtttagagtgtaggcactatttaactctacaagatgacaatagctgatctttatgaaggaatatacgattccaattaagtaggcacggatcttttgtacgttcatgtcccagggtgctaatggctgtgagattaggtcatgactagtttcgaatttgtcagatctggacacctaatatttttagtgggtgatagacatggcagtgaaccctttagcactgaggaggcagtcgaagtaaaaccattgccatgcttttttaaattagtttacacctccggactaccaatatattcatagttggaaagttttggatcatgattgtttctgtatgctacg

SEQ ID NO: 10611 - DNA, 81 bp, Diabrotica virgifera
  misc_feature (2)..(59): n is a, c, g, or t
cnnnnnnnnnnnnnnnnnnnnnnnnnnnnnnnnnnnnnnnnnnnnnnnnnnnnnnnnnncgtattgagagagaataccccc

SEQ ID NO: 10612 - DNA, 132 bp, Diabrotica virgifera
  misc_feature (40)..(62): n is a, c, g, or t
cggacgcgtgggtttaaaccggtgtgagccaggttggttnnnnnnnnnnnnnnnnnnnnnnngctgctacaccaattataaactttaatccaacatcgaggtcgcaatctttattatcgatttgaactctcc

SEQ ID NO: 10613 - DNA, 418 bp, Diabrotica virgifera
  misc_feature (271)..(288): n is a, c, g, or t
gtttaaaaaaatgcaagaacaacaaaagaaagttgaagagcccccaccagttgtagctccaaaaccaattccaatttttggtaagcgaagaggcggtaaagtattaaaaactggtatggtgcaaaagccgaagccaaacttcagaggagagctcatcacgtgatgcttggtctatgtatatgagcgaggtgagaaagtacaaagctgcatgctgtgatgatgattccaagtctagacctcttgtaaaatgaaaatattatactaatatgcnnnnnnnnnnnnnnnnnncctagttttaatttaagtaggtatttgagttaattttcaaaaagaactgctttcataatctttaggggtttgtttaactgtaatttttgtatgtgtttgtaaagtgctataattaaaagttacatttatt

SEQ ID NO: 10614 - DNA, 910 bp, Diabrotica virgifera
  misc_feature (87)..(121): n is a, c, g, or t
  misc_feature (123)..(144): n is a, c, g, or t
  misc_feature (184)..(211): n is a, c, g, or t
  misc_feature (861)..(861): n is a, c, g, or t
caaaaaacaacattcgagacctagacatagaaggtgcgtaagtctacggcaaatccgacaaatatatatatatatgtgtatatatgnnnnnnnnnnnnnnnnnnnnnnnnnnnnnnnnnnngnnnnnnnnnnnnnnnnnnnnnngttatattcctatttgatataagaaataaaagtctatagnnnnnnnnnnnnnnnnnnnnnnnnnnnnggttttcgtttttatcgaccgcgggcatgtaaatttggaacaccctgtataaaacaaattatgtataggtagtttttaagaaagtgtttcggaaaagtgtttacgaaccccaggaacaatacgactcaagtaaacaattagagtgatgtttaaaaagaaagtgttcgtggaaaggtgtggataaccaccgataattcatattctagtaaataagataataggttattaaatttgtaaagagggttaatgtggaaagtaaaattgaaatggggaatattattttttcttgaaatccattaagatatttagaaagaggaaagtttgtgttggtaattacggataattgaaagttgctttggattgattgattttgaatgctggaaggggtatttggaaggaggagaatgaatgagcgagaagagtcagaatgttttgagcgatcgaaaggcgaagtcgagttttcgagaagagtgtacaaaagagtgaaacgccgggttggttagttttgtctttaaaaaataaaaagtaagatatcgtggagcgagtgatagaccgactcgagatagtatataactccttgagtctaagtatcccggtttttgtttgagtgttttgaaaaggtagaacacggcatcaggagaaggcagggnacgaaggctgtacgaagggcgtagttttcaaaggagccgaggcattact

SEQ ID NO: 10615 - DNA, 680 bp, Diabrotica virgifera
cccacgcgtgcgaatcatgtgtagctactttatactttatttgtgtaatctccgcatggattggatgaacttcattatgaatttgtatttttatcccccgtacaaacacccggatctttaattgaaaatgatcatcatcattaggaatttgctacagaatctgaatttattatggtctcttccctactagctatacctattatattgttatgtatatatcaattgacttgtatccttaatacatggtgcaccttatcatatgtcttcacgtcttatatgtgctgttattatagcatattctaatgattcccgcgttccttctattattatatttgttataaatcttatattaatggttctctcgtattacgagtgtacatattatccatactgtgtctccaatatttgacgtgtacgcacattgagaagaaggaattcactcttctcgatcacgtttatattgacattccttctttttctcgtgctattaattccatgacaataaaactatcaatacagaacaatgccactagactttactagactacccttaatttctgagagcgatactcatacatgatcactggattatgatatttgttgcatgtggatatggagctctatcgttattattatcctatatcctttgaaattgctcgtgatctagatgctcgtgctgg

SEQ ID NO: 10616 - DNA, 249 bp, Diabrotica virgifera
  misc_feature (6)..(66): n is a, c, g, or t
  misc_feature (72)..(99): n is a, c, g, or t
gggggnnnnnnnnnnnnnnnnnnnnnnnnnnnnnnnnnnnnnnnnnnnnnnnnnnnnnnnnnnnnnccccannnnnnnnnnnnnnnnnnnnnnnnnnnncccttagggataacccgcgtcatttttattggagaagttccaaatgcaaaaataaaaattgggaaccccccaggttggaattaaagcttataaatttggggggaaccccttatttttttatatcccgtgtcacctctttaaaattttttc

SEQ ID NO: 10617 - DNA, 826 bp, Diabrotica virgifera
  misc_feature (617)..(637): n is a, c, g, or t
  misc_feature (795)..(819): n is a, c, g, or t
aaaataaattggtcagtctgtttgctttttcgatttaaaatgagtgaggatatccaacgaaaattgcaaaatgaattagaaaattacaaaaaaactcagaaagaactccaaagaaccatccaaaccagacagcaattggatggtcaattaaacgagaatgagattgttaaacaagaattagacctacttccaagtgatggtaaagtttataaatccgtaggacctgtactgattaaaacagagttaatagaagccaaacaaaatgtcagtaaaaggatggattatattagcaaagaactgaagcgagttgatgatcttattaatactttagataaaaaacaagatgttcatagggaagctcttcaaaaattgcaacaccagtttcaacaagctcaagtgaaagctgctcttcatgcttaattttaatactggacttactttaatgcttgaatatttattttaaaaaccaatttatgttaacttttgtattgaagtacattttctgttatataaaggttctgaatctgcaggtgatatctaaacaactttgaacagtccttattgttacaaatctgcagatataaatacgaaaagtattaaaataaggtaaattaccnnnnnnnnnnnnnnnnnnnnnctgccttgccataaagcatgtgtaaaataatttgtgttaatgtaattctttcataggttattcaagtatcttatcaaatgaaaatatattttgcacatttatagtttcaaaataggtaaagtgatgtatcccctgattcggttcctttgacaatatgnnnnnnnnnnnnnnnnnnnnnnnnngagctcc

SEQ ID NO: 10618 - DNA, 447 bp, Diabrotica virgifera
cggaatccccgggccgccccacgcgcccgaccttattcaacactaacgcatttcgattaattttgttatataatgtacatcattgactgaatcttttctgcaattttatagggtaccagatatgtgtatacatgaatatattttaattttgatctatttgtattttttgtaatactaagctagtgtatgtatatctaaaggatgcagtctcaatataataattctttgagaagaatatagatcggcgcttttcggtataatatgcttataggaactaggaccaaagtaggaatcatagatgtatgaactgccatcagatgctatcatcataaagcactatatagtaggaaactatacttccaatgaaaagcgtaagatgacctttgataaaattgctctgataatcatcgcatcgctgttggcgatttccttactgttgtgttcttt

SEQ ID NO: 10619 - DNA, 552 bp, Diabrotica virgifera
  misc_feature (4)..(124): n is a, c, g, or t
gccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgaagcttgaagtatctaatgttattggtacagatcatgcatttattataatttttcattatatatatacctattattattagtgggttatggaaattgaattgaaccctttagtattggggggcccgacatattaatatcactccaatttatatataagatatttgattgcttcccccgacccatttattaatatttagaaagatatggaacatgaatggttggtatggtatcggaatgaacatcccgactctgatctcgatatattgtccatgccgggccagaaagagaattagatatttctcatattacatttaactggaatatctatcatatttaagtgtacttactattattcctacaggaattagatataccacacaactggaatcacctttgatcgaagacgccctatttgattgagtt

SEQ ID NO: 10620 - DNA, 589 bp, Diabrotica virgifera
aagatgacaaagtgtttgatagcgacgaagattcagacgtagaaattagttatgaactgacaggtgataggaaaaaagtatttgactttttccagagcgctactctcaatgaattgcaattgattagcacttgttccaagaagaaagcagaagctattgtagatttacgaccgtttgctgactggaaatatctgatgactataatacagaacagcaagaacttgggatgcatacgacccgtcaatggtcacttagttgagactaaggtctaaaaattagcgccgatatcacaataaaacccgtccacactaccgaactgttttgctgctgatgaaactatgctagacaacctttatatagcaactcgtatagacactactacaagttcacgttaccagcactatgcagcctccggacattccttctcagaacactagattatttgcacaactattaccgatgtagaccgcctccaccgatcaacgcaccaatactgtccctcatccatatcttccacctcttctattaactccttttctctcctaacctaactattgcgcttacctaaaatcaacaacccccgtacacc

SEQ ID NO: 10621 - DNA, 1036 bp, Diabrotica virgifera
ggttcctacatatttcttttttccggaaatatctccaacttatctgatcgaccctgtacagcgacaccgagaagtgaacccgacagaatattgtattcctatcaaatatccatagactgttgggaagatctgtatcgagcttctatcgtccgcagattaaacagtgaccactcgcgagcttgaccaacctgatcatcttatattgttatatgagaatgtccctggcaatgaaaacttgagcaatgaagaagtacccgaagtaagagattgccctgcgcttgaaaactatcttgaaccactggagtaccgagatatatatatactccaaatccttgctcataattgtttcttctgcaatgcttgtgatctcatagatccgactcgtatattaactgacttgtaccacacggtagacggcggaccctcctcaccgaacagaaggaaggaccctcatacatcacgctatccaagaatatacgtcacataatatatgctccgtgattagtagtcacgttagactacaaaggctactcaatattgagagagaatgacacacaaacactggcattctaaatagtatccctgttgccctgccgcaataagatctcctctctctatttattttacaatagactagaggtaacttctaagcgcatcgtcgtgtcccgatcatggaacaatagccacatactcgcttatcaagcatttgacactatatgatgctcattgcccataacctgctttctgattcccaccatcatacccatagccttatggaaagaacgttcttcaaggctttctgtgtcactatccccagatatgtattcaccctgtacgctacctggttaggtaattctgctgcacacttgtgggggtgacaaacctatgataatttctttatcccttccaaacacctcccctgtgttccgactccccctcctaaggcaaaggttggaccaactccccccaccccctccccttggggacttccaaaactttcccaatttagggcaaaaccagtgaccaactttttctt

SEQ ID NO: 10622 - DNA, 930 bp, Diabrotica virgifera
  misc_feature (87)..(101): n is a, c, g, or t
  misc_feature (103)..(151): n is a, c, g, or t
  misc_feature (156)..(183): n is a, c, g, or t
  misc_feature (200)..(240): n is a, c, g, or t
  misc_feature (278)..(336): n is a, c, g, or t
  misc_feature (357)..(375): n is a, c, g, or t
cccacgcgcgccttcatgatgatccgcctactatcccagcaagatagcacccaagaatattcaggggagacgattacttattgcggnnnnnnnnnnnnnnncnnnnnnnnnnnnnnnnnnnnnnnnnnnnnnnnnnnnnnnnnnnnnnnnnctagnnnnnnnnnnnnnnnnnnnnnnnnnnnngacagagctaaaaaacnnnnnnnnnnnnnnnnnnnnnnnnnnnnnnnnnnnnnnnnntgtactgaaatggtattcgattttagatatatctaagnnnnnnnnnnnnnnnnnnnnnnnnnnnnnnnnnnnnnnnnnnnnnnnnnnnnnnnnnnngatcattattgttacctatgnnnnnnnnnnnnnnnnnnnttacgttttattaaaatttatgtttttaaatacagattaggattaggaacttctcatattgtaaaagatgttaatgattcctcatatatatactgataattttgaatatttcgatgactttatgtatgctcccagatatgtacgttatgttaaactaagacagggtagacaatattgcgtattggatgatacgagtaatatggggatattaacttgtgtctctgttggcctgccgcaataatatctcctctctggatttattttacaatagactctggtaacttctatcacatgttgaggatcgatcactgaaaaatagctagatactcgctatcaactttcctcagtgctacaagggtcatgtcggagggcagtgatcctgaaatccataggccatgccgggggcccttagggacctctccgtttcccgaagggttgctgtgtttcggacccggactatgcattctcccggaaaggaccctgttttagtacctcctgctgccaaccggggggggggaaagcttgacggtctttatttatccctccaagaccccc

SEQ ID NO: 10623 - DNA, 1169 bp, Diabrotica virgifera
  misc_feature (822)..(822): n is a, c, g, or t
  misc_feature (824)..(824): n is a, c, g, or t
  misc_feature (851)..(851): n is a, c, g, or t
  misc_feature (880)..(880): n is a, c, g, or t
  misc_feature (890)..(890): n is a, c, g, or t
  misc_feature (960)..(960): n is a, c, g, or t
  misc_feature (1052)..(1161): n is a, c, g, or t
ctttcagagcgaataaatctttcgccttttactaaagatctccatggaaccaaagacaaaaaagggaaaagcttacagaaataatgtttgaaaagtacaaagtgccagcgtttttcctggtgaaaaatgcacctctggcggcatttgctaatggcagagccactgctttagttattgatagtggagcaactcatacaactgcagtacctgtacttgatggctatgtattagcaaatgctgtcgtcaagtctcctttgggtggagacctattagttttaagggcaagggaactattagaaagcatgggaattgatcttacacccactcctatgattgccagtaaagaagtggttcgtgaaaaggaagcacctaaatttacaaaaaagaagttgagttttcaacctacgaattcttggttgaactacatgataaagaagactatacaagatttccaacaaacagtattacaggtgtccgaaaatccttacgatgaaagggctgctacaaacatacccgcagttcattatgagtttccaactggatatcatcaagattttggacctgaacgttttaagttagctgaaggtctgtttgatcatgcaatgcttggagctggatatatagctgctacaagtgctggtatgtgtgacgtcgatattagaccagcactctacagtgcagtggttgtaactggtggaaattctttagtacagggttttagcgataggctcagcagagacctttcatccagaacgccaggttctctcagaatgaagatgatcgcagctaacggtaccgttgaacgcaggtttggtgcctggngntggaggttcgattctagcatctattgnaacattcccagcaatgtggatctcgatgncagagtaccnagagtgcggaaatccccagtcgatcgaagtgcccttaaatgtagtttatcatagaactttataatgtaantgatcaaaagttgtttagacatgtcgagagttaaatgtctaattgtattgcgtatttctaagtttacaataccattaaactatttttttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaacacc

SEQ ID NO: 10624 - DNA, 985 bp, Diabrotica virgifera
  misc_feature (422)..(439): n is a, c, g, or t
  misc_feature (919)..(949): n is a, c, g, or t
cagttagataaagtggaatttaaaatgatttgtgattatattttaaaagatcttccatcatatctaaaagatctgctttcagatactgatttagataaggttcaggtagctggggaaaagcgatcatggataataactatctatttacgatccccgtatcaccaatatctaaaaaaccacatcgccgcttgtgcaatagttaccgcagtaacttctccagtatcgaaatgtctttcttatctaaatatatctagttttctaataaatacatgacttgtatttattcagcctgtacttagatactagaattgttctcttattaatatgatgtacagttcgggaggagattcaaggtatgatctgattttcattcggtttacaatagtcactagtatcgtgcagtttcataagttatgctaagnnnnnnnnnnnnnnnnnngattatgacttttatttgttatctatctttaattaggatcatacatgtagatttcttaaacctaccagtgattgacctattaagactaaaaaatggtaaatttggtggaaatagatacctggtgatacacgtattctgctatgtttttttgcactgagtattctgtacctgcgtttttgtattacgtatcgggtctcgcatgaccgctgattagtctaaatggccgctacaatcctgaccgcgctatagtatggtaagcattagctctttttattaatagctgaaatgcgagggaggacgagaaaaaacttgctgttacttaatttaaaaagaatttcagtttttaggacaaaaagcttaattttttttacaagacgataagaccccctcatagtactatgaaattattatcacggtttctccagcattaaagttcatttatataataaacttatttaattacggggggttacaaaacgnnnnnnnnnnnnnnnnnnnnnnnnnnnnnnnctaaaatttttctcgtcccattttttttggatattt

SEQ ID NO: 10625 - DNA, 914 bp, Diabrotica virgifera
  misc_feature (28)..(321): n is a, c, g, or t
  misc_feature (615)..(632): n is a, c, g, or t
atttaatactaatattatcatcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaccaccctatagatcattattgcatcctttgtaagacttgtgatatcaaggatcctattcataatattatctgttttgtaccagaatgagaaggcggacctgcttacattgtaaatgtagataattatcctcatacattacgcaccccatgaaaaattgttgtcataatatatgttccaagataactagttatgttcatctagaagtgctactcaatattgcgattggatgttacaacaaaaattggtattttaacttttttctctgttttcctgccaaaataatatccccnnnnnnnnnnnnnnnnnnatagattcaggtaacttctatcacattttggagttagattatttttaatttgttagatactcgttattaaactttttaagtgcaacaaagggtatattgggtgggcattcgatcccttattttattagccaacctgcaaccctttatagacattactcgttcacagagtggttaataaagtttgaaacccagcatatatcttttgacatgaaaagaccattttttatgaaactttggttggccaagtacggggacgcaaaaggcacgatgcctttttttttt

SEQ ID NO: 10626 - DNA, 491 bp, Diabrotica virgifera
  misc_feature (5)..(171): n is a, c, g, or t
  misc_feature (182)..(182): n is a, c, g, or t
  misc_feature (189)..(251): n is a, c, g, or t
  misc_feature (287)..(326): n is a, c, g, or t
  misc_feature (445)..(484): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgattanaaaatannnnnnnnnnnnnnnnnnnnnnnnnnnnnnnnnnnnnnnnnnnnnnnnnnnnnnnnnnnnnnntttataagaaataaattacccttagggataacagcnnnnnnnnnnnnnnnnnnnnnnnnnnnnnnnnnnnnnnnnggcgacctcgatggttgggataaagttttatatttggtgaaacagcttatttaattaagtctgttcgacttttaaattttacttggattgaggttaaaccgggggggggccaggtgggnnnnnnnnnnnnnnnnnnnnnnnnnnnnnnnnnnnnnnnngggcccc

SEQ ID NO: 10627 - DNA, 171 bp, Diabrotica virgifera
  misc_feature (2)..(32): n is a, c, g, or t
  misc_feature (59)..(59): n is a, c, g, or t
  misc_feature (141)..(162): n is a, c, g, or t
annnnnnnnnnnnnnnnnnnnnnnnnnnnnnntaacagcgtaattttattggagagttncaatcgataataaagattgcgacctcgatgttggattaagtttataattggtgtagcagctatataattaagtctgttcgannnnnnnnnnnnnnnnnnnnnnagtttaaac

SEQ ID NO: 10628 - DNA, 1016 bp, Diabrotica virgifera
  misc_feature (2)..(44): n is a, c, g, or t
  misc_feature (52)..(164): n is a, c, g, or t
  misc_feature (173)..(399): n is a, c, g, or t
  misc_feature (404)..(491): n is a, c, g, or t
  misc_feature (493)..(547): n is a, c, g, or t
  misc_feature (549)..(549): n is a, c, g, or t
  misc_feature (555)..(594): n is a, c, g, or t
  misc_feature (600)..(600): n is a, c, g, or t
  misc_feature (604)..(622): n is a, c, g, or t
  misc_feature (630)..(655): n is a, c, g, or t
  misc_feature (676)..(693): n is a, c, g, or t
  misc_feature (695)..(756): n is a, c, g, or t
  misc_feature (760)..(772): n is a, c, g, or t
  misc_feature (774)..(839): n is a, c, g, or t
  misc_feature (847)..(909): n is a, c, g, or t
  misc_feature (916)..(941): n is a, c, g, or t
  misc_feature (988)..(1007): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnanacatgnnnnnnnnnnnnnnnnnnnnnnnnnnnnnnnnnnnnnnnnataaanttgnnnnnnnnnnnnnnnnnnngtgctaannnnnnnnnnnnnnnnnnnnnnnnnngaaagctggaaatgagggggnnnnnnnnnnnnnnnnnncnnnnnnnnnnnnnnnnnnnnnnnnnnnnnnnnnnnnnnnnnnnnnnnnnnnnnnnnnnnnnncagnnnnnnnnnnnnngnnnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnnccccacnnnnnnnnnnnnnnnnnnnnnnnnnncccccaagggaaaacaccggcgatttttttttggggggaaggccaannnnnnnnnnnnnnnnnnnncgccccccc

SEQ ID NO: 10629 - DNA, 674 bp, Diabrotica virgifera
  misc_feature (189)..(201): n is a, c, g, or t
  misc_feature (203)..(216): n is a, c, g, or t
caataatcatgtactttttagaaaaaataaggattgattttatttgatgataggtaattaatattaagggagatgatcccttctctataaaagactgattcattgtttgaaccccgtcgtatgcattgcctccctacttaacaattatattttgattattctcacccttagaaccgctattgcctctgnnnnnnnnnnnnncnnnnnnnnnnnnnngtatttattctgttttgaaatgatattgactcctaaatataccttcattatttaccaaatagatatattttatgtattagcaatatatgtattatcaaatatcctcatattatttttatccactgtctttatgaaggccctgaataataaatgtttattcttatttgatttatctgctgatgtcaagacttcaaatgtacatatacttaggagaggtctattataggattttacacatcattatacacttcttatctcattatgaaatcttgtatatgcactatatactcaagttatatctatccataaatgaatgtaatactttattaccagagacttcctattttcagacatcatataagtatagtataggctccttcctgacttcatatcacctgatattgaaaaagcctgccattttatctaccccctacatgctctgctgatccctgatgatt

SEQ ID NO: 10630 - DNA, 1113 bp, Diabrotica virgifera
  misc_feature (95)..(125): n is a, c, g, or t
  misc_feature (736)..(755): n is a, c, g, or t
  misc_feature (954)..(973): n is a, c, g, or t
  misc_feature (1017)..(1042): n is a, c, g, or t
gcgaacttatttcagcaacatgacaaaacctcttgcgggagtccagaaaaattttacttaccgatacttaattagcatcgcgacagaatattttnnnnnnnnnnnnnnnnnnnnnnnnnnnnnnnaccccgtgtcccaggcactattaatcactaatcatacactcaccactctcgaatttaaccgacctaaacaactaacatttttattggaaaataaacattttaaataatccttttgcactgaaacgctacccgttttcaaatatatccaatcttctaagaaataacttacacctctttaccaccaatatatttataattacatattcttatatcattaatattacctatctttcgggatgagctcacaaatcacgtcttattaaaattcagtctctaaccacacattaacatcaaaactcctcacatcgtaaaagacgtaattacccatcttccatatactataccttcgctacccccacactttatgtatactcccacactagtagactccttaaacctagcaaggcacacaatattgcgacgggacgattccacgaacacggaaaacctaactgtttccctactggcccgcgctaaatacccccccctcctttacttcacctggaccctacttactccacccacccgtcgtgccgacccggaacaccaccccatccccgctatcaacctctctcaccccgcaaggctcatgcccgagcccccctaccccnnnnnnnnnnnnnnnnnnnncccctctcgcccccaccgcttccccaacggtctgctgcgtccccatcaccacacatgtccttctccatgaaacctcacccctccaggcacccccgcccgcccacacgcgggggaaccaaccccggaccccctctcattcccctcccgaccacccccccggtgccccccccccgccccctcacgcaaagccgggaccatnnnnnnnnnnnnnnnnnnnngggcatctcctcctctctcactacatgccaaccctcaccccttnnnnnnnnnnnnnnnnnnnnnnnnnnagcgccccagaccaccctcccgcggccctccaccctacaccttcccccctcccctccctccccacccccca

SEQ ID NO: 10631 - DNA, 122 bp, Diabrotica virgifera
ggatttaccgagagctaagtagttgagagagagagaatctcctttttatacagaaaaaaattatcttttgtctcgtgcgtagcacaggattatgaatgagcaatgatatatatattattgtc

SEQ ID NO: 10632 - DNA, 115 bp, Diabrotica virgifera
  misc_feature (9)..(106): n is a, c, g, or t
ttttagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttttt

SEQ ID NO: 10633 - DNA, 817 bp, Diabrotica virgifera
  misc_feature (11)..(33): n is a, c, g, or t
  misc_feature (73)..(90): n is a, c, g, or t
  misc_feature (97)..(116): n is a, c, g, or t
  misc_feature (269)..(294): n is a, c, g, or t
  misc_feature (296)..(334): n is a, c, g, or t
  misc_feature (467)..(482): n is a, c, g, or t
  misc_feature (485)..(497): n is a, c, g, or t
  misc_feature (511)..(532): n is a, c, g, or t
  misc_feature (539)..(570): n is a, c, g, or t
  misc_feature (572)..(606): n is a, c, g, or t
  misc_feature (608)..(656): n is a, c, g, or t
  misc_feature (685)..(709): n is a, c, g, or t
  misc_feature (749)..(775): n is a, c, g, or t
ataataacatnnnnnnnnnnnnnnnnnnnnnnnccttttatttaactgataccccaattactcttgcgagacnnnnnnnnnnnnnnnnnncagaacnnnnnnnnnnnnnnnnnnnncgtatcccggattattacttaataattctatatttattattttctaatttcaaacagctaacacattaaaatttttattgtcctctacatattttaaatcatctttttgtaatgaactgtcattcgcttttacatatatctaatttcttaccnnnnnnnnnnnnnnnnnnnnnnnnnncnnnnnnnnnnnnnnnnnnnnnnnnnnnnnnnnnnnnnnnctattcctacggatgagcttataaataacatcttattaacatttaatttttcactaaaaattacgattcatcattatcatattttcaaatatgtcattattcatttttatatatcattatttccattttccannnnnnnnnnnnnnnnatnnnnnnnnnnnnnatctaaacttaggnnnnnnnnnnnnnnnnnnnnnncaacacnnnnnnnnnnnnnnnnnnnnnnnnnnnnnnnncnnnnnnnnnnnnnnnnnnnnnnnnnnnnnnnnnnngnnnnnnnnnnnnnnnnnnnnnnnnnnnnnnnnnnnnnnnnnnnnnnnnnctctgaatggccgcggcattttgaccgcnnnnnnnnnnnnnnnnnnnnnnnnnctttattggaagctgtgatgaagggttggatgaacacagnnnnnnnnnnnnnnnnnnnnnnnnnnngttattttttagctaaaaagcttaatttttttaaccgacgag

SEQ ID NO: 10634 - DNA, 681 bp, Diabrotica virgifera
tactttagagtaataaaatattttttcgcccacataataactaagtttattcattgatagctaaggattagtgcgggagaagattttagtattgtcaaacaaaaatattcttctttgtaccttccgcctcaagtataatatcttgcttgttctaactcgtcagacgctgaactggaaaaccggtggactttcgaaatattatggtaggcaaccaatataatagagagtcatttacactgacatgatatcgcaaggtatatgattcgacagaagatttgaaagacctatactgcctctaggacccctacaatgatcattgcgcacgctcataataataggaagagacattgtagggagaagctcttaaaaaggccttaaatgatgttaaaaacttaggtatttagggataggctccgaaatatggtatggccagaagatagatcacacagatatattttattagaaattagaatctgccgcaagaaatttggaagaatattaccaagagctgtgattaaaaactaacacagaagttcctcatttagatataaaattgtacgtttgcgagcattttatgtggtaagtatgctaaatcgttagcattatttttcaccagacctcagaaaatattgggtggaggcaccccctccgcagatacccgctgccactcacgaatggcaa

SEQ ID NO: 10635 - DNA, 432 bp, Diabrotica virgifera
agaatcagggatcagataatgattgttatatgctataaaccatcaaagtgggaacaaagtgattccgaaagtgttggttcatccactaaatgttaaaatatgtattttgtggtggaactcgatattcccatctcataccccacaactgccccagaaatagcccttccagaacttgacggccagagtgctaccatgtatagaggtggaaaaattcgtctgagagatcatttcgaaccattatgggctagaaatgcacctatatttggaatcggtcatgccatggctttggggcttgggccatggctagatgaggaaattccagacttaatagcaaaaggagtgatatccttacaatgaaaagactagtcattgatccatatacataaatttatagttaagaataagagcagagcagctatcttccattttatg

SEQ ID NO: 10636 - DNA, 1099 bp, Diabrotica virgifera
  misc_feature (267)..(290): n is a, c, g, or t
  misc_feature (293)..(308): n is a, c, g, or t
  misc_feature (343)..(360): n is a, c, g, or t
  misc_feature (506)..(523): n is a, c, g, or t
  misc_feature (683)..(712): n is a, c, g, or t
  misc_feature (721)..(840): n is a, c, g, or t
  misc_feature (843)..(890): n is a, c, g, or t
  misc_feature (910)..(965): n is a, c, g, or t
aaattgtacctaacgaaagataataaataatgaaatagaagatataatccttactgggaaaaccggtttaacgcacatcgtgtaacactgaatatgacgaactgactaaatattaaagatgctccaccaacaaaaaactaaaaaacccacaatcgaggatctgaaaacatatattattcgaaatgaactctccagtaaagaacatcgctgtcatcccttaaggatatctaatcttataataaataaattaggttcatttattaaccnnnnnnnnnnnnnnnnnnnnnnnngtnnnnnnnnnnnnnnnngtacaccctcagggatgagactatatatatatagnnnnnnnnnnnnnnnnnnctattttataacttatcattagtattataaaactccatagggtctgctcggctattatatatttttatgcattattacttttatttgttatacattataaattaaaacatgactgtagattatttaaacctacccatcattatagnnnnnnnnnnnnnnnnnngtgtatttgctacaaatatataggggataataaacgagattcatgcaacatttttttgcgctgaggattaaaaacatgctcttttagtattagatatcgagtctcgcctgcccgctgattaattggaatggccgcggcattttgaccgcgctaaagtatnnnnnnnnnnnnnnnnnnnnnnnnnnnnnnaaatgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnnngggggtgactaaaaaactannnnnnnnnnnnnnnnnnnnnnnnnnnnnnnnnnnnnnnnnnnnnnnnnnnnnnnnccattttttttggatataagaaaataaattacccttagggaaaaacaggcgaattttttttttggagaagttcaaatcgaaaaaaaaaatggcgcgcccccccgcctgggaataaagatctattaatttggggg

SEQ ID NO: 10637 - DNA, 935 bp, Diabrotica virgifera
  misc_feature (3)..(3): n is a, c, g, or t
  misc_feature (9)..(40): n is a, c, g, or t
  misc_feature (44)..(921): n is a, c, g, or t
tanagtccnnnnnnnnnnnnnnnnnnnnnnnnnnnnnnnncttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggattaaaaa

SEQ ID NO: 10638 - DNA, 932 bp, Diabrotica virgifera
  misc_feature (146)..(164): n is a, c, g, or t
ccttttacgtccggcgcatcagttagagtgagtttggcaacaacgctagacccgctcttcgtaattattatcgtattctctagtcaatttttttgaaataattagtgactaaaaaactgaaccaaaggaattaatacagtgctgtnnnnnnnnnnnnnnnnnnntaaggtgttaaaaaactataaagtgattgtgactgtttttaacggcctcaaaatagctattttcggatttacaaaacggagccccgatacaaaaatggtgggcagtaacggcacaatgattgcaattcgtcttgttcgcagcaaactcagaaagagggaagaacacagcaacagcgttcatcccaccgatgtggtcctgcaaactaccccgaatgcaactcaactcaaccaccagaatacatcaccccatattctccaatcggacttgacctaccgaggacagtttctatggacgcaacctccaccacctgcgaatcagtacccgtacaatcacaatcaggatacgcttgtacaaaattctggggaccgtccaggattcgtccgaggattcaggaaaaaccttggaggaaaatggagacgtcttgtgaaaaggaagccttcccaggaagtatacaccattccagctgagttgaagcctcaactcaagcaaatttacgtttattagccttaatacaaaccgattggctgtcgaatagtcaattggatccaggccctacgaatgcggagcccttccttaatgagactgattttttaaactaatattactcctcgcgaataagaagagtaaccttagtttatgcgatgtaaatatttgactataggttgtaatacttacgccatacattatgtagaattataaattttacaagagtagaacaacttccgattatctgggagatatgttaatactttttataagtttaactc

SEQ ID NO: 10639 - DNA, 851 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (445)..(445): n is a, c, g, or t
  misc_feature (476)..(496): n is a, c, g, or t
  misc_feature (634)..(683): n is a, c, g, or t
  misc_feature (688)..(796): n is a, c, g, or t
  misc_feature (799)..(844): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngacagntttttttttcatccaacccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcagcc

SEQ ID NO: 10640 - DNA, 936 bp, Diabrotica virgifera
  misc_feature (358)..(379): n is a, c, g, or t
aaataaaatttgatatctgatggttgagttttagttttttgactatccagagcattttatgaagaataactttttttcgtaaaattgataataaaaaagtttccatgtggttcctagctacgcagacatactgtataagagcttctgtataagaattttcaaattgcaataccatattcggattcagtataatcaaaaacaaaatacaaacatatttgatcaaagtaaaatgatgaatttcacgatatttttgaaattattaatacaaaacaattgttattgtttaaacaattaataaacaattagcggccaaatctgcgagtagaactttttactttaacatgtatataaactaacnnnnnnnnnnnnnnnnnnnnnnaagcttgtttgaatttttccgaaacaatgcatgttttagttctaattgcactcccctataaggaaaatacttagtatgattgttgcacccggtataaaatgacatttacctgtttagcaatagtattattacattatttcttacataatggggctataacatactaaaaaaatcactcaaatcggacagcaggtttgggaaattcgagacatctaacatgtcccatttttaaagtgttccgttaattttgccgcataatgtataaaatggaatgaactaatagttcaaaaatatcaaatattttagacttaatctgtaacccttcagatctaccgtgttcgtgtaagatatattgattttatacaagaattagttgcttacaggggtctaaatgtatactattttccttcgctttaacttaaacatgatttctttggatttttagattaactgtgcattggaccattttggctattcatttgacgacgtttcggaaagatcttacttgccgttaaaagatatcttcagattctagcatgttattacacatgtttttt

SEQ ID NO: 10641 - DNA, 429 bp, Diabrotica virgifera
  misc_feature (3)..(229): n is a, c, g, or t
  misc_feature (232)..(245): n is a, c, g, or t
  misc_feature (258)..(337): n is a, c, g, or t
  misc_feature (340)..(365): n is a, c, g, or t
  misc_feature (367)..(412): n is a, c, g, or t
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnaagacgagagacnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnncnnnnnnnnnnnnnnnnnnnnnnnnnnnnnnnnnnnnnnnnnnnnnncctccaaattttttttt

SEQ ID NO: 10642 - DNA, 206 bp, Diabrotica virgifera
cccaagtagtgttccttttattctaagtttcctttcgaacagatgcattcactttatatcccaaatatcagaaagtttaaggaaagagaacggagttccaacgatcgttcaactcaccatttgtgatttctattccgagtaataagaagtgcgatctgcgagatgatcgctattctactttttggtctattcatgtgtattttcat

SEQ ID NO: 10643 - DNA, 383 bp, Diabrotica virgifera
  misc_feature (54)..(68): n is a, c, g, or t
cctatttctagtttaattttaattgtgtgtgcattggttagtattgcttttttnnnnnnnnnnnnnnntacagtattatgttatattcagattcgtaatggccctaataaagatggatttttgtggttatttcgcccttgtggtgatgcaattaagattatttactaaggaacagcactgatcctgttatatcgaattctaatatatattatgtttctccaattataaagatcttaatacatttgtatttacgagtgagtataccttatattactatatctgaaatatgacaataccacaatagaactttgtatattaggttctacttcttcggctctatatgttgatattgactgcggatattatcgaaatgctcttagtga

SEQ ID NO: 10644 - DNA, 658 bp, Diabrotica virgifera
  misc_feature (50)..(75): n is a, c, g, or t
  misc_feature (218)..(244): n is a, c, g, or t
  misc_feature (400)..(420): n is a, c, g, or t
  misc_feature (541)..(558): n is a, c, g, or t
tttttcattttcaaattaatttaatcgactagtagactatttactagaannnnnnnnnnnnnnnnnnnnnnnnnntttacaatggaattataaatgtacttgagttctactaccaaaagctcagaataacaataaaaatagtaaggaataaatagtgaaatagtgaaacaaagatgtacatgagaagtggctactacgtaaggtggaaatatccagcnnnnnnnnnnnnnnnnnnnnnnnnnnnggatgtcaagtttgtcgaaaatatgtattttttagtttctgtttaggactaaccttttcctgtatagttccacctaaatactatcaagtttttaaatgcttataggttccgtattcaaaacctattttgtacttattttcaattgaaacaaacacnnnnnnnnnnnnnnnnnnnnntacttctaggcaccgggtttatgtataaaaagtagtacatacagtaacaataagttctaaaagtacaatactgataatggaatgttaaaataaacattcagaaggaaaatatatcggcacnnnnnnnnnnnnnnnnnnttgaatgtagtactgtctaccttgtttatctattttgaatgtgagttaaagagttgtactgaatctatgaaatcgatatatttttcttctacaactggac

SEQ ID NO: 10645 - DNA, 461 bp, Diabrotica virgifera
  misc_feature (170)..(191): n is a, c, g, or t
  misc_feature (211)..(231): n is a, c, g, or t
cttcgacccgtttgccggcgttagcttgtaccttattgctgcaaccagcggtacgccctcttgagactgagactaggacgattcttactatgattataccactaatttttattgaaatatactgaccacctgtccagccatggatgcatgacgcatttgaattgaatccnnnnnnnnnnnnnnnnnnnnnngagagatgtctctcgggacnnnnnnnnnnnnnnnnnnnnnctatacggcgcgacggttggccttagaaggacgaggacacaaagctatggaggctaccacataaaccgcctctgaatatgattttactcctgaaggtgatactatttggtacctcttatttatccactggtttccagacatctctagtatgcgtcacatggatatgacgtctctgatacattctgtctctggcactgaattactcgttaaactctttccatctacgctgc

SEQ ID NO: 10646 - DNA, 914 bp, Diabrotica virgifera
  misc_feature (14)..(681): n is a, c, g, or t
  misc_feature (688)..(725): n is a, c, g, or t
  misc_feature (761)..(783): n is a, c, g, or t
  misc_feature (791)..(814): n is a, c, g, or t
  misc_feature (844)..(875): n is a, c, g, or t
  misc_feature (887)..(911): n is a, c, g, or t
cctcctgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatggtggattagagtttataattggnnnnnnnnnnnnnnnnnnnnnnntgttcgannnnnnnnnnnnnnnnnnnnnnnnagtttaaaccggtgtgagccaggttggttnnnnnnnnnnnnnnnnnnnnnnnnnnnnnnnngaaagaaccaannnnnnnnnnnnnnnnnnnnnnnnngat

SEQ ID NO: 10647 - DNA, 277 bp, Diabrotica virgifera
  misc_feature (7)..(58): n is a, c, g, or t
  misc_feature (119)..(138): n is a, c, g, or t
ggtagannnnnnnnnnnnnnnnnnnnnnnnnnnnnnnnnnnnnnnnnnnnnnnnnnnnggaacatgcatttattactttatatagaattaaacatagccgggtaacaacgcattaaggnnnnnnnnnnnnnnnnnnnngatcgaaggatgaaggattatcttgtatatgttgcataattggctactgatgttactcaaatgagtatgtatacaggtaaaaacaaaatgaagaattattcatgccaatagatagcgcgtgctacagctgaatgctgaa

SEQ ID NO: 10648 - DNA, 815 bp, Diabrotica virgifera
  misc_feature (260)..(275): n is a, c, g, or t
gcttccacgaatgtccataacgcaatgtttagaaaaattattagctcaccgatgctgttctttaatagtaatccatctggtaggattttaaacagattttccaaggatattggtattttagatgaattgctaccgctagcgactgcagactcaacatgggtcggccttactgtagtggctacaacaatagttattagtcttttgaatccttggatattgatacccacggctgttattgtttgtattttttacaaaattannnnnnnnnnnnnnnnatccagtagaaatattaagcggatcgaagctgtcactcgaagtccaatttttacccatttagcagcctccctacagggacttccaacaataagagcatttggagcagagcagattctcacccaagagtttgataatttccaagatgcctacacctcgtcgtatttcatgttcctaactgccagtaggggctttggattctggttggacttgcactgtgccttttatattagccttgtcgtcatcagtatagtttttttcccaaagtggttcattgggaggaaatgtcggtctttcactgactcaagcaattacattatcgggaatgttccagtgggtaatgcgagaatggagcgaactagaaaaccaaatgacttcagtagaaaggacacaagaatataccgacctacccatagaatcagataacgagagaaaacaacctccagcagattggccaagttcaggaagcctaacgttcaaaatatgagtttgaggtactccttggaagctccttgtgtacttaaaaatcttaatttcgagat

SEQ ID NO: 10649 - DNA, 183 bp, Diabrotica virgifera
  misc_feature (6)..(27): n is a, c, g, or t
  misc_feature (48)..(181): n is a, c, g, or t
taatcnnnnnnnnnnnnnnnnnnnnnnggaatggaaggggttggatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntg

SEQ ID NO: 10650 - DNA, 666 bp, Diabrotica virgifera
agaagaactcaacgttgatttgtacggatctaccatggaacctgccaataaggacatcacggatgccaagatggaaaaagctcttatacacaatctagagctgagagttgtgtctactgggattccccacgaacggatattgtctgaagatttcttcgatggtatagaattgaacaattcaatgaaacccgatgatgctgccgcttatgatgcatccgtcctagtctgcatcttgcacgtatataagcctgaagaaattcctgacttgatcatgctcgatgtcactcctctctcattgctaattgaaactgccggtggtgctatggctgccctcatcttacgtcacttaccatatcccaccctaaaagccagagcttctctactcactctgagtaccaacccgctatacttaatcttgtatatgaatgtgaactgggcatgacatcagacaacaacctcttataaaaattcgaactgactgtatttcctcctgcgccgcgaggagtctctcacactgaacaatgctccaacattgatgtcatatgcatcatgaacattatggttcattgatacaccaacttgtttaaatacaagatcatcatcagctatgatattcgacgactcagacataataacgttgtaagaatgttcatcgatgatgaataa

SEQ ID NO: 10651 - DNA, 266 bp, Diabrotica virgifera
cgccaatgttgaaggagatgtgttgggacacttttagaaggtaggaggccccttactggctctcgcataaacaatataataacattagtagatgaagctatactatcggacgaagaaggcccattacgagcacaaatcgaaaggaatatatgctactgatagagaaacagtactcatttacatgagtcacttccctgagatgacaatgaccatcacgtccgagtcgagagaacatgcggagatcgcagaaagcctaacgaaatatt

SEQ ID NO: 10652 - DNA, 402 bp, Diabrotica virgifera
  misc_feature (2)..(17): n is a, c, g, or t
  misc_feature (19)..(32): n is a, c, g, or t
  misc_feature (72)..(129): n is a, c, g, or t
  misc_feature (171)..(189): n is a, c, g, or t
  misc_feature (198)..(229): n is a, c, g, or t
  misc_feature (256)..(274): n is a, c, g, or t
  misc_feature (315)..(333): n is a, c, g, or t
gnnnnnnnnnnnnnnnnannnnnnnnnnnnnngtcattaggttttttattgtaagctggaatgaaggggtgnnnnnnnnnnnnnnnnnnnnnnnnnnnnnnnnnnnnnnnnnnnnnnnnnnnnnnnnnngtttaaattttggattaaatgaaagtaccctatagaattccnnnnnnnnnnnnnnnnnnntataaaagnnnnnnnnnnnnnnnnnnnnnnnnnnnnnnnngtccgaataaaagacgaattaaactcnnnnnnnnnnnnnnnnnnnattaaataattattgatttctcttggccggttcttttcaannnnnnnnnnnnnnnnnnncttaaggaggggggctattttgcaaattgaaaatttaatcttcttcataaaacggcggggcccctccag

SEQ ID NO: 10653 - DNA, 260 bp, Diabrotica virgifera
  misc_feature (200)..(249): n is a, c, g, or t
agaataaattaccttaggggataacagcgtaatttttattggaagagttcaaatcgattataaagattgccgacctcgatgttggaattaaggtttataattggggggaagcagctataattaattaagtctggttcgacttttaaaaatttttaacatgaatcctggagttttaaaaccgggggggggagccccgggtnnnnnnnnnnnnnnnnnnnnnnnnnnnnnnnnnnnnnnnnnnnnnnnnnncgaaaaagggg

SEQ ID NO: 10654 - DNA, 992 bp, Diabrotica virgifera
  misc_feature (845)..(845): n is a, c, g, or t
  misc_feature (875)..(875): n is a, c, g, or t
catgacaggccctcaacagagggtcctcagcggataccacgcccttagcggactaaaagcacctcccggggtagaacatttcgaagatgttgtccacaaaaaatgttccaacttcactttaccggaaatccaacacaatttagatttattagttgacatgtgcgaacaagatatcataaggatagacagaagtagtcgtttaaacgaagataaaatagtggcactcgaacaggaagaaaaaatgttacgggatgtattaaataaagagggcgaattgatggaaaacatacaagaagtaatatcagttgtcgataaattaatggatagtacgcagacatactctttgggacagattgccagtatttttaaagaattgcaggataagcactcagaggaatatacaatgtatgaactaggcgaattggcccccggcctaatcggccctcttatcacatcggctttagccaattggaatcctctattacagcctcaccaacatgtcgatgtatttaagcaatggcaggatatcctgacgtcacagcaccgtgggaatctagaaggtaataaaatgggaatacagccatatgatagtttcatttggcatacttggatgcctgttatgagaacttgtgttagttcttggagtccacgtgattgtgatcctctgataaccctactagaagcgtggaaaccagttctgtcccaatggatattagaaaatgtactcagccaattagtactcccgaaaattctaaaggaagttaacgaatggaatcctctaaccgataccacccccatacatgtttggatccatccatggatacctctgttagatgacaaacttncatctaccatatatccagtgatttcagaanaattgggcagcgcattagaaactggcatccgtctgacaggtctgcgaaagtgatgctacagccgtgggcagaagagtggtgacgaaaggaagcttcgtagcatttttacttaaacat

SEQ ID NO: 10655 - DNA, 249 bp, Diabrotica virgifera
  misc_feature (3)..(99): n is a, c, g, or t
  misc_feature (101)..(165): n is a, c, g, or t
  misc_feature (174)..(232): n is a, c, g, or t
  misc_feature (234)..(248): n is a, c, g, or t
acnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnttttattannnnnnnnnnnnnnnnnnnnnnnnnnnnnnnnnnnnnnnnnnnnnnnnnnnnnnnnnnnannnnnnnnnnnnnnnt

SEQ ID NO: 10656 - DNA, 935 bp, Diabrotica virgifera
  misc_feature (37)..(66): n is a, c, g, or t
  misc_feature (881)..(881): n is a, c, g, or t
  misc_feature (917)..(917): n is a, c, g, or t
gtgagtggtatcttgatcttgtatccaaaatccaagnnnnnnnnnnnnnnnnnnnnnnnnnnnnnnggaagataaacaaaaactacgtgaatgtaacattaataaccataaagtagatatgtctctatctgaccactgttgttcagatgatattaaaatagaagacgatacattaaaatatgaagttactgataatactatggaagatgttaaggtagaaataaagagtgaaatggaggaatataacgtaatttatgatgaaaaaccttgtataagtggaaaaaaatcaagtttactgtccaaattaagcatagaaagatttctcaagagagagcaaggaatagaaattgtcgaaacagtatctgagatttcatgtaaggaagaacatgtgaatgagcagcctgaagaaaaaacaataaacagtgctatacatttttttcgcccttttaaatgtgaaatttgttctcaagaattttccaatgcagttcaagtagaaagacatatgagaacgcataatggaggaaaatcttttagatgtgaaatttgtttcaagagcaagcgcttttctcaagcagatgatttgcaactacatatcagaacacatcataatcgaaaaaaaccttttaaatgcgaaatttgttctaagtcgtttgttaaaaagactaatttatgtaaacatatggaaatgcattcagaaagatttaaagataaagtaaataaaagatttcatgattttggtgatttgacaaaacatttgaaaacacataatggagaacacctttttaaatgtcacatttgttctaaacagtgttcccaatcagacgatttaaaaaaacatatgaaaacacatactgagaaaaaccttttaaatgcgaaatttngtcccaagtcgtttggtaaaaagactaatttatgtnaacatatggaaatgcatt

SEQ ID NO: 10657 - DNA, 945 bp, Diabrotica virgifera
  misc_feature (22)..(46): n is a, c, g, or t
  misc_feature (780)..(797): n is a, c, g, or t
taatcataaagatattggaacnnnnnnnnnnnnnnnnnnnnnnnnngcaccattgttatatatcttcataaaagagattttagcattactaaatgaagccatcccatccgacgataaatcctcaatacttagcagacagagaaaatgacatagaaatgcaacaaacactaacacgtaacctgagacccttcctttagacatcccttactataagctaggactctagggaattgcgaaagagacagaaggccgaactaggtagtcgcaccaagaagaaattgcccctatcgcagctgaggaggaccgcaggagcctttagaaccccctcaaatctactgagcgatgtacggcaaggaactgataattccttattaaaaataggaatcagaaccatgcgtgaagatgatgccaataaaacaggaaggacgaggctgctcagcttacaaaagattcgactccgccatgatctacatagacactggctaaatattatattagagccttattggtgaagctctagaaaattctgaagacatatgtgaggcagatgacattatatggctctagggcgacaaagtacctgagtgcaccggtgatgcccttaacagtaacccaggtccacagattggaagatatttaaaggacaggcttcatataacctttctacagctacatctggattacccagttaacaataagaatccagacctaagattggacccgtcccacaatattcatatactgaataaaactgcgtggaaactttaaataccacggatnnnnnnnnnnnnnnnnnntgagcgcatccaatcatatggaacttacaatttttggtaataaatatcaaagtctttttaaactttaccttatataaccatacaaaacatcatcttttttgtttccacgggcggtactaaaccggcattatcatttgccttgcctcac

SEQ ID NO: 10658 - DNA, 70 bp, Diabrotica virgifera
  misc_feature (3)..(69): n is a, c, g, or t
gtnnnnnnnnnnnnnnnnnnnnnnnnnnnnnnnnnnnnnnnnnnnnnnnnnnnnnnnnnnnnnnnnnnng

SEQ ID NO: 10659 - DNA, 763 bp, Diabrotica virgifera
  misc_feature (2)..(50): n is a, c, g, or t
  misc_feature (52)..(657): n is a, c, g, or t
  misc_feature (667)..(731): n is a, c, g, or t
  misc_feature (739)..(760): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggagnnnnnnnnnnnnnnnnnnnnnnnnnnnnnnnnnnnnnnnnnnnnnnnnnnnnnnnnnnnnnnnnnaagcctannnnnnnnnnnnnnnnnnnnnnacc

SEQ ID NO: 10660 - DNA, 431 bp, Diabrotica virgifera
tgctgagagactgctacgagatgaaagaactgacggcgagaatttgcatggattaccctttcttcccctgaacgaaggtcaatgccgaaaacgttgtattcacgcatataagacggagtcgctctcctaccaactgtcccacgtctcacttccggactcgcaatattgtatgaggtcaactctcagcaagaacccaaagacgttcagatccgagtctatgtacacacccaaggagaaggaccattgtaagtactcatcgccgcatccgaaatcttctccttattctctgaacataatttatgaccagaactgcgcggagatttccccggaggaagaatcgataagaccatcgacgccatacctcttgtatcataagactcgtataacgccacgactgactattaaattgccttacaactggtagatattca

SEQ ID NO: 10661 - DNA, 434 bp, Diabrotica virgifera
  misc_feature (321)..(338): n is a, c, g, or t
ctattttgtatgttctgctgtaattcaataacaccatgtgcatcaaaatctagtcaaataaaattggagaagtctggttaccttcttttggcacttggcttcagctttttttttcgatatgaaatattggtaattgtgacaaagtttttagataaaatatagcatcattttttctgatttaagtcagaacaaaaatagctgtattctccccggttgcctttattaccaattctgcgaagtactatgacaacacttttaggactttcagtgaacgactaggattcagtaccagatggaaaaatggaatcatagccttcaccnnnnnnnnnnnnnnnnnnattctttcttgacatgagacgattatgataccattcacaacattgaatacgtagagcgtttgcacttgttggagagctaatgattcatgattataa

SEQ ID NO: 10662 - DNA, 749 bp, Diabrotica virgifera
  misc_feature (11)..(11): n is a, c, g, or t
  misc_feature (356)..(375): n is a, c, g, or t
  misc_feature (651)..(668): n is a, c, g, or t
  misc_feature (670)..(682): n is a, c, g, or t
  misc_feature (708)..(725): n is a, c, g, or t
cccttcgcggnccgaagaaccaaggagatcaacatggcgtccactttgagggcacctactgcaagagcaatcacagatggtccgcattgaagagagaagacctggtgcttttacgaggaatgtgcattctttgatcctctgcggtcaccagctgctgatgattaatcgatgcattgagtatttaccaagtatgccgaggtagtaaatgaattacgcattctgtaagagatatatgtttaagcaactgttttgcacagatctgctgttccttcgtaaataaatccaagtttttaacaagtttattaagtttattaattgcccctacatccatacataaatatgcttgatatgactcnnnnnnnnnnnnnnnnnnnnagagctcgagactgaaataattattagaagttaatttctaaagacaaattagcattagaaattttcgtattttaaaagatcggatcattcatttttatatattactatttttatgtccttagaagtattctattataacatacttgcagattatttatatgtattaatgatgatgatattatgagtcgaagattgtacatttactaaaaatatataggtataataaaggaagtcggccgcattattttcacctgtttattacaaacttgtgtatcnnnnnnnnnnnnnnnnnngnnnnnnnnnnnnncttaacatgaacggccgcgctatgannnnnnnnnnnnnnnnnntaacccattactttttgtattgaa

SEQ ID NO: 10663 - DNA, 953 bp, Diabrotica virgifera
  misc_feature (840)..(840): n is a, c, g, or t
  misc_feature (854)..(854): n is a, c, g, or t
  misc_feature (863)..(863): n is a, c, g, or t
  misc_feature (917)..(917): n is a, c, g, or t
attcaaatatagaaataagatggctaataataatcataagtttgaatattttgttcaagaatatcctattttgtttgaaaagaataaggtaccagaagtgtggcaagatctgatggctactgttttcaacaaccaattcgatagtttaaaaaatgtagctttacatttaaaagaagatcaaaaatggtatccatcaagtgacaaaatgtggaattttacgaacttttgttgtcctcaatgtattaaagttattatagtcggtcaagatccaacttctgagcccactggtttggcattcagtagtagaggtaaaatttataattctacaataaatatattaaaagaagttaaagccgatatcggtatacaaaaccttagaccagaatttcaaggagattatggaaatctagaatactgggctaagcaaggagtacttcttctaaattcaactctcacaaaacgtattggtgacgactcccatttcaaaataggttggaaagggattactggggaattgattaagcaactacacttcaataacgaaaaattggtatgtatgttttggggacagcgcgccaaagacgtaattaacttatgcaacgtcctaactacaggacatccatctagaaacccaaagaaaaattttttcggatgtaaacatttttcacaagctaataaatggctaaaagatcatgatattgctgaaatagattggtgccctgttcccaaaacatgtcctattccaactacatgtgtgcacttaagtggtgattcaagtgaattggataattcaagaaattacatggctaataataatcataagtttgaatattttgttanagaatatcctattntgtttgaanagagtaaggtaccagaggtgtggcaagatctgatggctactggttttcacaccnattcgatagtttaaaaaatgtagctttacattttaa

SEQ ID NO: 10664 - DNA, 919 bp, Diabrotica virgifera
  misc_feature (34)..(34): n is a, c, g, or t
  misc_feature (206)..(245): n is a, c, g, or t
  misc_feature (263)..(310): n is a, c, g, or t
  misc_feature (312)..(379): n is a, c, g, or t
  misc_feature (381)..(680): n is a, c, g, or t
  misc_feature (682)..(720): n is a, c, g, or t
  misc_feature (722)..(849): n is a, c, g, or t
  misc_feature (861)..(915): n is a, c, g, or t
cccttaggggccgcaacatgaaggataacttggnactaaccgcttttgccacgctatgcgcagccaagccgacctttctgctcgactcccttgagattccaaggaagctaaaggacttggtctaggaaatgtgagcagcggtgatgaagacgcaagaaccatgtacgtacgattctcgaatgaagaagatctagaagattacaacnnnnnnnnnnnnnnnnnnnnnnnnnnnnnnnnnnnnnnnncgaaatgctattcgtacnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttacaaatcnnnnnnnnnnnnnnnnnnnnnnnnnnnnnnnnnnnnnnnnnnnnnnnnnnnnnnngggg

SEQ ID NO: 10665 - DNA, 1044 bp, Diabrotica virgifera
  misc_feature (3)..(695): n is a, c, g, or t
  misc_feature (697)..(792): n is a, c, g, or t
  misc_feature (796)..(812): n is a, c, g, or t
  misc_feature (814)..(880): n is a, c, g, or t
  misc_feature (882)..(972): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacannnnnnnnnnnnnnnnngnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaggggaaaacaggggatttttttttggggaggttcaaccccaaaataaaaaatggggccccccatgggg

SEQ ID NO: 10666 - DNA, 884 bp, Diabrotica virgifera
  misc_feature (339)..(356): n is a, c, g, or t
  misc_feature (476)..(496): n is a, c, g, or t
  misc_feature (560)..(583): n is a, c, g, or t
  misc_feature (710)..(728): n is a, c, g, or t
  misc_feature (769)..(792): n is a, c, g, or t
  misc_feature (860)..(882): n is a, c, g, or t
cccacgcgtccgccgagtcctaaattttccgaagagagactaactcgtgtctactccttcattcgtttgtaacgctatctctgcaagggccgtatatcactcttcttcttcttcttgtaataggacttatatcactcgaaggattttttgttcccacaccagcaatttgttgtttcgcttaggagatggtctagtgatttcccgagacttattgtttacctagcaatttcataatatcattataaatgatctaaatgtctatttgtgataatatctgttgaatcacatgttagagttaaatttatctgcaaaataacgtttttcatctcaaaaaatagnnnnnnnnnnnnnnnnnncaatttttatctgatttggtgtgtattgttcgatataaatgtatttaactaatatattgatattttatacatatattagtttattttactcgttttcagtctaaatttcgaattttatcnnnnnnnnnnnnnnnnnnnnngattagttaattgaatataacttccgaataggtataaaaacaatcctcagataattatcagctnnnnnnnnnnnnnnnnnnnnnnnncgttattaatctgtattaactatacatgcagatatttaaaattatgaattttatcattattcagaagcataacgagacctgtactattttttaaacattagatagattaaagtgcagttgtattttnnnnnnnnnnnnnnnnnnncagtgacatttacctatagtttatactaaaattgataatgnnnnnnnnnnnnnnnnnnnnnnnntttataacgaattcaattcaaatttaagatgtgatttcatccaataatgttaaaaaacatttttatcnnnnnnnnnnnnnnnnnnnnnnngt

SEQ ID NO: 10667 - DNA, 854 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (406)..(420): n is a, c, g, or t
  misc_feature (422)..(438): n is a, c, g, or t
  misc_feature (441)..(459): n is a, c, g, or t
  misc_feature (474)..(494): n is a, c, g, or t
  misc_feature (632)..(681): n is a, c, g, or t
  misc_feature (686)..(789): n is a, c, g, or t
  misc_feature (797)..(846): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgtctttaaaaaaatttaagctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatccnnnnnnnnnnnnnnnnnnnnnnnnnnnnnnnnnnnnnnnnnnnnnnnnnnctcatccc

SEQ ID NO: 10668 - DNA, 1292 bp, Diabrotica virgifera
  misc_feature (554)..(583): n is a, c, g, or t
  misc_feature (815)..(839): n is a, c, g, or t
  misc_feature (947)..(970): n is a, c, g, or t
  misc_feature (972)..(1011): n is a, c, g, or t
  misc_feature (1045)..(1079): n is a, c, g, or t
  misc_feature (1101)..(1124): n is a, c, g, or t
  misc_feature (1160)..(1181): n is a, c, g, or t
  misc_feature (1217)..(1249): n is a, c, g, or t
caaaagtaggtttctagatttatttatacggacttctgattataaaattaacatattctgaataaatcaacatttcttgaaacaaaaaataatatgaaccgacttatttattactgtaaaaggtgataggttacaacaaattaatttagttgatatttagaaaattcgcatgtcagctgattgttaataaatatttaggttaccattacttatgtaacaaaaatcgttatatttgtgtgcagtggatattcaattaccaaaacatttttctattgactatgtttcgtggaaattattttaattatcttgctcatattcgtatactaaaaagtatttcttaaacacattgtgtatttatagcaaatgtagcaatttttaattctaaacttcagaagttaaaatatgtgtattatcattatttttagagtaatttataaacaaaaatcaaataaactaagcataacagtttattcagaagagccttcgaactcaaaagcttttggtttggagtattattacaatgataataataatatggacgtttgtcgctagcnnnnnnnnnnnnnnnnnnnnnnnnnnnnnngataatgataacccctctactaatgaaaaccatttttatgatattcaaccaatatgtttagtaagagatattaggaaggaagaaaacacaaaagtttataccgaattaaaaccgctaccattaattgatggaacaaaggatggtagtcaaaatgatacggatgttaataatgaatgtcacaaagaaaaatcggttgatgttatagacgtttgtcagcataataaaggttacnnnnnnnnnnnnnnnnnnnnnnnnncaatttagaccaaacctcatactgttttaaatgacacaggttgacgatgactcaagatttagaccctaatttatgaccccacaaggaattctgaagaaataaagttannnnnnnnnnnnnnnnnnnnnnnngnnnnnnnnnnnnnnnnnnnnnnnnnnnnnnnnnnnnnnnnggaaattgggccctggtattgaaaaaagaaaggnnnnnnnnnnnnnnnnnnnnnnnnnnnnnnnnnnncagggaaactccctgcccgggnnnnnnnnnnnnnnnnnnnnnnnngggtttccaattaaattaaacaaaatatcttactcnnnnnnnnnnnnnnnnnnnnnnccagggagaataacacccgatgaagaggaaacccgnnnnnnnnnnnnnnnnnnnnnnnnnnnnnnnnnaacctcccccaaaaacaaacaaattgttggaagggcgcccctt

SEQ ID NO: 10669 - DNA, 491 bp, Diabrotica virgifera
gatttgtgcaatcatgagggaacaatttttttcgtcctaattgcttgtattctatcagctgttatagctgatgtagctcaacacctcaaagctagcagcatagtccaacaatgtcaaggtactgacggaccagtaaacttgattaaacagatcagaagtggtcagaagctcaatgtggaagaagctggccagattgccctttgcatgaacattaaagccggtgttatgaacgagaacggtgacattctgactgataacttaaagcccaagttagaaaggcgtctgggaaactctaaagcgacaaacgttatcaacgattgtggaacgcgtaatggaaatagtgccaaagaggttgcgcttaattttgttaaatgtatgcaaaaatatatttaggaatttttgtgtaactgacgttcacaagattttgtaaataacacaatattcaaataatactgtaaattatttttcctaattgtcattaattagaatat

SEQ ID NO: 10670 - DNA, 596 bp, Diabrotica virgifera
acaaatttgcgatgattctaatggccttatcgcccagaccagaagtcgtcagaatatgtagcattttttcatggcgaactttatcaaaagccttgtcaaaatcaatcttgcacatgaaaacgtcacgatttacatctttggattaaaacggttgcaaatagtgtatcacgctttacaaggccacagcgaaaaccgaattgagagaaaaattttcaaaacatgacttattaggctgatggtgcgatgaaatatctacttaaggacatatagtgcagtcaccaatggtggatatgagctattacctccgatttcgttgaacccccatcgattttcatgaaaattggtgagtgggtagaggatacatcagggaacaaaagtgacacggtgccaacttcgctgttgcgaaattttaaaactcactaaactacgatagatagttatgaatctttcgtggcgcactatggcgattgccttttcagaatccaagaagaaagaaaataccggactgttcacttccttaactctttgaatcggaacctgtgttaggccgagattactgtggatcagtaccgaatatatcaccgtggatgagaacg

SEQ ID NO: 10671 - DNA, 449 bp, Diabrotica virgifera
cgcccgctatcttgaacgttatgtttatttacatcctaattgctagaattcaatcatgtatatgcgagagagcagctcaataccatctactgctaactgcatactgctacaagggcaatggattgactcttcactactgtaggattatctgatagaaccagcacaaaatctcaacctagaataagctgctcacagagaccattataggaaaatgaagatcgaggaagtgaatcataccctggagattcagactgatgcttgactactgcgctttaaaggcccggaacatttctagagcgacttgcgttctattcgatagtgtagctcgtgatgttaaaatagactaagggagttccgcttaaactgcttagtgtgtacgacattataatgggaaatttagaatatgttacgtttaaagaaattataaaagctcgagatttacagagtac

SEQ ID NO: 10672 - DNA, 725 bp, Diabrotica virgifera
  misc_feature (5)..(512): n is a, c, g, or t
  misc_feature (519)..(556): n is a, c, g, or t
  misc_feature (576)..(589): n is a, c, g, or t
  misc_feature (592)..(614): n is a, c, g, or t
  misc_feature (622)..(644): n is a, c, g, or t
  misc_feature (674)..(699): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttgtttnnnnnnnnnnnnnnnnnnnnnnnnnntagtacgacaggagcaaatatataaa

SEQ ID NO: 10673 - DNA, 403 bp, Diabrotica virgifera
  misc_feature (345)..(362): n is a, c, g, or t
gcatatttttctttattataagatatgaacctcttgtctagcacactctttgattgatatacttcaatgctagatcattactatagatcaccgtatattatacattttacaatcgtctattgtactgtaggtgaaaccagccgataaaacgagattcgacatcaataagccacaaatgatacgtctaaaagaggagaaatataacattactgaatatgatagtacatacgtatggtaggaacttgaatgatggccgcactgcgttttcatttgtgaatagatttccattatgagagaaaacaactacctctatgcggtactaccataatgatacttatctgatgnnnnnnnnnnnnnnnnnnccctagtataatacaaaacctcataaatcctacattgttaa

SEQ ID NO: 10674 - DNA, 932 bp, Diabrotica virgifera
  misc_feature (424)..(458): n is a, c, g, or t
  misc_feature (752)..(752): n is a, c, g, or t
aaactagtccgccacagatcagcgtcgcttcactgtgtgggacttctgtttttacacaaaaatttactttgctttcgtgtcggtttgcaagtctagtctgtgctagttaattatttctgtgaatttttggtactcctgctgtaatggaacaaaaaggcaatacacaaaatactaaataccttcatcctttttatcatggattaaggaatgttcctgaaggaaggatcaaggaactacagaaggttagaacttgggttgcagcacaacctcatttacccgaagtatctgacgactacatttacgtctttcttagctcatgtaatttctcagtggaccgggccaaaagctgcatagaacattatttcaccatcaagactaatcatcctgccatatttggaaatagagatcctgaggatgacaaagnnnnnnnnnnnnnnnnnnnnnnnnnnnnnnnnnnnctaccaaaactaacaccagaaggatatagaatggttatgtacgctgttagagatggagatccaaccaaaatggttttcggtgattgcgtcaagacgttttgtatgttcaacgatattgttttatcagaggatggtatcgaagatgggtatattgtaatattcgatatgaaaggagtacagttaggccacttagcccgaatcagcttgccagctttaagatgctttttcttatacatccaggaagcacatccagtcaaaataaaaggagtacatgtactgaacactgcttcctgngtacaccatattatgcgaattgtaatacctttggtcaaatcagaacttctgagcttagtcaaattccacaaaggaaacatccctgaaggtctttcctttggaataatgccaaaggaatatggcggtgaaacatcttccatggaagattagaccagttacggagcacttatgggaaaatac

SEQ ID NO: 10675 - DNA, 415 bp, Diabrotica virgifera
caggcataccttagtgccactgagatcccggaagtcttaaccatccccttcgaagatgtcatcttccaactgacaacagttacaacaactcccttctcatcgacacatcagtccaccagagacaacacatctcatactccgcaaatccctcgcacctaactcaatacctgtcacgcactacgccaactcggctcgttgccgctacacctatgcacaagtctcttgacctcactaaaatgaatgacccttatccatcatcgtaactcgtaccacacttatcaaaaccctctttccaaatcaaccttcgcactaacgctagtcaaaccttaaaccccgcaactactccccccaacctacaactatttttatcatcaccaacttctctaccaaccgtatctactcaccctacctccat

SEQ ID NO: 10676 - DNA, 477 bp, Diabrotica virgifera
gaaatagaatttgataaaaattgaattttgaaatagaaattgggactgaagatggtcatatagttaggacgatgagctaggagactaggggagtagcagtgagttggagagagcaggggtagagtagaggagcgttgagagagaaagcccggatcggcggaggagcaggaggcgcagagaggatttagaatgccctagctacgcgagactagggtacggcgaggagatggcactagatggcacacgaatgggtatcaggatatagcaggaagtaggatgccagtaaaaagggaaggacgaggttgctcagcgttgtatcggaatggattcggccatgagagactaggggtcctggggaaattactagaaggaggtagaggggtgaagggtgagaagattcctgaaagatacattgcggtggagatgagtatggtatggcagtttgggggaggacgtagcagagatgtacggatgatg

SEQ ID NO: 10677 - DNA, 75 bp, Diabrotica virgifera
  misc_feature (2)..(53): n is a, c, g, or t
  misc_feature (68)..(68): n is a, c, g, or t
gnnnnnnnnnnnnnnnnnnnnnnnnnnnnnnnnnnnnnnnnnnnnnnnnnnnnataatttttgatccnatttttt

SEQ ID NO: 10678 - DNA, 900 bp, Diabrotica virgifera
  misc_feature (816)..(816): n is a, c, g, or t
atgagctagtacaacacactaaagatacgcactttttatccaaaaaggcaatcattgaatttttatactaaacccagagaaaatagcaatggatattgggtctcttttgcaggatacatgtccgggaaacctacagggcatatcaggatattttttcctgactttactcaacagtttattgagttccaagtgcaagttaggtaataccaacgactacacagaagactatgcgcccagattgaaagatggagatgagtttgactttatagtggtaggttctggatcagctggagctgtggtagcgaataagctaagtgaaaatcctaactggaaagttttggtgctggaagctggaggatatccatcagcaactagtgacataccaggacttgtatttagtggcttacgagaagactggcagtaccgaactgaaccctcttcacaatattgtctagggttcaaggatgggcagtgtatatggccaaggggcaaaggtctcgggggcagcagcattttaaatggcatgatgtacataagaggaaataaaagagattatgatacttgggagcaaatgggtaatacaggatggggttgggacactgttaaagaatattttaagaagttggaaaatatgcaagctaaaggtgttagtgaccagtatggacgggatggttatatgacgcttaacagatatccttcagatcaaccaattgccagcgcgttacatgaagccttcaaaaaaatgaagttacctctacttgatgaagaaaacccgacaaatcctctaggaatattgacatctttccaatgtattanagatggaattagattcaatacaggaagagcattttttgggtcaaagtaaaagcagatcaaaccttatgactgctttgcactctt

SEQ ID NO: 10679 - DNA, 938 bp, Diabrotica virgifera
  misc_feature (510)..(538): n is a, c, g, or t
  misc_feature (741)..(741): n is a, c, g, or t
  misc_feature (789)..(789): n is a, c, g, or t
  misc_feature (802)..(802): n is a, c, g, or t
  misc_feature (892)..(893): n is a, c, g, or t
  misc_feature (902)..(902): n is a, c, g, or t
  misc_feature (906)..(906): n is a, c, g, or t
attataatgtctacaccttatacgaggataatatctggcaaattttttgttatgttatttagaaacgatattagtcaataatagcatttgcatagcacaataaaggtccttatatgagagaaatttgcttaatatattgttagctttaacactctcccatatagacccaggagtttactatctgaatttcaaaatagcaattttactgtttattagcaaattaagcagcctaaaccaaagttcgaatagtataaaaggtaaataaaaataacagaaaacagaactatatctgtttgtttctgcgcctttcgattggtatcaatgagtgagcttcacttaactgcaagacttacttttcattatcctattcatcgttcagcctacctaattcgcggtcgcaaaattcttctagttcaaagccactttgtactttaaactactgcattttgaacaatttctctggctacaatcaaatattcaataaacttattcacactttcagtcatgagnnnnnnnnnnnnnnnnnnnnnnnnnnnnncttggaggttgcaatatttgattttttgtaaagatttataaacaacaaatttcgcccataaacattattatgcctagtgcaacatacagagacgatgttcgttgagacgatcacggtcattcaacctaaaaaatgggaattagctatctttggggcttaatagttaatgttcgtttaaacgaacatggtgactgaaagggtanattagtccaccagccacctgagctatcgaggtgactagaatacacaanagaaaaatcctanagctatcagagatcttagatagagataattagaaaacactgcgaaaaataaatatcataaaaacgccaaagcctaacctaatatatcttnngacaattgngatncatgtttttactattattgacactttcctgct

SEQ ID NO: 10680 - DNA, 318 bp, Diabrotica virgifera
  misc_feature (18)..(99): n is a, c, g, or t
  misc_feature (263)..(303): n is a, c, g, or t
aattatataattggcgtnnnnnnnnnnnnnnnnnnnnnnnnnnnnnnnnnnnnnnnnnnnnnnnnnnnnnnnnnnnnnnnnnnnnnnnnnnnnnnnnnncccttaggataaccgcgaatttttttggaaagttcaaatcgaaataaaaattggacccccatgttgggataaatttttaattgggggacaacctttttattaaagttggtttcacttttaaaaatttactgtattttgggtttaacccggggggggacccgggnnnnnnnnnnnnnnnnnnnnnnnnnnnnnnnnnnnnnnnnnccaaaaaggggcccc

SEQ ID NO: 10681 - DNA, 912 bp, Diabrotica virgifera
  misc_feature (300)..(328): n is a, c, g, or t
  misc_feature (672)..(754): n is a, c, g, or t
tattaataatttttaggttattttgtttactatcaaatcgttgtcaaaacgaatttaatagggcttttaaaaaaagtaatgtttattaaaacatggcagcagcaccaccacaggctttagtcaacaggaataagaaacattttctaggtgtaccagctccgttgggatatgtagctggtgtaggaagaggagctacaggttttaccactcgttctgatatcggtcctgctagggatgctaacgatgtttcggacgatagacacgctcctccagcagctaaaaggactaaaaagaaagacnnnnnnnnnnnnnnnnnnnnnnnnnnnnntttaaatgattccaattatgatgaattcagtggctatggtggatcattattttcaaaagatccttatgataaagatgatgcagaagctgatgctatttatgaagctattgataaacgtatggatgaaaaaagaaaggagtatagagaaaaacgtttaagggaagaacttgagaagtatcgacaggaaaggccaaaaattcagcagcagttctctgatttaaagagagatttagcgcaggttacagaagatgaatggaagacagtaccagaagttggtgatgccagaaataaaaagcaacgtaatccgagagcagaagagtttacccccttaccagatagcgtannnnnnnnnnnnnnnnnnnnnnnnnnnnnnnnnnnnnnnnnnnnnnnnnnnnnnnnnnnnnnnnnnnnnnnnnnnnnnnnnnnaccgggtatgctaacacccacaggcgacatggatctgcgcaaaatcggccaagcaagaaacactctgatgaatgttaaactgtcacaagtatctgactctgtaaccggtcaaacagttgttgatcctaaggggtatcttactgatttacaatctatga

SEQ ID NO: 10682 - DNA, 284 bp, Diabrotica virgifera
ggtactagataggatatatttacctgccccgctacaaaatagacatagtacactacaatagaaaaatatattaagaaagtatataggtgagctgagatctataaagctctctctttatttttctgtacgctgcatctcatgatttatcaccgattaacaagatatcacatgtattatcaaaatgtatgggagctacattatgagtaggctttattgtatgaaacgtatatgtcgcgcacttttagataacgggcgacgtctttaggatcgaacctacatcgctt

SEQ ID NO: 10683 - DNA, 1231 bp, Diabrotica virgifera
  misc_feature (402)..(420): n is a, c, g, or t
  misc_feature (760)..(780): n is a, c, g, or t
  misc_feature (833)..(833): n is a, c, g, or t
  misc_feature (855)..(855): n is a, c, g, or t
  misc_feature (860)..(860): n is a, c, g, or t
  misc_feature (1039)..(1076): n is a, c, g, or t
  misc_feature (1106)..(1128): n is a, c, g, or t
  misc_feature (1144)..(1175): n is a, c, g, or t
gattgctcaagttctttattcaaacagtagaaaaaccgttgattcttcattattgaatcaaacataaccaatagagtggtaaaagactggttaaataatgtgagagacaaaaaatgaactcatcattaaccaaacaaagatatataataagcacaaatttattgaacaaataagcaaatcaagaaaaaggaaaaatgagttgtgaaacccaatgttggctactaaactaataaaaataaacagaaaagactgaaaaatgttgaatatctctctgtattatgtccaatctcctcaaaacactttcttctcacaattttcgtatacaactgaatgacacttttttatatatatttcactacacagtagattgctatttttggtatgttgtatatttgttgtagnnnnnnnnnnnnnnnnnnnctcaaataagaaatttctatcgttactttttgtcttcatctttcatgtgctaaaataaatattttgttcttgtggtactttttagaatcaatttggttattgttgtctgacaatatttttagttacattgttttaaataatacattatcttatcaactggcatgaaaaatttacatttatctcaaggttttgcaaacacttctaagattttcttatagcttcagttgccctcttaacccagttttaatgttgttaaatatctggacttcagaggtaatcttcactatatcaacatggtattgttttgttcctttaatccacttattttattagttggagnnnnnnnnnnnnnnnnnnnnncaataaaatatagtcatattgtctttcaaccatttgtgggatatatcagattnttattaacactaagtgctctanacttntgtgcaaacacacgctaaacacagttgctcgaatgccatagtgtattttaacttccgaggtccagatatagaatactctcaatctacttgaatattttgagggatggagtcccaaaaaatctgttccctttttggatactaaccatctagaaaaaaggaaaaggggttggtttttgtgnnnnnnnnnnnnnnnnnnnnnnnnnnnnnnnnnnnnnnccaattcccccatttttttggaaagaaaannnnnnnnnnnnnnnnnnnnnnnagaaagggcccccccnnnnnnnnnnnnnnnnnnnnnnnnnnnnnnnnccccacaatccccccccccacaaaaatagcgccgcccggttttggtgtaaaaatta

SEQ ID NO: 10684 - DNA, 908 bp, Diabrotica virgifera
  misc_feature (834)..(834): n is a, c, g, or t
  misc_feature (862)..(862): n is a, c, g, or t
  misc_feature (873)..(890): n is a, c, g, or t
gaatatacacatacaaagatacaactcacatttattttaaagcatttacattaccagatatggcatttaccggaaaagtaattctaataaccggtgctagttcgggtattggggctgctactgcgaaacaatttgccagcctcggtgccactttggcacttgctggaagaaatgtggataacttaaaacaagtggcctcagattgttcaacaaagtccattccattgctgttacaaggggaactaacgaatgaaaaggataccaaggcaattttggacaaaactatcgagcattttgggagattggatgtcttggtgaacaatgctggtatcctagaaacaggaagcattgaaaacacaactctcgaacaatatgaccgcctaatgaacaccaacgtcagatctgtttaccatctcagcatgttggctgttcctcacttggtaaaaacgaaaggaaacatagtcaacgtgagcagcgtcaacggaatgcgggccttccccaacgttctagcttactgtatgtccaaagcagctgtggatcagttcactcgatgtgttgccctggagctagcagacaaacaggtcagagttaacagtgtgaacccaggtgtgacactcaccaatcttcagaagagaggtggtatgaacgatgagcaatatgaagcgttcctacaaaggacgaaagacactcacgcccttggtaggccaggaaatccagacgaggttgccaaggccatcacttacttagccagtgaggatgctagttttataactggagctagcctgccagtagatggcggtagacacgccatgtgccccagataattactgtttngttgtaatatctgtatttgttatgattntgggatattgnnnnnnnnnnnnnnnnnnaaatgtaattaatgtttt

SEQ ID NO: 10685 - DNA, 651 bp, Diabrotica virgifera
  misc_feature (145)..(165): n is a, c, g, or t
aaaattctctagattatgagatcgacaaagtcaatagaaacactacaaagacttacaaataaccaaagactttccaagaaaacatcccttacaatatgctaggactcatatggaattacggaagagacagaacgcaggcaagggnnnnnnnnnnnnnnnnnnnnnccattatccaaaatgagtaggactactgagaacctttacaacctcctaaaaacttcaaatgatataaagcaaggaaatgattattccttactcaagaaaggaatcaaaaccatgcgggaagatgatgccaataaaagaggagggacgaggctgctcagcttacaaaagaaacaattaaaccatgatctacatagatcctggttatatactatattagagccccattggtgaagctcctgaaaattcctgaagaaatatgtgagagcagatgacactatatggcattagggcgacaaagtacctggttgtaccgctgatgcccagaacagacacgcagttctaaagattggaagcatattaaaggcaaggcttcattataccttctacagtttacactgagtttaccaactacactaaagatacgagtctaaaaactggacccggccccaaaaaattcatataaacggataaaatggcaggaatttt

SEQ ID NO: 10686 - DNA, 719 bp, Diabrotica virgifera
  misc_feature (79)..(96): n is a, c, g, or t
  misc_feature (362)..(381): n is a, c, g, or t
  misc_feature (435)..(453): n is a, c, g, or t
agatattattacatctctaaagtaaatctatgcaaagaaatatataacaaataagaaaaactgtgtaggtacctatagnnnnnnnnnnnnnnnnnngccaatgttatttttttaataagttaatggtagaatagtataaagtaattgttaaatattcgttcaaattaccaataattaatatcaacataatgtactatcgatttattaattaaatcggtcatttcaaaaacatcaccagtcacatattcctaattttacagaagagcaaagaaaactaactatatagttgaaagatggatgaaatggatgacatcaaaattcagagttatattgtagttttgttcctaatgttggactggtannnnnnnnnnnnnnnnnnnntatcttaaaggagtctattcctctcaaaaagttagtttctgaaaattgtggacnnnnnnnnnnnnnnnnnnnagacatttttattagtaattgacattatttttatttatgaaactatattgttacaattttttgaaaaggtagaagcaaaacaaacattattcacatcattcgaataaggccgaatttatattaataacgaacgtcttttattttactatgcagttcacaaattatgtattccaatattaacttactatacatacatttattatctgctagctttacttaggtccatttttcttatgtggaaatatctaatggacgcaatattgatt

SEQ ID NO: 10687 - DNA, 372 bp, Diabrotica virgifera
  misc_feature (9)..(9): n is a, c, g, or t
  misc_feature (12)..(35): n is a, c, g, or t
  misc_feature (39)..(39): n is a, c, g, or t
  misc_feature (52)..(52): n is a, c, g, or t
  misc_feature (55)..(56): n is a, c, g, or t
  misc_feature (58)..(58): n is a, c, g, or t
  misc_feature (60)..(62): n is a, c, g, or t
  misc_feature (65)..(65): n is a, c, g, or t
  misc_feature (70)..(70): n is a, c, g, or t
  misc_feature (73)..(73): n is a, c, g, or t
  misc_feature (79)..(79): n is a, c, g, or t
  misc_feature (81)..(85): n is a, c, g, or t
  misc_feature (90)..(90): n is a, c, g, or t
  misc_feature (98)..(98): n is a, c, g, or t
  misc_feature (103)..(104): n is a, c, g, or t
  misc_feature (109)..(109): n is a, c, g, or t
  misc_feature (119)..(139): n is a, c, g, or t
  misc_feature (149)..(149): n is a, c, g, or t
  misc_feature (151)..(151): n is a, c, g, or t
  misc_feature (173)..(173): n is a, c, g, or t
  misc_feature (175)..(175): n is a, c, g, or t
  misc_feature (182)..(182): n is a, c, g, or t
  misc_feature (188)..(188): n is a, c, g, or t
  misc_feature (190)..(190): n is a, c, g, or t
  misc_feature (192)..(193): n is a, c, g, or t
  misc_feature (195)..(195): n is a, c, g, or t
  misc_feature (209)..(209): n is a, c, g, or t
  misc_feature (219)..(219): n is a, c, g, or t
  misc_feature (228)..(228): n is a, c, g, or t
  misc_feature (252)..(269): n is a, c, g, or t
  misc_feature (292)..(317): n is a, c, g, or t
  misc_feature (324)..(325): n is a, c, g, or t
  misc_feature (328)..(349): n is a, c, g, or t
  misc_feature (353)..(353): n is a, c, g, or t
  misc_feature (355)..(355): n is a, c, g, or t
caataaagnccnnnnnnnnnnnnnnnnnnnnnnnnaganaaacctaaaaagnaannangnnngangaagnagnaaaganannnnnaaagngaggaagnaaagnnaaggnagagaaagannnnnnnnnnnnnnnnnnnnngaagggagananaaaaaagagggggaagaaagangnagaagangaaggngnannanaggaaaagaggggnagaggaaggngaaaggganagaagaaaaagaagagagaagagnnnnnnnnnnnnnnnnnnggaggaggaaaaagagggggggnnnnnnnnnnnnnnnnnnnnnnnnnnaaggaannagnnnnnnnnnnnnnnnnnnnnnnggangngggagaagaggaggaag

SEQ ID NO: 10688 - DNA, 200 bp, Diabrotica virgifera
  misc_feature (7)..(44): n is a, c, g, or t
  misc_feature (79)..(101): n is a, c, g, or t
  misc_feature (113)..(113): n is a, c, g, or t
  misc_feature (120)..(120): n is a, c, g, or t
  misc_feature (166)..(192): n is a, c, g, or t
  misc_feature (194)..(194): n is a, c, g, or t
taacagnnnnnnnnnnnnnnnnnnnnnnnnnnnnnnnnnnnnnntgcgacctcgatgttggattaagtttataattggnnnnnnnnnnnnnnnnnnnnnnntggtcgactttntaaattntacatgatctgagtttaaaccggtgtgagccaggttggtttctatnnnnnnnnnnnnnnnnnnnnnnnnnnngnaaggga

SEQ ID NO: 10689 - DNA, 325 bp, Diabrotica virgifera
  misc_feature (10)..(105): n is a, c, g, or t
  misc_feature (266)..(316): n is a, c, g, or t
tattgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaccgcgtattttttttgggaagtccaatcgataataaagaattcgacctccagggtgggataaaggttttaattggggggggcacctaaatttattaaatctgggtcgacttttttaaaattttcttggattgaggtttaaacgcggggggaggccccnnnnnnnnnnnnnnnnnnnnnnnnnnnnnnnnnnnnnnnnnnnnnnnnnnngggggcccc

SEQ ID NO: 10690 - DNA, 848 bp, Diabrotica virgifera
gacaccaagttggatacgatcctattcataacacccaaacccgcatacattttgtgaagaataaatatatggaggaatatatttggaaattgaattaatgatgtcatgcttctatacattatgtggtagcatgccatcattaattcaatttgtaagtatagtatttttactacaaaaacgttattacgtgggtcagaatttttgacagttctcttacgtcagaaattttgacctgcgtgatggcgtttttgtagtaaaaatgctatatgtatattcttccatatttgtttttcttaatatgtgtgcgagtcggatgttatgaataggagcgaccctgacaggaatggtggtgacatctgactgtctcaattggaatcaaataaatttatctattgggttgaccaactattactatataaacaatgcttttagtaatagacctcacaagttaataacctaatgtcacaaatacataaaagttatatgttaaaataatcgttgacctacccaaaacggacggctatggtcggtactagaaattcgtaattgacggaatcgattcatctctgaaggataaaataaataagtataagtgtaccagttttcgtttttctaaatagaagcgttctggaggtgtttaaagaaactaattaccaggcgccatctttaaagagctctagcttaagctgagcattcacggtcaatccatttggagccacgccaaatggcttcagtcaaatggattgacgccaaaatcgtagcccattcacgaccactccacattgtcggattccgaagaggaactcggatagagtgaacgaaaaatggacgtgggtttggacattgac

SEQ ID NO: 10691 - DNA, 358 bp, Diabrotica virgifera
  misc_feature (81)..(107): n is a, c, g, or t
  misc_feature (152)..(171): n is a, c, g, or t
catttagaaaagtgttataatgataaatattgttagttaataatatatattgtaaagtttttctgggttgagaatggctannnnnnnnnnnnnnnnnnnnnnnnnnnccataataaattcatttttatttttagatttcttattgaatgacnnnnnnnnnnnnnnnnnnnnctaccttaacttttgaggtcttgagcaaaaagtataattgcagtaggaattcaaatttgacataggtatattagaaaatccctattcatactataagtattcatctttattgttatattataatattaatctgttgtgtaacttattatgatatttaaagctatagtttgtgtgattttatatttta

SEQ ID NO: 10692 - DNA, 54 bp, Diabrotica virgifera
  misc_feature (2)..(18): n is a, c, g, or t
  misc_feature (23)..(53): n is a, c, g, or t
gnnnnnnnnnnnnnnnnncgagnnnnnnnnnnnnnnnnnnnnnnnnnnnnnnng

SEQ ID NO: 10693 - DNA, 97 bp, Diabrotica virgifera
cgctagcctgatgaatcattataagccaattatttcactaattctgtgatttctaccaactatccttctacattgttccacaaacttactcatcttc

SEQ ID NO: 10694 - DNA, 766 bp, Diabrotica virgifera
  misc_feature (379)..(397): n is a, c, g, or t
  misc_feature (545)..(571): n is a, c, g, or t
  misc_feature (573)..(586): n is a, c, g, or t
tttagttacaattatgataaagctgttcttgttagctgctcttggagtagtagcgaccatcgccgttccccgagatgatcttatttgataaacacataataaattatttgttgattctctgttactttgtgattaatgactaataattatctaattattatatcataaatctcaagaaataaaccgacgttattttgatatacatgtatgtataatacatactttccaaatcccctgcggaaagttctgtacatcgtgacaagacatatgaagacgacaatgaattatatctcgtctaatatgtattccatatcgttctatattatcaatagtaatcgtaataatatattgtcgccggggtaaggagaattttaagtannnnnnnnnnnnnnnnnnngatgatatttgggaatatggtgttattatataagatatatgataaggaatttataattgatttttatatttgggaatagtggatagtttaagatatgtaattatttaattgaaggaaatatgaataataattaatgaggataagatgnnnnnnnnnnnnnnnnnnnnnnnnnnngnnnnnnnnnnnnnngattgagatatttataatgataaaatgtgtttatgagaaattggttttttgtattttaataaggggaagatgaatatgatatttttaagggggggtttattaaagtgtatgtagtaaatttagttagtatggattgaaagagagttgagtgaaaattgttttattattgggaaataattt

SEQ ID NO: 10695 - DNA, 70 bp, Diabrotica virgifera
  misc_feature (3)..(3): n is a, c, g, or t
  misc_feature (8)..(9): n is a, c, g, or t
  misc_feature (17)..(17): n is a, c, g, or t
  misc_feature (21)..(21): n is a, c, g, or t
  misc_feature (23)..(67): n is a, c, g, or t
  misc_feature (69)..(69): n is a, c, g, or t
gtntatannattattantaangnnnnnnnnnnnnnnnnnnnnnnnnnnnnnnnnnnnnnnnnnnnnngng

SEQ ID NO: 10696 - DNA, 775 bp, Diabrotica virgifera
  misc_feature (729)..(756): n is a, c, g, or t
  misc_feature (768)..(768): n is a, c, g, or t
caaattcataaacatgagtagaaaacgcaaattaagtaaaaataaacaagatgaatttgagtttgatccaatacctaaacatttagtagtagctcatttaaaagaccaagaaaaacgattaattatcattctggaaggcgcacaattggaaacagtcaaggtcagggataagtttgaattattaaattgtgatgaccatctgcacattttaaagagtaataatcgagatgttggatcttgcagaccagatataacacatcaatgtttgttgatgttatttgacagccctctaaatagagcaggacttttacaagtttatgtccatacagccaataatattttaatagaaattaacccacagactcggattcctaggactttcaaacggttttcaggattaatggttcaactattacacaaattctccgtaagagcagatgatggtcccaaattactaaaggttattaagaaccctgtaacagatcacttaccagttggcgttaagaaaatttgcacttcctttgctgctaaacaagtacacaattgtaaagagctggtacctaagaatgaagaaccaatagtttttgtaataggagctttggctaggggtaatgtgaatgtagactacactgaagatacggtttctattagtaattatcctctttcagcagcgttaacttgtacgaagttatgttcagcatttgaggaggtgtggaatgtgatttaagnnnnnnnnnnnnnnnnnnnnnnnnnnnngataatatagtntgataag

SEQ ID NO: 10697 - DNA, 184 bp, Diabrotica virgifera
  misc_feature (6)..(152): n is a, c, g, or t
  misc_feature (154)..(154): n is a, c, g, or t
  misc_feature (156)..(156): n is a, c, g, or t
  misc_feature (167)..(167): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnantnataattttttngatccaattttttttga

SEQ ID NO: 10698 - DNA, 260 bp, Diabrotica virgifera
  misc_feature (7)..(43): n is a, c, g, or t
  misc_feature (104)..(127): n is a, c, g, or t
  misc_feature (158)..(188): n is a, c, g, or t
  misc_feature (199)..(259): n is a, c, g, or t
taacagnnnnnnnnnnnnnnnnnnnnnnnnnnnnnnnnnnnnngcgacctcgatgttggataaagtttataattgttgtaacagtatattattaagtctgttcnnnnnnnnnnnnnnnnnnnnnnnnagttaaaaccggggggagagcaggttggttnnnnnnnnnnnnnnnnnnnnnnnnnnnnnnnccaaagggccnnnnnnnnnnnnnnnnnnnnnnnnnnnnnnnnnnnnnnnnnnnnnnnnnnnnnnnnnnnnng

SEQ ID NO: 10699 - DNA, 1043 bp, Diabrotica virgifera
  misc_feature (14)..(342): n is a, c, g, or t
  misc_feature (375)..(395): n is a, c, g, or t
  misc_feature (397)..(438): n is a, c, g, or t
  misc_feature (442)..(471): n is a, c, g, or t
  misc_feature (530)..(552): n is a, c, g, or t
  misc_feature (572)..(606): n is a, c, g, or t
  misc_feature (608)..(648): n is a, c, g, or t
  misc_feature (660)..(824): n is a, c, g, or t
  misc_feature (937)..(957): n is a, c, g, or t
  misc_feature (999)..(1032): n is a, c, g, or t
aggacgcgtgggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatgatgataaaattagtattaattaattgtnnnnnnnnnnnnnnnnnnnnntnnnnnnnnnnnnnnnnnnnnnnnnnnnnnnnnnnnnnnnnnnatcnnnnnnnnnnnnnnnnnnnnnnnnnnnnnnatcgactgcccactgattaaattgaatgaccgcgagattttgaccgagctaaggaatannnnnnnnnnnnnnnnnnnnnnnaagctggtatgaatggctgnnnnnnnnnnnnnnnnnnnnnnnnnnnnnnnnnnntnnnnnnnnnnnnnnnnnnnnnnnnnnnnnnnnnnnnnnnnncacgataagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagggaaaaagtgcaatttttattggaagttcaaatcataaaaaaaatggcacctcccatgctgaattaaatttttaattggggtaccagctatattttttaggccggtccnnnnnnnnnnnnnnnnnnnnngttcggaaatttaaaccggggggggggccacgtggtgttttnnnnnnnnnnnnnnnnnnnnnnnnnnnnnnnnnnaaaggtacccc

SEQ ID NO: 10700 - DNA, 455 bp, Diabrotica virgifera
  misc_feature (80)..(115): n is a, c, g, or t
  misc_feature (126)..(170): n is a, c, g, or t
  misc_feature (215)..(282): n is a, c, g, or t
gccacgcgatcggaaatgatatacgtctatatttatatgaaatatattaagattatttataaactaaataattaacaatnnnnnnnnnnnnnnnnnnnnnnnnnnnnnnnnnnnngggatagagcnnnnnnnnnnnnnnnnnnnnnnnnnnnnnnnnnnnnnnnnnnnnnggataaaaaataggcttattaaataacatgttataatatatgttnnnnnnnnnnnnnnnnnnnnnnnnnnnnnnnnnnnnnnnnnnnnnnnnnnnnnnnnnnnnnnnnnnnnatatgatgatagtattggtgttaatataaggaatatatagtagaaaattttgggtataatcacgggattcggcaaggatttcggcaccagttttttcacctgctgattatgtgcatgtcttatagagtctcgtctgcagcctggtctgcccgcagggcagggggattgggcgc

SEQ ID NO: 10701 - DNA, 947 bp, Diabrotica virgifera
  misc_feature (99)..(128): n is a, c, g, or t
  misc_feature (785)..(816): n is a, c, g, or t
  misc_feature (833)..(850): n is a, c, g, or t
  misc_feature (855)..(878): n is a, c, g, or t
  misc_feature (881)..(881): n is a, c, g, or t
  misc_feature (900)..(901): n is a, c, g, or t
tgtttatctatgtacatgtgtttgtgacaagtgacaatttgtttgtgtaaattttcctgtttggcgttttcataatattttataattgttgaaaaaagnnnnnnnnnnnnnnnnnnnnnnnnnnnnnnctataattgtgatggctgcacgcaaaggtggaatttcttctgtggttcgtggatgccagactagatctggggaacaaataagtcttttttcaataccacgagatcgtagcaggtaaacaaatcaaatttgatattaaaacgcgctacaaaagttatctgaacattaatattttaattcaatacatttttttatagagctgaatattatggctaaaagctgcaattagggaagatttactttcaaaggatgtcaatgaattgcacaaaaattatagaatgtgtgagaaacattttcaaccacatttcatatcgaaggggggaaacgtaagaaaaaatttatttatacaagctcatcctacgatattcccatacaaccaagatgtacaatctgcagatgaacccttaagaaagatcataagacttgaaacacagattgaagataaaactgaaatagatattatgcagccagttgccaacaaaactgatgccagtcatagtatgcatagtatacctgatactttgatggaagaatctctggtaacagatgttgatgtcaataccgaagtatctaccagaccccatactccagcacacacagtttcaactcaaactccccccaaattatctagtagctcaccaaggaaagtaaaattacgnnnnnnnnnnnnnnnnnnnnnnnnnnnnnnnnggaaatgcaaatccccnnnnnnnnnnnnnnnnnntgatnnnnnnnnnnnnnnnnnnnnnnnncanatgtgtgacaaactattannacagcctttagcacaaatagtaaaaagctcagcattattaaaaagt

SEQ ID NO: 10702 - DNA, 643 bp, Diabrotica virgifera
gcttcttttattatgttgctcattaatttttttagctctttcttgcttgtcgttaatagtgttagatcatctgcgaatgctatacattgatggccatttttaaagtgatgtaagataagtagctatattattttaaatacatttgtctcagtttctatctaaaagcatgcacacataaaaaatctaattctaataataattgatgaagatgatacttttgttctttattttattttgtttgctatacaaaaacgttagccaacattttacattttgaaaatatgtaagtatgtatgtcaatatcacaattttaataattcacgcaagagttgttgtaataaacttggtttaaaatattaccggatttatagatatataatttattatacatgaaaataaagaaatcctgtcatcaactctcgataatattcctatatcatcacatatatacttttattttattttgatagcagatagttacgtacaataattgtaacttatatcaagtgcctacatccaacttatttcatcagaatcatttaatttttgatatgacgttaatatctgtataatattgattatatatttgtatgaatacacttcaataaaattctgcttcctgtgtatatttatctgaagctat

SEQ ID NO: 10703 - DNA, 573 bp, Diabrotica virgifera
  misc_feature (148)..(166): n is a, c, g, or t
gtttgaaaggaaaattgttttacactttactaatattgtgggaatctagattcaataaaatgcccacataaacatggaatccatctccgtatctgcaaatatcaaccctaccatcatagaaccaccagttatatcttcgaacgactcnnnnnnnnnnnnnnnnnnnggtggagaaaatgaaggagacaccaccatccatgctttcaatatgtctgcatcacagtttcacatcactgttgtggaaaaccctgcgttaaagaaatcttcacaatgtgaaggtagtgatagcggggtagaggttgtagaaaatgtcgaaaaccaggatccagtcgtgtaccaacgtaatataagctctaatagtggcatgtcccaggattacgataatataaatagtgcccgatcgtgcgattcttcgattataagttgctatgatgaagcttacaatatcctggtccggaaaaattcaacgttactggaagattatcgaagacacgaagacgtcaccagcgaaaacggtagcgaaagttcttccttaagtggatccaacgtacgaaccaatagaagaacctccgt

SEQ ID NO: 10704 - DNA, 316 bp, Diabrotica virgifera
  misc_feature (2)..(119): n is a, c, g, or t
  misc_feature (122)..(168): n is a, c, g, or t
  misc_feature (174)..(271): n is a, c, g, or t
  misc_feature (288)..(308): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaagggaaaaacaagnnnnnnnnnnnnnnnnnnnnngttcaaaa

SEQ ID NO: 10705 - DNA, 442 bp, Diabrotica virgifera
  misc_feature (13)..(185): n is a, c, g, or t
  misc_feature (320)..(340): n is a, c, g, or t
  misc_feature (375)..(425): n is a, c, g, or t
aagacgagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttaggggatacaggggtaatttttaattggagaagtccaaatcgataataaggatttggccaccctcagtggttgggattaaaggtttttaatttggtggaaacagcctattttttttaagttttggttcannnnnnnnnnnnnnnnnnnnngagttcggaattttaaaccgggggggggaggcccnnnnnnnnnnnnnnnnnnnnnnnnnnnnnnnnnnnnnnnnnnnnnnnnnnncccaaaaagggaccccc

SEQ ID NO: 10706 - DNA, 285 bp, Diabrotica virgifera
  misc_feature (7)..(31): n is a, c, g, or t
  misc_feature (49)..(104): n is a, c, g, or t
  misc_feature (106)..(129): n is a, c, g, or t
  misc_feature (132)..(160): n is a, c, g, or t
  misc_feature (163)..(277): n is a, c, g, or t
taatcannnnnnnnnnnnnnnnnnnnnnnnntggagggggttggatgannnnnnnnnnnnnnnnnnnnnnnnnnnnnnnnnnnnnnnnnnnnnnnnnnnnnnnncnnnnnnnnnnnnnnnnnnnnnnnnacnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 10707 - DNA, 166 bp, Diabrotica virgifera
  misc_feature (3)..(52): n is a, c, g, or t
  misc_feature (120)..(141): n is a, c, g, or t
tgnnnnnnnnnnnnnnnnnnnnnnnnnnnnnnnnnnnnnnnnnnnnnnnnnntaggaatttcggcagcattttttttcccctgtgtcacaaaaaacatagtcttttttgtatttaatagnnnnnnnnnnnnnnnnnnnnnnctaatttgaagtggccccggcattg

SEQ ID NO: 10708 - DNA, 278 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattaggaaatagtcaatataagcataaaaataacaacataag

SEQ ID NO: 10709 - DNA, 843 bp, Diabrotica virgifera
  misc_feature (97)..(109): n is a, c, g, or t
  misc_feature (111)..(123): n is a, c, g, or t
  misc_feature (787)..(787): n is a, c, g, or t
ctgcagtaagagatggagacagaagaaaaacagaatgaagcatctggtttactacaaacagtacaaaatgggaaagaaaaagaaacagctacacccnnnnnnnnnnnnntnnnnnnnnnnnnnattatacaaaaatgtataggagttttaggaaggtggcatatttggttatgctttataatatttctagtcaaatttggtgtttcttggcaccaacttagtatagtatttttagctccacctattaaatattattgtatcaataatgcaacagaaacatgtttatccaattgtactcattatctatatgatacatttggtagaaaattaccacttgttctggctgttgctctgcaaggattgtcgggattaggtgcagctttctccccatggtttacattatttataatcttaaaatttttatctgcagtagcgacaggaggtacaatgataacaagcttcgtacttatcatggagataatcggtaccgaatggagaacagttcttggtattttgtaccaaataccattcaatttaggtcatcttttgatgccactatttagttattatcttcgaaactggaggcatttccaaataatgatatcagtgccttcgctttttctgatctcatactattggattcttcctgaatcacctcgatggcaactagcagttggtaaagaaaagcaagcaattgaaacattaaaaaaagcagccaggcggaacaagctaccaacagaaaaaatcgaacacgacgttaatctttatttagaacacaaacatctanatcaaaaggaagttcatcaggaaatattctagacctggtccgacgccgattatgag

SEQ ID NO: 10710 - DNA, 204 bp, Diabrotica virgifera; identical to SEQ ID NO: 9268
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10711 - DNA, 863 bp, Diabrotica virgifera
  misc_feature (10)..(31): n is a, c, g, or t
  misc_feature (746)..(746): n is a, c, g, or t
  misc_feature (828)..(828): n is a, c, g, or t
  misc_feature (848)..(848): n is a, c, g, or t
aggtatatcnnnnnnnnnnnnnnnnnnnnnncacaattaatccagatcttgttataatacgagacatttttttggttaaaaatactgtgaaacattaaattctaaaacactaaactacaacatttgaaacaaaatgtggagaagaggcacgatgaaaattgaagcagacattgtcattcctgtaatgctggcgaagatgtaccacaaaagtgaaaatatcataaggtgccataagatgtggataaccaacaatactttatcttttgatctcgcagcgtccaaggttttcctagggtccttgttcaaataaaccctagctcctagtgttaaatcgacaaaatattctggccagcagagtccttgcaaatcaacattgaattcttgctgatcactttttgttaaccaattttgtaattcaacggttttcacagctgggaatgtccattcagtaaatatgaatttagatagcatgcctaatgaattattgacgtttctgtgtaacttcattaaaataggacgaccgcccgttaatcttgtcacagtatctaataaaattgcagggaagaaatgaacgaaaaacgcagaaactttgtaccatgtaattgtaggtaaaaacttcaaatgtggataccaaactgcagatttaagagggtatttgtggagatactccgtgattttgttttctacggacgaccaacggaagggttcccgtgtactggatgttgcatggtagacttccacctttngatgttttggtatgaccagcatgagcgcctgcaacaataagactgttaactactatatccgacaggaatgtaatcatacacntaaatttgttttgcactggngcaccttctgatgac

SEQ ID NO: 10712 - DNA, 466 bp, Diabrotica virgifera
  misc_feature (10)..(33): n is a, c, g, or t
  misc_feature (38)..(38): n is a, c, g, or t
  misc_feature (45)..(45): n is a, c, g, or t
  misc_feature (53)..(53): n is a, c, g, or t
  misc_feature (62)..(62): n is a, c, g, or t
  misc_feature (66)..(67): n is a, c, g, or t
  misc_feature (76)..(160): n is a, c, g, or t
  misc_feature (163)..(163): n is a, c, g, or t
  misc_feature (165)..(165): n is a, c, g, or t
  misc_feature (169)..(169): n is a, c, g, or t
  misc_feature (179)..(207): n is a, c, g, or t
  misc_feature (413)..(451): n is a, c, g, or t
gttaaaagcnnnnnnnnnnnnnnnnnnnnnnnnacccntatagangtttatanattattaantaanngttttttannnnnnnnnnnnnnnnnnnnnnnnnnnnnnnnnnnnnnnnnnnnnnnnnnnnnnnnnnnnnnnnnnnnnnnnnnnnnnnnnnnnnttnantaanttttttgatnnnnnnnnnnnnnnnnnnnnnnnnnnnnnaacttaggaataacagcgtaaattttaatggaagaagtcaaatccaataataaagattggcgacccccccatggttggatttaaaagttaaataatttggggggacacgcctaatttttatttaattctgggtctcacttttaaaaatttttccatgaatctgggaagttaaaaaccggggggggggggcccaggggggggtttcnnnnnnnnnnnnnnnnnnnnnnnnnnnnnnnnnnnnnnncacaaaaggggaccc

SEQ ID NO: 10713 - DNA, 895 bp, Diabrotica virgifera
  misc_feature (520)..(536): n is a, c, g, or t
gtctggggattatttgtctgaggactgtttgtgggggattttttgtccagaaataatttgtgaggatattttgtccgtacacatatattgtttgaaagataatttaatatgagtatatacattcatgaaaatttatttcgacttcttatgtttaacattgtaaaattaatgcatcaagaaaattcactttttttattgctaaggtatttgacaattaaaaatttaacaattaatgttttaataatgggtattaacctcgtcctgcattaataacttctctcatatgattaggcgtagatctaatcaagtttgctgttgtttcttgtgggatgttgagccactcttcttctactgcgtcaataagctctgggatcgagtttggggtgtgacgtctaactcgaattctttgttttagctcatcccataattgttctatgggattgaggtctggactatacgccggaccattccatgacccgatggaatgtaattttgcacgattcttgaggttttccttggnnnnnnnnnnnnnnnnntaaattcgtctcctatgtaatcaacgcaaggtagcacatgcatcgctaaaatcttctcgatgtatgtagcacccattacaactcctttctcgtaaagacggttacccctacgaatgaaaacaaggacggttcgtgcccccatagaaattgcactttagatcatgaaggaaccacctccataaggactatgctcttcaatgcagcattttcctcgtcttcgatacattttccttcttcggtcgctaccatagaggcatattctggtctcatttgtgaacagaacagatccccattgttccaacgtccagttcagaatggttccgtgcaaaacgcaggcatggcttgacgatgaaactgca

SEQ ID NO: 10714 - DNA, 820 bp, Diabrotica virgifera
  misc_feature (30)..(30): n is a, c, g, or t
cccttcgcggccgcgcattttaaaacaganttcggaatggcaactttggtcgtaatcatcaaaaaaattaaataagaagttctgagtgtaatgaccgttgaggtaaaatttagttcaagatctacgattatgaaacggtttttagtgattgccgtggtgtttattttattttccataacggaaagtagtgttaaacacgaaaatggctgcttagataatatttgttacaaagataatacctatcctcataaggaaatagaaatcatgtggaaaagcagctctaataaattaaccaaaaccttcggggacattcaacatgtctcagataatgaaaacgacgagctggtatcaaaagccacttgcgaactttgtccgacaagtatacggtccaaggtgcagattttaagtatcattggcgataataatatgagactctatattgctcgtacttcaaagtaccatccagaaattagagtagaagtttgtggggatgaagcaaaatgtaatccaaaggacaagcgcgacaattatgaaactttttgtcaacaacagacgtccacgataagtcttttagcttataacaaaacatctaaacagtttcagactcatcaagttgattatccaagtggttgtgagtgtgttttaagtgtatctgatccaccaacacggaacattccaaagaactaataattttctcgtgactttcgttgataaagttatctaacaactgctttgggtaaatttagtgatatcataacaatatccaatataaagattatgcaaaagaacaaacgtactttttaacttataaacaacatat

SEQ ID NO: 10715 - DNA, 337 bp, Diabrotica virgifera
ccccccttttggggtgactaacctagtatatgttttttacgcacacctgtaggagattggaggattgtaattataattacaactcctgaggacttgactgtgtgggggagataatttactagaacgcgatggtcgacagtcatcatctcaaaagatagctaaaaatcttttagaaatgtagcagtactatttagcgtacaatagttgctaagtgatttctgaaaaatttcacgtttgccagtaagtccagcataaaggaacgaatgtataattggatgaaatgattcatgatactcaccactgggcacgtcggttgtaattattgaaggagatcctc

SEQ ID NO: 10716 - DNA, 795 bp, Diabrotica virgifera
  misc_feature (2)..(787): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgag

SEQ ID NO: 10717 - DNA, 786 bp, Diabrotica virgifera
  misc_feature (781)..(781): n is a, c, g, or t
cggcatttatgatccaaaagaaattcccatgagggagtttaaggcatctattatacaaaaacagtgtgaattagatgctggtgcagctataccttcatctgttaacttcgtagctcctttaaaagacatttgtgctgaaaagaaaattcaagatccagtgtttaaggaactatcagatgttggtccgccacactgtagagaattcacttatgaatgtggcataggttctgtcaaaactgttgcgactagcacaacaaaaaagatggcgaaacaattagcagcaagagaaatgctggaaaagttaaacgatattctacaggatttattattagagtgtcctcgtgaggaagaggaatttgaacagttaccatctactatcagagatcgaatgtgtgcagaatcagcactgaatcaaaaaattctccatcgttacaataagttattcggacaagttataccgaataaaaaaggaaaactaaaggatttctcaacttgtttccgtgagttgctgaacaaatttgaaaaaaccagagacgattttgtcgaagatctctgtgagaagacagaagaatctctagtcagaattttagacaaaatggaactacaacatgatgtaattgctgtacaagaaggaattccaataattgtttgtttatgtatcaatactgatgtatcattgactacatcaggtgttggtcaaactttcaaagaggccaaagaagaagcgctcgagactgcattcatgatgcttgacatgtatattgaatagttttcaaataanaatta

SEQ ID NO: 10718 - DNA, 546 bp, Diabrotica virgifera
  misc_feature (169)..(169): n is a, c, g, or t
ggggagacgacgaagcagcgagactgggcaaggacaagggaaccgagacgcgcaagaggaggacgcacccgaaaagaggaacgccgaggcagaaaccgcacaaacgccggaagcaaaaggaagcaaggggacacgggcggcaggggacgaacagagacacacgcaaggnaggaagcccaaagtaaaacagcgaagcgcacagaggaagaccccagagaagacaggcccatcaccaagtgagatgtaatgaatagaatcggtcatctcaccatcgacaatgaactccgagaagctccagaataacaccctattcacattatttaagctccactcaacaccaaggcacacataataaacatgacccagatcctgttagagacgttcaacacacacgtcatgcgtatatccatgcactgcgcactcctccttgtacgcttgtggtcgcaccactggttttgtgtagtactccgatcacgatgtcaagcgctccgtccaaagctaccaaggttacgctcttctccacaagaacctctgcccggacatgtg

SEQ ID NO: 10719 - DNA, 893 bp, Diabrotica virgifera
  misc_feature (532)..(549): n is a, c, g, or t
  misc_feature (761)..(761): n is a, c, g, or t
  misc_feature (804)..(818): n is a, c, g, or t
ggtaacatgtgtttaccttagcaacattgatggatttgctacatcaataataaattataacgaattataatactaaaataagcgtgttttataaaaataaatgaatatacagaatgtcgtctttaactgaagaagaattgttttgtgacgctgaagaagaggatcaaatactaattgaaaaggtaaaaatcaaatctgatgaagagtatgcaggagatgattatgatgatgactacgaagatgatattgattataatactgatgaagagtattggcaacaaaattccagtcattctaaccaacagcaatcatctggcaaagtcagtaattaccaaccaagtgaaaatttatttaaaaagtatactcataaaattaatgttgagaagtatgaagtgaatgctcttccccaacacactacaaacttattaatggaaaatcaaaagcgtatggaaaatgaaagaaaccgtacaaaagataaacatgatagagcaacagcagaacaagttatggatccccgaaccagaatgatctnnnnnnnnnnnnnnnnnngaaacctaatttcagaaataaatggatgtatatcaacgggtaaagaagcaaacgtttatcatgcatcttctaaaactgaccaagactttgcgatcaaaatttacaaaacttccatcctagtgttcaaggatagagataaatatgtttcaggggagtttaggtttcgtcatgggtattgtaaacacaatccaagaaaaatggtaaggacctgngctgaaaaagaaatgagaaatttggttcgaatgcactccaatnnnnnnnnnnnnnnngaaccaattttgttaaggtcacatgtgctggtgatgacttttattggaaaagaaggttggccagctccaaaactt

SEQ ID NO: 10720 - DNA, 902 bp, Diabrotica virgifera
  misc_feature (711)..(711): n is a, c, g, or t
atcggacagtgaagtagtaccataaccataagtagtacgagtatatcgggtcagtcagtgcgagtgatcactagtcaatatgacaaggttttttatatgtgcaattatatgcttgttcgcaaatgttgtcatagcttccaagtctttgccttcttatatcacaccttgtaaaaaaactgatcccaaattaagtgaatgtgccaagcaacgtgctatagaagcattgccctctcttataaaaggggacagagcatataaaattcctagtttcgatccatacgttatacctgctgtagaaacaagtggtacgagtggtatcaacttaaatctcaagaatttacgcctgtcaggtttggacacaacagtaataagagcagttaaagttgatttaaagaataatcaaatagtagtagacgtattcataccagagacaagaaccgaagctgattatacagtagcgggaaaattattcgccatagatattaatggagagggacctgcatcaattaggggtgaaaatagctcagtaatatgtacggtagattacaaattaatcaccaaaaaggatggaaagcggtatgtagacccagacacactcaaatcccatttggacctaaacgttgataaaactcattatcattttggaaatctcttcggtggaaataaagttttagaggatagctttaacaacgtactcaacgagaattctanagaagtagatgacatttcaaaggaaacaaataggtcaatagtcagtagtattgtagtaacagttttaaagtctatatttagagtaccgtttgacgatatctttgtggactaaaactaaaaggagtattaattgtgtatatttcgtgtacataagtttttaagtatcataagtattactttaagaataatac

SEQ ID NO: 10721 - DNA, 80 bp, Diabrotica virgifera
atataagtgtaaattattaaaatttagtcaagatgataacatgtagaattaatacattgtatattttgaatatatatata

SEQ ID NO: 10722 - DNA, 918 bp, Diabrotica virgifera
  misc_feature (2)..(775): n is a, c, g, or t
  misc_feature (777)..(799): n is a, c, g, or t
  misc_feature (876)..(911): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnatacccttagggataacagcgtatttttattggagaagtcaaatcgataataaagattgcgacctcgatgttggatnnnnnnnnnnnnnnnnnnnnnnnnnnnnnnnnnnnntgttcga

SEQ ID NO: 10723 - DNA, 543 bp, Diabrotica virgifera
cgagagaatattatatctctctcaccagacaatttgagagcctgcgtggttggaaaaaacgctgatgaaaaccttaccagccgccagtccaaagggtgtgtcccaacaaaggaacggagtttaggggacgacgtgggatctatgcttctggaaatgattcagagtgcatattctttcgacgcggggcaaggatgaatcgaccgcacagaagtcatcctcactaataggagatcggtcaccactgcgcggcggcttgggccctacctgcagcttgtgcaatgcgagatagacgtagcataacctccctagggaagataatggtgcctgataccgctgaaaaagtaccggcccgtactcggactacacttgattgctaaagaagatatatgaacgatggatgctggctcctatcccataatggaatctcctgctcaaggtctttatgtcttcaaatagggtcgtcttccatattcacttcaatcttgtgaggatgatacgatcgatactgaaccgaattgccgtacttcgagcttgcatacgcct

SEQ ID NO: 10724 - DNA, 468 bp, Diabrotica virgifera
  misc_feature (198)..(271): n is a, c, g, or t
  misc_feature (276)..(375): n is a, c, g, or t
ttttttttttttgaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccaagtttaatttacagatcacaaataatgcaatgcaagtaataagtccattagttattaaaaatacattgatactccaatattaatatat

SEQ ID NO: 10725 - DNA, 999 bp, Diabrotica virgifera
  misc_feature (8)..(30): n is a, c, g, or t
  misc_feature (246)..(269): n is a, c, g, or t
  misc_feature (282)..(299): n is a, c, g, or t
  misc_feature (333)..(355): n is a, c, g, or t
  misc_feature (581)..(601): n is a, c, g, or t
  misc_feature (680)..(699): n is a, c, g, or t
  misc_feature (764)..(812): n is a, c, g, or t
  misc_feature (952)..(973): n is a, c, g, or t
ccccttannnnnnnnnnnnnnnnnnnnnnnaggtgcaattaattctattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattgaatcactaatttctttaatgggggtattnnnnnnnnnnnnnnnnnnnnnnaagaagctttttcttttcaacgaaaa

SEQ ID NO: 10726 - DNA, 911 bp, Diabrotica virgifera
  misc_feature (886)..(886): n is a, c, g, or t
ataccaactttatttaggcatctaacaataaatttttgtaaatgtaacttttaggtatattacatatattcaactttctcatattcctaatcataaacactatgtgctaggtaacaggagcaatcaccaaattcagcttcagtgagtccctgttgggtcctacaagataaacaggctcactttggtcttgtgaagcagcctgcttattgagctcatagaaaggaataagattgtcaatattcactgtcctatcttgatcgctaaaatggtgaataacttcctttacttccataacatgttccactcctccttgcattccatatatcagaactgatattttgaccctcgaagttgactctgatagctctctgcttgtaagagagagcctcactgttgttaatatctcttccgggacctctaatgtgccttgccatacgatcaggaaacattttttgaaccagacaccttttggatatagatcaaccagccattcattgatattgcctgattgatgttctgctgtggagagacaagaagaaaaaacaaaggtgctagtatggtaatttggaatgctgttgaagttgtctattgtcagaagggcactacagctatcacaggtatataatctaggagtaaacagtctttttccttcatctgtattgaaatattgcttgattagttctgtataaccagaatggtagttcatacttatggacattctgtccatatagaactctttatgcagctttaacacaggtgacagaaccagatctgccaattctcttggactcatcattggaaatctaatgaaagttaggaattttttcagtcaataatctaaattctgtctcattttcctcagaagtcaatccatggtgggtacaanttgatcctctgcaaatctaaccatc

SEQ ID NO: 10727 - DNA, 567 bp, Diabrotica virgifera
aaaataaatatgacatacctttttattataattcattagcggccaaacaattacatctcatccaccaatgtgcaagaatgaagctcagtccatgttggttaagctggagtacaaatcggcaatgcccgctgggagttgaactggcagaaacatggaatccaacctgactgacatatgccatcatattttactgtttgtaggaagataggagagttgcaagacagacaacagtgaaaccgacagccggaaaacatgtacctacagcagttttcgtaaatgtgtaatcatgaacaataaatgaaaaacctaccgaatcataccgtgatgagttccacccagaactactcttccctggcgaaaaagaagccgccagtagatatactacaggtcactatacatttggtaaagaaataattagactaggtattggacttaatccctaaataggctgataaatgttagtggacttcaaaggttaccgatcttctattccttcaaaggagctaatgaatgcggtctcacttctttgttgatgtaacgaatatcagatgactatggtaaaaaata

SEQ ID NO: 10728 - DNA, 1136 bp, Diabrotica virgifera
  misc_feature (842)..(843): n is a, c, g, or t
  misc_feature (1003)..(1021): n is a, c, g, or t
  misc_feature (1076)..(1110): n is a, c, g, or t
gatattaatattaaacacaaagttcttaaagaagtagaatctgtggttaagcctgattgcatattcgccaccaacacgagcgctttacctatttcgcagattgcagttgcatccaaaaggccagaaaatgtcataggtatgcattacttctccccagtagataaaatgcagttattggaaatcatcaccaccgataaaacgagtaaagaagctactgccatcgcagtcgacataggtcttaagcagggaaaagtagtcatcactgttggtgatggtcccggtttctacacaaccagaattttatccgccatgatggctgaaagtataagactgttacaagaaggcgtggatcctaaagatctagactcccttacgaagaagttcggcttccctgtaggtgccgctaccttagcagacgaggtcggtttagatgtagctgctcatattgggcctaatttagcgcaggcttttggagaaagattttctggaggcgacttgggcgtaatgagagatattgttcaagccggcttcttgggtagaaaatccggaaaaggcgtttacatttacgaaaagggaagtaaaaaccgcgatgtcaacgccgaagcactagaaatagtaaagaaatattccttagaacctcgaggatcgtttgaagatgaagacaaaactttgaggatggttacaagatttgtaaatgaagctgtcctatgtttagaagaaaaaatcctcgccaatccattagaaggagatatcggtgcagtattcggactgggattccccccattcaccggaggtcccttcagatgggtcgaccaatacggagcagccaaactagtatctannaatggagaaacttcgaaacgttcctacgggacttccctttcaacctgctcaaacgcttatcgatatggccaaggaccccagcaagaagatccatcctaaagtaccatcataaagggttatggtattcaacggggcctttttctataaaacagttttttcnnnnnnnnnnnnnnnnnnntaaaggttattggttttaatttaggaattatttttttactggaaatccccaaaannnnnnnnnnnnnnnnnnnnnnnnnnnnnnnnnnntcctggaaaaacactaattttttctc

SEQ ID NO: 10729 - DNA, 541 bp, Diabrotica virgifera
  misc_feature (519)..(519): n is a, c, g, or t
ctaaggttttttatgatgatatttgtataaatgatatccgtgtgttatactcactcatggtaagatatagaaaattatatatctcctacaaaacaagacgccgagcgattggaagacagtctgatgaaaaccctgccatgtataaatatctattttgtgttattaataaaggaaaggagaccagagcaagtcacaactatcaacccataggaaaccgattcaagttgcctactatttcgaagaccagccatggacgttcgtgcgcacagaagttatccacataacaggagaaagtatcccatgtccctgggctacgacactagcgtgccgcttgtgcaactcatgaaaaatatagcatgaactgccgatacaaggatatgatgaccgataccgctaaaaaagaaccggctcagtaccagcaatatgatttcctggaaaataaaatatattgaacgatgcatggtggcttcgaatacataatggaattcctactcaagttctttttgtctatcaaatagnggtcctcatctatattcactac

SEQ ID NO: 10730 - DNA, 494 bp, Diabrotica virgifera
  misc_feature (20)..(20): n is a, c, g, or t
  misc_feature (33)..(52): n is a, c, g, or t
aaataacaaactccatgccnggggttttaatgnnnnnnnnnnnnnnnnnnnngttaagaacttccactttctattcaaatatgacttcaaatattgttgctataactttaacaccaatggggcaacgtagccaagtgcacaaagagtgccgaaagatgtaagacgattagtatactactttttttgaacttggagtgaagaaggacgactgaaaacaatagaggaaagatattaatgaattatttatagattattgtattgcatttaattacttaaagtcacctaccaggatgaattattgttagaagaaccgcataaataaaagaagataatgatgcaaacaatatgcttacaagagactgagaggatatcaaaattctaacgtagtaacatatggaggatacatgggctatgattattttacattaaaactcacttaaaaatacacttaaacgagtaggacatattaatatactacctatactatattgata

SEQ ID NO: 10731 - DNA, 639 bp, Diabrotica virgifera
gataactataacaaataggagggattccgatctcctgtggatggtgacagttctcagatgtgatgttattaccaacataggcaactatgattcaagatatattcttcatccagatgctcgaaaattaattcagaagtgctgaaaataatagtcaagttgtactttgcaggggagacgctcctcgcagaaacggatcatcaagagactagctcactagccattccatggccactagacagtctccccacatctctctccagaaggaaatgctgtatcagcggcatacagtgcagttagcatcagccataacggcagtactactccactccccttacccctattgacaataagtattttgaaatataccaacacaaatctaaacgcttacgcgaagaagagaataaggatgtacacgagacagaacactcggatggtactacccccgtgatactgcccggtgctatagagtaacgtgttcaaggagactctgaaagttgatcttctgcatcatactatcccttccttgacagctcctccctctacatatgcttgaacctacaacttgcaaatctcctcgaaatccgaaccgtgaatcagatatctatatatatgcggaaccaatcgagagataaatggaaa

SEQ ID NO: 10732 - DNA, 935 bp, Diabrotica virgifera
  misc_feature (813)..(830): n is a, c, g, or t
  misc_feature (879)..(879): n is a, c, g, or t
actgcttcttcattcgtttagcatttgtccaacttccataattctattaaataaacgtattagccaacttattcctgcctcttctaatggcttccacatttccccagaaatatcccgattcctttatttttgaagtgcttgaaccacttcctcatggtcagtgcgagttgacagtaaaatcaagtaggaagtatatatcagcacgtctcgcaacaaggatggaaaaaatacagtatgtttaagatatactatgtgaagacagacacatgtctctgactcattagctatcatcagtacagtatagccaaattagaataggtctgcgttaacctttccttgtttgaaaaactctaaacattgattgtttgaaacattccgcattcctttcctcaggtagctgtagcttcctccttggatgtgttagttgttgctctggaatcgttaggatcttctaacattattgtcacaaattggttgcattgctcctgtagtgatcttttcccaagctagcatacacctctagtaggtatagcggtatagcatacagaaatgtagataaactgataatgttgatttgtaaacaaaacatcttcactaaatgggtgaaaaagctgaattcttagtgtctgttatctgtattttgaggttgcagtcattaagttaaggggcagaataaaaaaaaactctgtagacacattaacggacacacttcacatgtagtcacatcttcttaaggagtgacttcatatgtagttgtgtcagtgaatgtattaatatcaagctttcgcaaaatttatttgtttcatcaagtcnnnnnnnnnnnnnnnnnncttttctcagtacatacaatgaaattaagacaaaaaagcattgtattanagaagcataaaaacttacaacatgagcttagtccattaaattgtaacattatcact

SEQ ID NO: 10733 - DNA, 1043 bp, Diabrotica virgifera
  misc_feature (103)..(118): n is a, c, g, or t
  misc_feature (145)..(162): n is a, c, g, or t
  misc_feature (511)..(538): n is a, c, g, or t
  misc_feature (759)..(759): n is a, c, g, or t
caaaaagtggtgactttgaaagggttggtaaaggtgatttttgcatgttattataagatttaattgtcaatagctcactcaatttttcccgtagaaaaaattnnnnnnnnnnnnnnnnttgggaattaaataggctacaatttcnnnnnnnnnnnnnnnnnngtatctatgatgataatctttctattctgaagaaatagtatattgtgcaacaggtgcagaaaggtactagtttctcacgagtttgaaaagttgcggtacgagcgcaagcgagtgccgcaattcaaacgagtgagaaattgcctttctgcacgtgtttcacactatactttttctacaagcacagtttttcctaaaaataaaaatcacaatttccaaacgacgattaattataataggtacctatgtgataaattttaaactgtatttaattaatacctactaatcaatttaaattccttatacctaaataaattgcacagaaatcagttaaaaaattaatgcactgccnnnnnnnnnnnnnnnnnnnnnnnnnnnnacacattattgacattatatttatgcagtcacggatttacacaaaacatacttcattcgacgtctcttgcacaggttgctaaatccttattggttatttgataattataaaatgtttaataagaataaaattgtaaaataaaacagttgtaacatccataatttagtttctatgctatagttaaatataataattgtcttataggttatatatttgtctanagtttaaccacggatgtaaacagaatataacgttactcagaatgaggtagtcaactgtgcagaaaagaactttgcggcacagaaacgtcactttgcggcacagaaacgtcacttttctgcacactaatgtcaaatatcttatactgtgagaaaatatcaagtttgctaacataaaaaccgtgcagaaaagtgcacttttgaaatagtgggttgtagaaaaaggaaaattttttaaccacacttcaaaaaattcgataatttggcttttgactccattttttttt

SEQ ID NO: 10734 - DNA, 952 bp, Diabrotica virgifera
  misc_feature (919)..(919): n is a, c, g, or t
ggaatctctttaagagttgaacttgttggatgtggagaaatgcaaacttctaccactctaaccgccaaacctactagacataccaccaggccaacccatcgcactagaagacctaccactcgccattcaaccaccactcatagacccacaaccatcattgttcacactacagtagccccacagatttgtgacgatcctatgggtctctctgaaggcaacctatccctttcccaaatttcagtaagttcttctgtcgatgtcagacacgacaaagccagtctgccactcaacagtgaatctgcttggcagccactcaccaactcacctaccgaatggatagtggttgacttcttggaaccaagagaattaactggtttgaccaccaagggaggaccagatggttgggttgaaaattacgttgttgaatattcccacgatggaataaactggaacaaggttatgtatgaacaaaaagaacgaatcttccctggaaacttcaaccagaaccttcctcaagtaaactactttgaattaccaatcatggctagatacttaaaggtcattcctaagaaatggaagaacacaattcagatgagacttgaagtacaaggctgctatctcccataccctactactacccccgaggaagtcacaccatcaactactaccactgcatacgagtgtaactattgtcctggagtaatcgataccaatgttgaacttgacgtttgcaaatgcttaccaaccaaatactgggatggacagagatgcgttgatagacctgaatgtccttgcgtagttggagttgtcaaatatcctgttggagcagtatttgaaaaagaagattgttcagaatgtgtctgtaaacttggtggagttgaatactgtgaaccaaagaaatgtcacccttgtggaccgntcatgagaagcacagtaacagcaacatgtgcct

SEQ ID NO: 10735 - DNA, 804 bp, Diabrotica virgifera
gttacagttaggttaggagtgatatttttcgttttgaaaacaaacagtttggataaagttcataaaaaggagattaacattgttataacaataattttaacctcttatgtgaatatacttttatacctttgattttagcacataattataaaatgttagctctgcaacagtattcgggcagtagtgatgaagatgatacagacaataacaaaaataaagacacctcagtagatataactgaaatccccattaattccgaattttccactaaaaataagcttgccatttgtgccgctccaaatgtactgcctacaggtttagatggagaaaaaaatcatatacatcctgatagtggagaactgacatataatccaaagtatgatatactatttgctcctgtagtagggcctgcaaatccttttaaaacacaacaacaatctgttgagagaaacatactctcgggacatattgaaaaggctcatgtaagtgattttcaattcgaaaaccagagaagaacgtttacgagctatggttacgcattagacccatcgataagtaatgatggagatggacatctaaaagttgtcggttcaactgaagagggtaaaaacgtagaaagtgttaagactgtatttgaaacttcaaagataagacccttggataagaggaaaaggaaaagaaatgataatccgggtgatatagaaggatttttgggaccatggggtggtttttgttgatgaacaaaaaagtttctagaccaacggaggaagaacaggctgagttaaatgaaataacttctaaaaa

SEQ ID NO: 10736 - DNA, 375 bp, Diabrotica virgifera
  misc_feature (7)..(44): n is a, c, g, or t
  misc_feature (113)..(129): n is a, c, g, or t
taacagnnnnnnnnnnnnnnnnnnnnnnnnnnnnnnnnnnnnnntgcgacctcgatgttggattaaagtttataattggtggacacagatatattagtaatggcgatagactnnnnnnnnnnnnnnnnngaggaggtggtgttagggctctgaactaaggagatgagatgccagggtgcgagtatgtgaaggctacctgcctccggtattgtaacgtctatttagctacacttgaaacggtgctctatcctgaacttgttgttagtggaagaagctaaggtagtagatcaagcggaaaagcaatgttggtagatcattaattataactgaagatgaagaaggagattgaagattttcacgaagaagcgattgatt

SEQ ID NO: 10737 - DNA, 623 bp, Diabrotica virgifera
cttaagaacaaagggcacaaattggtggcgttccgctataggtgtaaggtgattgttagatatgtgacacacgccttcctgattttttatacatcgtttaaaccctgatccgacaataagtaaaagcaagacggaccgcactaatgaggtagagagcgggcatacgacaagatgctgcattgtatgccgtagttattgatatagaagtgtgataattctgggggagacattctaagcatatcctagtacatcccatccggtaaattaacataaattcgcctcaaggctatcattattgctggaggaaccagtatctgtgaaagctgataatgttcctatatacgaggctaaaagtgactgaataggtttaacagtgctgacaatatgatatggagggtagatgatgattgaagaatttgcggtgacatccattagaaatgaacctagagaagatggaatttataatttcgaagtatatttaatatgttagctgctcacgggtctctacaaaattctgtctgtactactaactcatggagatgtaatagataaaatagccgaaaattataaaccgattgcacgaagatcgccatttgtgcgccggtatctgcaacgaagagctt

SEQ ID NO: 10738 - DNA, 89 bp, Diabrotica virgifera
gctggacaatatattatatagttaatcactctttttatattaaaaaagtgctggacaatatattatatagttaatcacttttttaatat

SEQ ID NO: 10739 - DNA, 108 bp, Diabrotica virgifera
  misc_feature (2)..(15): n is a, c, g, or t
cnnnnnnnnnnnnnntagctaatttattactatttttatcgtaaaataaatatcctacgaaactgattatgaggtgaattgtattttgacgactacgccattgctcat

SEQ ID NO: 10740 - DNA, 1300 bp, Diabrotica virgifera
  misc_feature (755)..(773): n is a, c, g, or t
  misc_feature (826)..(827): n is a, c, g, or t
  misc_feature (858)..(858): n is a, c, g, or t
  misc_feature (878)..(879): n is a, c, g, or t
  misc_feature (912)..(931): n is a, c, g, or t
  misc_feature (935)..(935): n is a, c, g, or t
  misc_feature (943)..(979): n is a, c, g, or t
  misc_feature (989)..(1020): n is a, c, g, or t
  misc_feature (1024)..(1079): n is a, c, g, or t
  misc_feature (1081)..(1119): n is a, c, g, or t
  misc_feature (1144)..(1170): n is a, c, g, or t
  misc_feature (1186)..(1224): n is a, c, g, or t
  misc_feature (1230)..(1276): n is a, c, g, or t
caatatcactcttgtgttcactatagtttcatagtcttttgtttttcaatatcactccattgagtgctttcgtggcttgttttccccgtactatttttatttctataactttcatacaagtgccacctcggtttatcatttaccctaaatacttaaaagtcttacaactcttaatagtgtcttctaaacttacgtttaaggctatgggtacataattcgcaaatattttacgtgtatccctactttttctgtctttacacggcaaattacgtgtaataaaattcacactggtgtggatatgtaaacattactagaatgtcattctacttgaaaatgtcataattaatttaaagagatggcttttgaatgttcttggataactgttatttttataattgcaaattattaattcagttaataaatgtgataattttttcactaactatgttttcagtgattgtaataatttatttgtacaacaaaaactaataatcaatcgagaaaagaggaaaagtgttaaagtgattttttaataatatgttgttatgttggaacgcttacaattttgaacatctctaacaacaaaatacttggatcacaggatatatctgatgtattctctgcttggatcttccacaaataatacacaataaataactttttattaagttcacgtcttaaatcaattatttatcaaatacactatatatcaataatatttaatcaatttctcaaaatattcccgatgcaatgtnnnnnnnnnnnnnnnnnnnctggattgtcagtgtctgactgacaatatatgctgacataattatattccggnntgagtgcgttttaagacaaagacagatttgngaaatattacaccggcattnngtgttcatttttttccaaatcctgaaaaaccannnnnnnnnnnnnnnnnnnncttnaacgcagnnnnnnnnnnnnnnnnnnnnnnnnnnnnnnnnnnnnngaaacccccnnnnnnnnnnnnnnnnnnnnnnnnnnnnnnnngggnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnncgggggacttttccgcccccccgcnnnnnnnnnnnnnnnnnnnnnnnnnnncgcccccccaaacccnnnnnnnnnnnnnnnnnnnnnnnnnnnnnnnnnnnnnnnggggannnnnnnnnnnnnnnnnnnnnnnnnnnnnnnnnnnnnnnnnnnnnnnatcatgttcgccccccccccccac

SEQ ID NO: 10741 - DNA, 445 bp, Diabrotica virgifera
gttttgtaccgagggtaataatcgcgatctagatagcataggagaagatccacatcaagaaggcgcgtaagagagaggtttcgttgttcatctccaataaataatagccccatcattctgcttattccggaaaacgagaaccatctctatactgggatgtggctccagccagaatggagcccattacacccctcctgtccacagttatgaaagcagctggacatattccagccaatataggtgcgtgaactcctctagcagctgaacctgtagcaggaccgaccatatccaggcaggttgagacgtgtgaatgttggatagttttgtatttggtgtgactgaagacttatgtgatggaatacttcaaccaacaaatcgcaacttgggcggcttatcctcaagccatggataaacctatatctggcgagtctaataaatctcgaca

SEQ ID NO: 10742 - DNA, 1049 bp, Diabrotica virgifera
  misc_feature (139)..(159): n is a, c, g, or t
gttaagttcatgccgtttagagtttaggtcttaagttacaatttataagattataagtaattcataaataaaaaaattctttctggtgaatttttagtgaacagaaggcataaatgaagcttgcagacgattctgaacnnnnnnnnnnnnnnnnnnnnncatacataacactcagttttaaaaagccagacaggtcagtagacttaaggaaatttgtggaagaagtatactctatatttcaaactaatgacataaaatattccaaaacagacatccttacaacatggaaagatttagtagaggattattattactacaagaaaaacttcacaagtgaatatgccagtaatgcatggaatttcttttccttgatggatcgttgttttgaccccaaagatacatctaaaaagtttaattctactttgaccttttacttaattgattgtatgagtaaccatagagatgttatagcgaaaaaaggactaacatcaactgttttatctagtgttgaaaatgatttcaaagaattgggaaacaatgatataaatcaaagtgacatttatattcaatgggaaattctaaaacagtcctttagagagagcaggttacttataaaacaacgatgtagaaacattaagttaaacgagttttatgatgccatgagaatattttaccaaagtccatcatttcatgcttccaaaaactataatggtcctgtaaagagaagaaacggtgcagatcggtgtgaaggtattagtaaaaaaatggatgtaaaaagtgatgatgttgacagacctttcaatacagaactgaaggagcagctacttatctatattaaaagtaaaaagaataaacttggattcaacaaagaactgacaccatcattttcaaattacatagtttgaagaatttaaaaaaattggctataattttactgcagaggctattaataatgagtgggatgatctgtactacaggtaatgaattatttaaatcaagtgaaaaaaccatataaactgggaaattttttctcgggaaaaaaaatggat

SEQ ID NO: 10743 - DNA, 590 bp, Diabrotica virgifera
tttttcatccaacccttcattccagctttccatttaaaaactaatgagtatgataacttagcacggtataaataccgcggcttataaaactaagtcagagtgcatattcccaactatgtgagataatgcagagttggaagaaatgttgatagtaagctttcaacccggaacgccaaagagtatgtatctttatttgtatcgtgttgagagcacacgcgaggacaatgctaaggcagatgaattagacggaatatccaatcaacgcggggcaaggatgaaacgaccgctaagaagtcaaccactcctatgggacatgttcagcactgcccagtggcatggacactacttgcagctagtgcaatgggagaaagagctacctaaacaacctagacaagataacggtgactcgagacagtaggagagaaccggaccgaactagaactacacatgattggaagaggagatgatcgagcgacgggtgcttgctccgatcccatatgaattccttgctgaaggttgtttatcttcaaatagggtcgctctagatattcactaaaaacatagagaggtgtccgctcgaaaggatcccg

SEQ ID NO: 10744 - DNA, 682 bp, Diabrotica virgifera
  misc_feature (193)..(209): n is a, c, g, or t
  misc_feature (415)..(471): n is a, c, g, or t
gcccggcccccccctcccaggccgcaccaccactatgacaacgatgtagctgacccccctattactagctgttgtattaaggtacacggctagttatcctcctcttgccaatgtgttgatgaactatatccccataaaagcgagcaccctggataggttggaacactctttgatggactccttgcaacccgtnnnnnnnnnnnnnnnnnaggcacaaaggagtaggaggtccggggacgtaataggatttatccctcgggaaaagattcggattccctattcttaagacgacttgccaaagctggagagagtgtgcagaagctatcaacactattggcgatcgttccgaatgtccgggtggttgggacctagctgcagcttctgtactgcgtgataagacaatgcataacctccnnnnnnnnnnnnnnnnnnnnnnnnnnnnnnnnnnnnnnnnnnnnnnnnnnnnnnnnnactattgcatggcaaataggatatatggaacgatggacggcggcatcgactaaaaaatggaattcctacccgaggtctttatggcagcaaacaggcctgtcacccatattcccttcaatcttgcgagcatcatacattcggcactaaagtggattgtacgactttgcaattggatacccctacttgcagaactcaatgtaacgatccccgc

SEQ ID NO: 10745 - DNA, 519 bp, Diabrotica virgifera
  misc_feature (164)..(196): n is a, c, g, or t
  misc_feature (474)..(492): n is a, c, g, or t
ggccgactataacgaacaaaatcttcttatttttccatagtctatctcatcgttgataactttgaagcaaaatatttagcgttgagcttaaaatactgtgtagaactcagaaaggaatatgggcaagtaatgtaaagacgattcggctcgggaggcctacatannnnnnnnnnnnnnnnnnnnnnnnnnnnnnnnnattctagcagacaaaagtgactagtggatggtagacgctctggaaataggatttgcacatataaacaatagatgaacttagagagggcccttacgaggatatagaacccactaaaagaggaaactacagaagcggtgtgctaacaggttcaagacgagcggcatgaatctaaaatgaaacacaggaatccttttgagcaaagtgtacaccaactacttcacgcacttcatatgataccactagaaattgctaccgatgttgtgtagagaaccatggtnnnnnnnnnnnnnnnnnnncttatctattctgacgaaattttctgt

SEQ ID NO: 10746 - DNA, 948 bp, Diabrotica virgifera
  misc_feature (548)..(570): n is a, c, g, or t
  misc_feature (653)..(671): n is a, c, g, or t
  misc_feature (810)..(810): n is a, c, g, or t
  misc_feature (820)..(820): n is a, c, g, or t
caccgttagacagactatatctagatttgcccggaaccacgaagataggctccatcgtcacgtgaatgttgaggccctccagctacttgacaacacgaaccagaccagacgtcttagaagaatcaaaccatatgagctagtgtagtgcgcatagtgcggtactaaaccatatgagatagtgtagtgcgcatcgtgcggtagtgtacacgttaattgtagtgtaaataggcgatatgctaatataacctaaagaaatactgatgagtaagattttagcttaaaaaaatgtagttaggttaggttagaattaagttactcattgttccaatagtgaacagattgtaatgttactccgagtggagcattaaaaaaaaacatcatcactaccagatggattatgtcactatataatatgctaacaaattataatttcaaaataaaaatcgaactgtttcaggatttattttcaaagtcgtccattttagagaaaatttattccataattttgaccccctgtctgtatattcattatgtacaatatagaaacnnnnnnnnnnnnnnnnnnnnnnnggcatggatttttttagtatatagtcaaagtgatatcctatgctaaaatagacttcttaatgttactattacgttagattcgnnnnnnnnnnnnnnnnnnngtacttaaattatttgtaaaagtttaaataattatgtgtattaattatagtaatgtaaatattcgtattagggtagtagattgtggtaaatacttgataatttttcctctttttttttactttgttttttctaagatanaaactatatntaatttttgtaacctataaaattctgtatctgtagcagtaggtaatgtaaaataatacttatgcggtatattggattataaccctgtatttctttctaccagtcaagcatatatatatatggatatat

SEQ ID NO: 10747 - DNA, 575 bp, Diabrotica virgifera
  misc_feature (78)..(116): n is a, c, g, or t
gtcttcaattatgaagggtctatgtgacatttgcaggttattgagaaaaatgaagtgaataaaggatctatgtacacnnnnnnnnnnnnnnnnnnnnnnnnnnnnnnnnnnnnnnncgttggtcgagaagtgggaataggtatactagactgtataactgccgagcaattgcatttgttggagctgatccaccaccaatgtttatgagtagtaagaactcaatgaagtagacgttttttgtatgtggattagttattaacaaatacacataacaggagctgaagacacccggcccctactctgccacactggcatacagaattcgcggatgacagtatagacactgctacgagagggcgcggacccgccatgtatctatagactcacttaccaagagaagcagagtcactataggcgtcaataccttaggtgacgaggtcagatactaagtagatgcacctattgggaacaatttagctcaaggttgtggaggaagaatgtcatgtcggcgacttttgcttatagccagaaaatgagcgagccgtccttgtgttgagcaaatttctggaaatagg

SEQ ID NO: 10748 - DNA, 177 bp, Diabrotica virgifera
  misc_feature (9)..(31): n is a, c, g, or t
aaatggcgnnnnnnnnnnnnnnnnnnnnnnntaatcaaagcgatgatgatacaaaaaacgagagtgattactcgtcgaacgaacaggaaactaacttcattgatcttagagactactaatattatgaaactaagactatggcggtaaggaagagtaggctaatgtgtggataacata

SEQ ID NO: 10749 - DNA, 155 bp, Diabrotica virgifera
  misc_feature (2)..(58): n is a, c, g, or t
  misc_feature (60)..(88): n is a, c, g, or t
tnnnnnnnnnnnnnnnnnnnnnnnnnnnnnnnnnnnnnnnnnnnnnnnnnnnnnnnnncnnnnnnnnnnnnnnnnnnnnnnnnnnnnncaataaagcttaatttaattctaagacgcctataaattttaagaattatgaattgtttataaggttt

SEQ ID NO: 10750 - DNA, 186 bp, Diabrotica virgifera
  misc_feature (6)..(159): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattttttgatcccattttttttgatt

SEQ ID NO: 10751 - DNA, 1099 bp, Diabrotica virgifera
  misc_feature (256)..(277): n is a, c, g, or t
  misc_feature (958)..(979): n is a, c, g, or t
  misc_feature (1016)..(1035): n is a, c, g, or t
cagctgtcataaatcccaaacaactattagaaatgtttttggccaaaagagccacaacgctaaatattcgaaatgagagggttagtgaatatgttttgaaagtttgtggacaggacgaatttttaataggagataataaaattattgagtttcagtatgtccaggattgtatttcgagaaatattatgcctactttaatcactttacatatagataaagtgccagtattcaagattaacgattacgaaagtttggnnnnnnnnnnnnnnnnnnnnnntcattcggccccgtttggttcaactaatacgttacggaaaaagaagaacagtctttcttcctggtctatacaagacaattatttagttaaaatatgtacagtgtgtaaattaaactgtgatctaaagaaaacatcagagattggcattcaagcaggtctctttcatggcggaaaatctttatgtcaaccgaaaaagacttttgactgttctatagatgataaatacgagtgttcaattaatactgaactagtctttgacatagatgtgtgcaatataccaagaaacgctaagttgtgttttgttgtttatgaagttaataagtatgcaaaaggaactaagtccagaaaatctaaagattccaacaaggaaaataacttatcaaataatccattagcttgggcgaatacgtcggtatatgatttcaaaggtcagctgaaaagtggggatatgactctgtacatgtgggcttttgcggacgacatgaattcagaacgatgtattacatcccctcggaacagtaagttagtaatctttatattgaacatttactacattgactcttccatcaaaagctattcaactgaccaaactgtaggtttttccatctatcgaccacaattggaaaaaaatgaaaacccacaaaacgaaaaaggagaatcgacaaaatgttgaaatccctnnnnnnnnnnnnnnnnnnnnnnggattccgaccggtttgaaccaaggtcccccacccgnnnnnnnnnnnnnnnnnnnntccctaaaacccacttggcggaaaaaggacccaaaaaaattttccccaaaacttttttattttt

SEQ ID NO: 10752 - DNA, 774 bp, Diabrotica virgifera
  misc_feature (316)..(349): n is a, c, g, or t
ttctcgcgtccggagtaaaagatgaaagaaaactggctgtgcgattaataacaatttttgaatgagtcatatgtatcaaaatgaattatataaatccttttattaggttaatctagatgtacattttcttttatatatcaattgaagagtgttgtgtttcgagttgacccagaagattgataatttaacttacttaacagtaattataacagaaaaatgattcatctattgttcctgtcagtggtttgtgaaatacagaatatagtgtgaaatatgatgttgatacaatgaagtcaagtcatggctaaatccacannnnnnnnnnnnnnnnnnnnnnnnnnnnnnnnnncagacaatttcaactatgaagtgtacgataattttatgtctgggtacattagagttttgacaagaagggcacaaagatggagtaccgtaaaaggtgatgtatataggaaaccaaatgtgctaaagagattcataaggaaaggagtaccaagcaatcagaggactgctgtatggatgagagtgtctggagctgagaatttgagaaattcaacaaatttgagttatggtgccttgaaaaagaacattgataatcaacatattattgacactatacagatagacttacctagaacatttccagaaaatatatactttagcaaccatgaatatcttccgaaagagttgttcaatgtactagccacatttgcacaccaaaacaaagaagtcggctattgtcaaggtctcaactacatagcgggactcttg

SEQ ID NO: 10753 - DNA, 626 bp, Diabrotica virgifera
gaaataacgataccaaaaaggagtatgacattccgagaaatcagatcattaccaaaatcgaaaattatgttgacgctttggtaataatcttcccacttccaagtatcgttcgctgcgcgagatatagagagtgcacggtggaacggcaacctgcagagcaattgcattcgttggagataatatacactattgttatgagtagttgaactactgatgttgtcgtttttgttctttataaggtattaacaaatacagatatcaggtatctttgagacccgccgtcaaacctgtgattatggaataaaaaccacctgatgaaagctataacagcgtctagtagtgtcccaggaactgctaccctgtgacacatttacagacgtgacagcagatatactatacgcctcaatacgttaggttaacatatcaagataaagatatatgaccacattcgtacaaattctgctaaatgttgtggacatcgactgtcagactatctacttttacttatagtcagataatgagttaggagtggtttatatgacaatgtcccgaaataccgtttaatataccaaagggcaactctagtgttccacgaccaacacaaatctctcaggatcgactttacc

SEQ ID NO: 10754 - DNA, 173 bp, Diabrotica virgifera
  misc_feature (10)..(104): n is a, c, g, or t
  misc_feature (110)..(160): n is a, c, g, or t
gtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnntccatttttttga

SEQ ID NO: 10755 - DNA, 732 bp, Diabrotica virgifera
  misc_feature (2)..(15): n is a, c, g, or t
  misc_feature (20)..(322): n is a, c, g, or t
  misc_feature (324)..(494): n is a, c, g, or t
  misc_feature (501)..(538): n is a, c, g, or t
  misc_feature (558)..(571): n is a, c, g, or t
  misc_feature (574)..(596): n is a, c, g, or t
  misc_feature (604)..(626): n is a, c, g, or t
  misc_feature (656)..(687): n is a, c, g, or t
  misc_feature (694)..(730): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnat

SEQ ID NO: 10756 - DNA, 200 bp, Diabrotica virgifera
  misc_feature (7)..(45): n is a, c, g, or t
  misc_feature (67)..(67): n is a, c, g, or t
  misc_feature (81)..(103): n is a, c, g, or t
  misc_feature (111)..(133): n is a, c, g, or t
  misc_feature (163)..(194): n is a, c, g, or t
taacagnnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10757 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (167)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttgggttctatcnnnnnnnnnnnnnnnnnnnnnnnnncaaaaggac

SEQ ID NO: 10758 - DNA, 744 bp, Diabrotica virgifera
ggcgtttgatcatttcgtggatttgatctcttttcttatttcaagacttttcgaacctatcaaaaaatagcgccatgttatgaatgacgaaggatgacagtaagatcttattatcgtccactacaatggacctcacatgatgatttttacctttgggtctccagggcacttgaccaaaaaagatgacgatgaggtaaccacgacgatgtacaaaaaatacgcaaagaggacttccccctgagaatattatgatgataccacccacaaaccatcaaaacatgtagccgaaatgacgacaaatacaaaagaactgatgactatgatcttcgtatatcgagattcaactattaagactaataaaggcgtgataaccctgatgatgaaataaaattaacattcgacaacttctacctgagtttttcacgacatcccttcgcataattagacaggtttgagactcatgactatgtgataaatttaagatgctaatgtgtcaatcattagataatgaaaggctgcctagtagaatgtaatttatgtgaaaatcatggtgttgtattgtagaattaccattactgcttcaatcttcgagaattttcggacacagaaatttcttaattgtatctagtgtttttgcatgacgatatttattatttgctgatgattttgcactatgtatcttcttgttacatttataatagagaggaacgagagaagagagtattatagtgcattctagattag

SEQ ID NO: 10759 - DNA, 68 bp, Diabrotica virgifera
  misc_feature (2)..(67): n is a, c, g, or t
cnnnnnnnnnnnnnnnnnnnnnnnnnnnnnnnnnnnnnnnnnnnnnnnnnnnnnnnnnnnnnnnnnnc

SEQ ID NO: 10760 - DNA, 62 bp, Diabrotica virgifera
  misc_feature (11)..(54): n is a, c, g, or t
aaataaatttnnnnnnnnnnnnnnnnnnnnnnnnnnnnnnnnnnnnnnnnnnnncaattttt

SEQ ID NO: 10761 - DNA, 100 bp, Diabrotica virgifera
  misc_feature (6)..(6): n is a, c, g, or t
  misc_feature (16)..(31): n is a, c, g, or t
  misc_feature (34)..(92): n is a, c, g, or t
atttanttatataatnnnnnnnnnnnnnnnnggnnnnnnnnnnnnnnnnnnnnnnnnnnnnnnnnnnnnnnnnnnnnnnnnnnnnnnnnnnncatttttt

SEQ ID NO: 10762 - DNA, 62 bp, Diabrotica virgifera
  misc_feature (2)..(53): n is a, c, g, or t
  misc_feature (60)..(60): n is a, c, g, or t
gnnnnnnnnnnnnnnnnnnnnnnnnnnnnnnnnnnnnnnnnnnnnnnnnnnnnatttatnta

SEQ ID NO: 10763 - DNA, 462 bp, Diabrotica virgifera
  misc_feature (5)..(24): n is a, c, g, or t
  misc_feature (243)..(263): n is a, c, g, or t
cgcgnnnnnnnnnnnnnnnnnnnngatgaatctataaaaatattattgttagtgaattttgctatgttgacgagtataatgaaagtatgaatctgaatggattatcatgattgtgccatgtaatacacgttttaaatatgaatgattactcatccattagttggtcctactcaacacgattcctaaaaattaaggttttatattgtaaaataattgatgtacaataatttttatgcagggatnnnnnnnnnnnnnnnnnnnnnttatctattttgtgaagatatggattagatttatttatcaactacatatatgagaagtacaaatgctgtgtccaccatcaacatcaattaacctaacgccatcagctgacatagtagatttaattaaactttaatgtatgaatacaactaaggattaataattttcctattttgtcagactgctgtcatttattcttat

SEQ ID NO: 10764 - DNA, 306 bp, Diabrotica virgifera
  misc_feature (8)..(72): n is a, c, g, or t
aaaatacnnnnnnnnnnnnnnnnnnnnnnnnnnnnnnnnnnnnnnnnnnnnnnnnnnnnnnnnnnnnnnnnngatgttgatcacggaactaggtgatgttctcgacacttggatgtgggcaagtcttaggaggacgattcggctcgggaggagtacctactaatcaaggagcaaggagatttccccccttttattttttcagaaaaacatcgcgacaggactagtagctgcgcagaatatgacattcccacctacaaagaatagaagcatgtaggcaggatcccccacaacctcctccccccccac

SEQ ID NO: 10765 - DNA, 355 bp, Diabrotica virgifera
  misc_feature (11)..(52): n is a, c, g, or t
taagagctatnnnnnnnnnnnnnnnnnnnnnnnnnnnnnnnnnnnnnnnnnnctgatgtaatgaaatgccatccctgtgaaaatataatgattttattacttaaaagctagattttgatatatggcataaagtatagagtaatcttaaaatatctcagactgatgccgtatccgctctttttataaattgggctccttttgaataaattatttttacctggactacccactaatggatcgtagctggagagcatgatttgcgtcgccgagtacgtattcttgattcttaatgctgaattgataacagaattgtatgtgataggtcattaaaagactgtcattactatattgaaat

SEQ ID NO: 10766 - DNA, 1132 bp, Diabrotica virgifera
  misc_feature (13)..(43): n is a, c, g, or t
  misc_feature (45)..(697): n is a, c, g, or t
  misc_feature (740)..(759): n is a, c, g, or t
  misc_feature (761)..(779): n is a, c, g, or t
  misc_feature (792)..(859): n is a, c, g, or t
  misc_feature (870)..(936): n is a, c, g, or t
  misc_feature (943)..(999): n is a, c, g, or t
  misc_feature (1001)..(1037): n is a, c, g, or t
  misc_feature (1084)..(1101): n is a, c, g, or t
ccctaacgtccgnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggccgcgggatttttgacccgggtaagggaaaataaatnnnnnnnnnnnnnnnnnnnngnnnnnnnnnnnnnnnnnnngaaaaaaaattgnnnnnnnnnnnnnnnnnnnnnnnnnnnnnnnnnnnnnnnnnnnnnnnnnnnnnnnnnnnnnnnnnnnncccataagagnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnntcacggggtaacgggggggatttttttttgtgggaggagtcccaatnnnnnnnnnnnnnnnnnncgacccccccgggggggttttaaaaaggttt

SEQ ID NO: 10767 - DNA, 232 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (139)..(139): n is a, c, g, or t
  misc_feature (162)..(193): n is a, c, g, or t
  misc_feature (204)..(204): n is a, c, g, or t
  misc_feature (220)..(220): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngaaaggaccanatatataaaataattnttatatttagat

SEQ ID NO: 10768 - DNA, 566 bp, Diabrotica virgifera
aaagaaagttgctgagaaaaattttggaaagaagacagatggtaaagaatatttggagtagacgaacaaaataaagaaagaatgcggatgtgtgaaaaaccaataagtatggcaaaaatacgagtttaaagaggtagatgggggggtagtagggggatgggggagatattcttctatacaatcatacatgtcttatcactcttcatattgaatactaaattataaacctcattccttactactcccataactaccacgaactatatacatctaattatggaggatgaaaattagcatatatatatatttagaatacatttgttgtaaaagatttttatacccataatattaagtattattatggttgagctcaattctaaaattttatcaggctgcaattttttccttaaatattaggattgaaacatgtcgtatattactatatgttattatatattttgttatattagtatcgctacaggttgtgcagtgtcgatctcagtataaatacagattattttagttaagaaccgatcattaggttaggatgataacatacagtgttt

SEQ ID NO: 10769 - DNA, 434 bp, Diabrotica virgifera
  misc_feature (126)..(143): n is a, c, g, or t
  misc_feature (145)..(158): n is a, c, g, or t
  misc_feature (160)..(177): n is a, c, g, or t
aggaaaaagtgaaaaataaaacatacgccattttcacaaaaattaaaatttataattatccttccaataacttctttatattagcataagaaatgatttcaataattttgaccggttcagaatgcnnnnnnnnnnnnnnnnnnannnnnnnnnnnnnncnnnnnnnnnnnnnnnnnngtaattttcatattcttttgataacaactccaaaaatgctcagtatacgtaaaaaattataaatacccaaattttagtttattatgtgtcaaatattttacctgttttactattccatagggtgataaataagcgagatagaaacgggtatatctaaagtagtggagcgtaagcaaagcaacggaatgaatgtgagcattaagatgattcaggtaggtgtgaatgagatggcatgatggtagaatagagaagcatat

SEQ ID NO: 10770 - DNA, 216 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattctt

SEQ ID NO: 10771 - DNA, 198 bp, Diabrotica virgifera
  misc_feature (77)..(99): n is a, c, g, or t
  misc_feature (108)..(129): n is a, c, g, or t
  misc_feature (162)..(188): n is a, c, g, or t
taacagcgtaatttattggagagtcaaatcgataataaagatgcgacctcgatgttggattaaagtttatatttggnnnnnnnnnnnnnnnnnnnnnnntgttcgacnnnnnnnnnnnnnnnnnnnnnnagtttaaacggtgtgagccaggtttggttctannnnnnnnnnnnnnnnnnnnnnnnnnncgaaaagacc

SEQ ID NO: 10772 - DNA, 565 bp, Diabrotica virgifera
  misc_feature (11)..(30): n is a, c, g, or t
  misc_feature (44)..(69): n is a, c, g, or t
  misc_feature (77)..(114): n is a, c, g, or t
  misc_feature (117)..(132): n is a, c, g, or t
cgctgcccttnnnnnnnnnnnnnnnnnnnntctaggtgccttcnnnnnnnnnnnnnnnnnnnnnnnnnnccataacnnnnnnnnnnnnnnnnnnnnnnnnnnnnnnnnnnnnnntgnnnnnnnnnnnnnnnnctaaaaaatcgaggaacacaatgctaaatacgaaagtggaaaagaaaactacgacttggctcgcagctatttcgccttgtttcccagtgctgattatcattcgttgctaacttgaaagccagattagtgaaaaccagggacagttatgtgaaatcttaaaatatccaaaactgatgtcttttctgttcttttataaattgtgctcctttttaataaattatgttatctggaataccgaagaatggctcatgcaacggatcatgaatgcgtcaccctgtataatttcttcgatcttaatgcagaattaaaaatattattgtatttgatatgttatttaatgattttcatttctatactgaactgagtatttgatgttctttttaggattattatttcatgaaaataaggagataactaaaaaatgtgtgatgaa

SEQ ID NO: 10773 - DNA, 560 bp, Diabrotica virgifera
  misc_feature (22)..(321): n is a, c, g, or t
  misc_feature (328)..(365): n is a, c, g, or t
  misc_feature (385)..(398): n is a, c, g, or t
  misc_feature (401)..(423): n is a, c, g, or t
  misc_feature (431)..(453): n is a, c, g, or t
  misc_feature (483)..(514): n is a, c, g, or t
  misc_feature (521)..(557): n is a, c, g, or t
gattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnatt

SEQ ID NO: 10774 - DNA, 514 bp, Diabrotica virgifera
gtacagaagatcattattgatcgttagaccacagagaaatagttcatgtggatgggtgttctccctcgtgtatataactaaaaagcttatatccaaatctgttccctcttaaacggcccataacaacaaactgttatattgctgatagattcttattccatctattaccatggtcccagaagcaattctggctgaatatgtgcctcagatacgtcgaacgaagaagacactattactatatagcatatcgatcctattctgttatatatagttataacaagctacatcctttactgtgtgctacctaactagattttttctcggactaaattgtggctgtaccataactgtattaccaatttcacattgcagaaatatgtgaagatttcaatatacgaattcctggttgcattatgtataacatgggacctaaaggaaaatttatcccttatgctaatgcacctgtagcttctattcttatgatttgactatcttgcaattattttgtcaaaaa

SEQ ID NO: 10775 - DNA, 857 bp, Diabrotica virgifera
  misc_feature (235)..(263): n is a, c, g, or t
  misc_feature (315)..(333): n is a, c, g, or t
  misc_feature (464)..(479): n is a, c, g, or t
  misc_feature (481)..(502): n is a, c, g, or t
  misc_feature (571)..(589): n is a, c, g, or t
  misc_feature (649)..(670): n is a, c, g, or t
  misc_feature (716)..(731): n is a, c, g, or t
  misc_feature (733)..(751): n is a, c, g, or t
  misc_feature (770)..(770): n is a, c, g, or t
  misc_feature (828)..(828): n is a, c, g, or t
  misc_feature (840)..(840): n is a, c, g, or t
ggcagtttaatcaagcaggtaatttgaaaacacatttgagagcacacatcggtgaaaaaccatacaagtgtcaaatttgtcttaagcggttttctgaaccatacattatgaaagttcatttaaggaaacacactggagaaacaccttataactgtgaaacttgtttaaagccgtttattacatccagtcagttgaaacaacatttaacaacgcacactggagaaaagatttatgnnnnnnnnnnnnnnnnnnnnnnnnnnnnncgagcaggttatttgaaaacacatttgagagtgcacactggagaaaaatcannnnnnnnnnnnnnnnnnncgaagcagttttctcaagcaggttcactgaaacttcatttaagaaagcacactggagacaaattttataagtgtgagatttgtttaaaacagttcactgaaggaggtactttaaaaaagcatttgagagtnnnnnnnnnnnnnnnntnnnnnnnnnnnnnnnnnnnnnngaagcatttttctcaggcaggctctttaaaaacacatttgagagtacacacaggagaaaaatcttacgnnnnnnnnnnnnnnnnnnnacagtttagtcaagcaggcagtttgaaaacacatttgagagtgcacacgggagaaaaatnnnnnnnnnnnnnnnnnnnnnngaagcagttttctcaggcaggttcgttaaaaatgcatttgagagtnnnnnnnnnnnnnnnntnnnnnnnnnnnnnnnnnnncttgaaaagttttcttcangggaagttctttgaaaacacacttgaaagtgcatagtgaagaaaatcgtacaagtgtngaatttgtttanacagttaacctatgccc

SEQ ID NO: 10776 - DNA, 1006 bp, Diabrotica virgifera
  misc_feature (162)..(185): n is a, c, g, or t
  misc_feature (198)..(215): n is a, c, g, or t
  misc_feature (249)..(271): n is a, c, g, or t
  misc_feature (497)..(517): n is a, c, g, or t
  misc_feature (596)..(615): n is a, c, g, or t
  misc_feature (680)..(728): n is a, c, g, or t
  misc_feature (895)..(895): n is a, c, g, or t
ctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattattcttaattttattatttgagaagctntttctttttcacgaaaaagattaagaacctttagaataacttcttcaattttgatgactacatttaacctccagctgaacacagatattctgaaattgccatattatcatc

SEQ ID NO: 10777 - DNA, 967 bp, Diabrotica virgifera
  misc_feature (741)..(764): n is a, c, g, or t
  misc_feature (787)..(787): n is a, c, g, or t
  misc_feature (816)..(816): n is a, c, g, or t
gatagaattgatagagacactttgaaagaaacggaagatctcttcaatgaaattagaggtctagaacacttaataaaaatgaagacttcagaaaaaaaagaaatatcatactttaagaaaaagcaagcctgcaaaatttgtgaaaaagaaggaaaaggtttacgttaccatctggaatcaagttgctggttcagaagcaaaagtgaagttccgaaaaatcaagaggtaagaactgtcaacaaccataaactagaattagaattaaacgaaacaaatccaaaaaactgttaattccaccactaattagaatcaagttactattaaatgacactttagagatctatggagtatatgactcaggatcaaatgtatcattggttaatgcaaaattattacagataaaggcacataatagagatgaccttcaactagtaaacttgaggacaattaatggtgtgaaaaaaacaaatggtatagtaacacctaagataaaaatctatgacattgaacaaaaaatgaatgtatttattgtagatgatgaaaatttcaattatgatttcttaattgggttagattgtattaaaagttttagattaattcaaaatgaggatctaaggatcacacgatgcaacagctctaaagaaattgaaaatttgtcaactattgataataatgtaagcattcctgagtttccaggtaacatatatgtaaatgcatctaatgaaaagattaatgatatannnnnnnnnnnnnnnnnnnnnnnngagagtataaatactgataattntgaaatagcaattaatcatttagatttanatcagcaatcaaaaattgaacaattgattaataaatataaatcagcatttgctaaagacaaatatgatgtaggtactataagagagtatgaagctcatattgactttagtgtagataaatactggctccaacgtccatatagatgtaccat

SEQ ID NO: 10778 - DNA, 875 bp, Diabrotica virgifera
  misc_feature (314)..(334): n is a, c, g, or t
  misc_feature (462)..(485): n is a, c, g, or t
  misc_feature (684)..(703): n is a, c, g, or t
aactgttcagaacatcaatattcgcgacaattttttctcttgcgtacttcgaatttttcgcaacaattacattgtatcaataatgagaatatttatttgtataatagagtattctcacggcattcgatatttatgtaaacgtgatttttgctaaccttgttgttgcattataacaacttatataaataatttatcgaaaacagacaattttctaatgagtcattattcactgctttgtcacattgtttccaaatgttaattatcagtcctttctaaattaaaagccagattatgaaaaatcgaagacagttatnnnnnnnnnnnnnnnnnnnnnaactgatcacttttctgttcttttataaattgtgctcctttttagtaaattaagttttctggaataccgaagaatggctcatacaacggatcatgaatgcgacaccctgtataatttcttcgttcatnnnnnnnnnnnnnnnnnnnnnnnntatttgatatgttatttaatgtttttcatttctagtttgaactgagtatttgattttctttttagtattattagatcagtagaagaaggaaataactaaaaaatgtgcgatgaagctttcctaggtgcttcccaggttgagatatatcacccgtttaaactctagcacttaatacacaagcgtgaaattatggaagtgnnnnnnnnnnnnnnnnnnnncagtatcaaaatgtttcctttaaatatcagataagataaaaattagttagctttacacaattctggattattttggacgagcgatatatctcttgattgaactttactattatacaataaattcaaaaaaactgactaacacgaccgagagacaactatttttctctaatat

SEQ ID NO: 10779 - DNA, 497 bp, Diabrotica virgifera
  misc_feature (7)..(207): n is a, c, g, or t
  misc_feature (214)..(251): n is a, c, g, or t
  misc_feature (271)..(284): n is a, c, g, or t
  misc_feature (287)..(309): n is a, c, g, or t
  misc_feature (317)..(339): n is a, c, g, or t
  misc_feature (369)..(400): n is a, c, g, or t
  misc_feature (407)..(483): n is a, c, g, or t
caccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnggcgcacaagaggg

SEQ ID NO: 10780 - DNA, 594 bp, Diabrotica virgifera
  misc_feature (167)..(185): n is a, c, g, or t
ccctttcgggggcgcgaacgcgggaaaagaacacaggggcggcccctttgtagaggagaatctgattttatgatatgttatcagaattgagagagaatatgtgatgttgataaaagagatatttattttgtgcacctcgtggagcccgcagtattaaactgataatnnnnnnnnnnnnnnnnnnnaatataaaaaagctaaagaattaaaacttgtattgtaggagaagtattttcactgattcattggagacgcgaatgataggcggatttaccatctagctaatattatcttgacaataaatgatgtgtatttgttaacaatacagttatacttatctattttggtattaggagtattaagtatttgtaggtctgaggtgagtaatagaatgtaattacaggctagtttttctttaagggtaaggttccgcccttctcctatgtcatgatacgatatcatcgatttttatatatgaatatgattacgttttatggagtgtttattaaaatataagcttagaatatttaaatggagccatgcggacgagtactagagttgaaacattggttatttcgggagtggatatagggt

SEQ ID NO: 10781 - DNA, 688 bp, Diabrotica virgifera
  misc_feature (270)..(284): n is a, c, g, or t
aaattagtatgaacaattcaaaatgagacttttttcaaaaattgtcgattctaaaaacgaaaacataacttcctcttattcttcgtacaaagaatcatatagtataaacaaaagctcaagttctaaatatgttcctttatctgcaccatcaactccttctagtaactggcctacaaaatcattcgatttaacgaaaagtgcgagcattaatgaagtcctagaaggttctaaaaatttcaagccttctgatagtaaggatccttcgacaannnnnnnnnnnnnnnaacttacggaaaaagtattcagagttaaatcggatgaaaatgctcccccaaagccaccaattaaccttgaaaaaatcttcacccccgccgatggagaacaaattaaacctactaaatgtcgaaaagtatttgcttcttcggcattttacgaaaaaggattccatccaaaggatgagagatagattctcgagagccaacagaatatcaagatctgtggctagaaggaaggaaaagcacaaccgagtgtgcgtgcccatgagctcgattcaaatgatgagatttgttgaatgatatgacgaaagacaaggtcagggaatgattgaaggctagggataccgaggaggatgaagaaacggatgaggaaaatcatgctcgcactcagaatacctccacgttgtggtggt

SEQ ID NO: 10782 - DNA, 928 bp, Diabrotica virgifera
  misc_feature (312)..(401): n is a, c, g, or t
gtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgccaaaacgctttcattgatcaagaacgaaagttagaggttcaaaggcgatcagataccgccctagttctaaccataaacaatgccagctaacgatttgcccacgttcctccgaatgatcggcgaacaagtttcgggaaaacaaaaatttttgggttccgggggaaaaataggtgcc

SEQ ID NO: 10783 - DNA, 922 bp, Diabrotica virgifera
tttcttttcttctagtgacactagcgacactggcggcaatgtttctagctagtgtttcatagaatagacgaagtgatcttttcgttttataaacgaagccactttgactgagactattaacaatattgtgatttgatttaggtttttattagttagaaagtgacatttacgtttatatcatcaaattcattgacgccaaataaatacacattacaataattttagttaaaacatgtaaaaaacctattttttactcataagttaaactgtaaaatactacaagagttaagcttcatttgcatttgacaggtttactgactgaaagtgcttccggccgctaaacttgccatgtgtaaacaataggcaagcgcttgctagacagaccgactagtttacttgccacttgcccactatttgctaagctatcaccagtagcaagatatcgtaatgttagttctacttatgtttcaggacaagcaggacttctcatccatgtttcagactttgtaggtttagattcaactagttttgacagtttttgaaacttttagttagataacctcatgaaaatccttcaactctatctcctttaccagttgttctaaacacacccagagtatttctacgccttatacaatctctaatccaaactcatttttcctgtttttcttgcgttgtaacgactattgaactgttggcagtttgacttgccaaaacattgacagctgcacggactactgcgcttggagtcattttcttgtctaactattagcaaataaacttgaaaatatgaagacggaaaaccacaagcaaatgcttttcagcccagtaaactttgccaaagtattacactttgccaagtttactggccgaagggacctgtaaccactaaacttggtttgtgggacactgcctatatatt

SEQ ID NO: 10784 - DNA, 261 bp, Diabrotica virgifera
  misc_feature (198)..(219): n is a, c, g, or t
ggccccgggcccggttcccgggtcccccccccccgccccgtttgaccggagctgttttgattgtcagtgatgataatcctcagaaagtgatacctcatcacggtagtgatggactcgtgataatttactataaagaagatttgcgaataatttgtgtgtgaacacgtcctgcatcaatcattataactgaataattgnnnnnnnnnnnnnnnnnnnnnncagacgcataaaggataccggtggcattgatgtttaaatcgt

SEQ ID NO: 10785 - DNA, 694 bp, Diabrotica virgifera
ccctttttaatcgcaggtgctcaagcttcccctatagagagactgtattagagcttagcgtaatgttgattataaccgattcctgatacctactactaccattaccataataacaatactacgtgaaagggacacccccaacatatgcacaagaattaactgtatcacaatatcgatcatcctctcattttttattttctctataactaaccttccacctgattcaaagcaaatgtcatcaatacaaactacgaattaaacaatactttattcttcataatactacatcaatttttaccatgatacaaattcccccttcaacatctataccctactatataaaaaatactcactcaataatctactttaatactatttcactttaacacttctacctggcattctcgatactacagataatccctacaataatcataggatattcacgtaactaccaaatcaatacttacgtaagagaataacttttctcttgattcattgttccacaaaatgagcttaacagaatacttcgtgcgcacagttatacatcaacatgactaattaaatctacaacttaaaaatcaagaaaaaaaattatcacaaacatcccctgttgtatcaaaccactcttctgtaccttaccatatctaatacattgcaacttactgcaccacaaatccacaccacataaccc

SEQ ID NO: 10786 - DNA, 676 bp, Diabrotica virgifera
  misc_feature (91)..(108): n is a, c, g, or t
  misc_feature (376)..(403): n is a, c, g, or t
tggaagtgtgtgtattttgtttatttctttttgtcagataaattcaataaaagttactttcgtctgatgtgcggacagttactagaaacgnnnnnnnnnnnnnnnnnnccatgaacaaccgaacggttctgtgggaccccaatgcggacaaacgcaatacgacgttaaggcaacccaaaggattaactattacacagcagtctgcaccctcaagttctccaaatacaactcctagagatgaaacacctcgtctaagtagtaaatcactcgtggatagggaaacgttggtggctaattcaacgttgaacgcaagtgctactgaatggtatcctaaaaatatttatactccttctccagttgaagttattacctctannnnnnnnnnnnnnnnnnnnnnnnnnnnagagtgtccacaagtaaataatattaataatgagggtacagaagaatactcaccggacctaaatcggattaaacaaataattaccacactaacaaaagatcctggacaatttcatgatttgatagacctgtttatggaaacgttggtaccatatcttgaagatattatgataacatccttagtagctgaaattattgctgaacaggcgataaactctcccaactttaggtatacagcaacgagtgtgtgttggattattgatccggtttctcc

SEQ ID NO: 10787 - DNA, 224 bp, Diabrotica virgifera
  misc_feature (4)..(210): n is a, c, g, or t
agcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtatttt

SEQ ID NO: 10788 - DNA, 325 bp, Diabrotica virgifera
ggtagagatagatattaaagagtatatggggatgatgagcgaaaagagtgttgccagttgataccgctacaagaagagtgtaagagaggggaaacgctgagtgatgcttggacatgaaggagatacaggtatagagactgatgttgatggaagtcagaagaatcaagatgtgaggatggaaatgggagaagaaagatccagaggtaggtgatgagtgcacaaagaaataattgtagcgagacatatgaatacgtacaatagagagggattatgcagaaacagacaaattatagagaaatgtggtcatcatagattagtctatggg

SEQ ID NO: 10789 - DNA, 594 bp, Diabrotica virgifera
  misc_feature (282)..(299): n is a, c, g, or t
  misc_feature (319)..(362): n is a, c, g, or t
  misc_feature (364)..(376): n is a, c, g, or t
  misc_feature (423)..(489): n is a, c, g, or t
  misc_feature (495)..(517): n is a, c, g, or t
cggtgatttatctttaagttgtattttaactttgcactaaatatttgatttaatggtaggtccttaatatagcgagagcatattttatcttcataaaagaagaattgattctgtgtaccatgtgccgcagcaatactcaacttttagagtacatatttattatttcccttttcacattatcttgcaatttctaatttttatagcgcaacaaatatttcatatatcttttctgtaatgagacgagattcgctatcaaatatatctaatattgtaagaaatccnnnnnnnnnnnnnnnnnncaacatattacatcattgcnnnnnnnnnnnnnnnnnnnnnnnnnnnnnnnnnnnnnnnnnnnncnnnnnnnnnnnnncttcaaattctaatttatatataaaaattacgactgaaaattgtccnnnnnnnnnnnnnnnnnnnnnnnnnnnnnnnnnnnnnnnnnnnnnnnnnnnnnnnnnnnnnnnnnnngaatannnnnnnnnnnnnnnnnnnnnnnctaatgatcataatattacaatttcactaattgtatattgagtatagatatataggtatccccaaccgaatgcggca

SEQ ID NO: 10790 - DNA, 852 bp, Diabrotica virgifera
  misc_feature (81)..(98): n is a, c, g, or t
  misc_feature (197)..(218): n is a, c, g, or t
  misc_feature (725)..(743): n is a, c, g, or t
  misc_feature (799)..(820): n is a, c, g, or t
cctttagggtccatgttaattagtgccagattgtttagtagcacctttgaaccatttaatatactgatagatgattagacnnnnnnnnnnnnnnnnnnctttgtattggctaaaatgtaattgtttgaaccttgccaagcagaatactactacctataaggaatatgttcgatgattcttcttttggaatcaagagnnnnnnnnnnnnnnnnnnnnnnaactgtatctcttactaatttttttgttgtgaatagagatgcggatgtatatatatcaactttgttgagaaaaattttgagattatttgttaaccatatacattgtaggtagatatttttagattatgagtattaaatattattacttacgctttttgaaacacagtttcattaccatacatctttttgaagaatccgtaggtagtatatatgttcctattatatactctggtagtatttattcttatatagtattatgattatttgctatagctattgaattgagatatgaaggtgaattattcacgataagatcattggtgaatgtatgatgattacgagaatgtatatgtggtagaaccatatattattcaaaactcgactttgagtacatttatgacgcctgattattaagaccttgtcttaatgtatgaaagatcaagactcttcctgcccgctaactgattcgaatgacagcgacatttagaccgtgctatggaaacatannnnnnnnnnnnnnnnnnnacagtcagaattgcgaggttgcatgagaatagaattgactttatttcattaatagnnnnnnnnnnnnnnnnnnnnnncccttataatgtttttaaagacgactaaccct

SEQ ID NO: 10791 - DNA, 258 bp, Diabrotica virgifera
  misc_feature (2)..(40): n is a, c, g, or t
  misc_feature (46)..(68): n is a, c, g, or t
cnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 10792 - DNA, 184 bp, Diabrotica virgifera
  misc_feature (45)..(76): n is a, c, g, or t
gaaacttttatgtttgacaaagaaaaattattaccagaatattannnnnnnnnnnnnnnnnnnnnnnnnnnnnnnntggagacttgttgctgacgtgactaataatgttgacaataatggaaggaaaaatatatgcctaaaatcagatgaaaattgtgtaatataggaatgccctattggcgct

SEQ ID NO: 10793 - DNA, 390 bp, Diabrotica virgifera
aaactgacgaccacattcaagattactgcataatagtccgttaaaaggttcaaatgacaacatctgttgtgaaatcgagtatattttgtgagatgtgttgatggcgggtacggatacttcttttctggatgacatattcgtataagacggagcttgtaatgagagcaggtatattttgtaaaattgcggcccggagcagtggcttggagcccaagcaagcaattttagttacgcgggcaagtcactagaggataacaggtctaaagcgcttcacgctagcctgaatttacaatcgattagggcatcacgttggaggtttgttacccagaactcccacgtgaagagcatttggctcatagttgtgtacctattgaggatcagagtgctata

SEQ ID NO: 10794 - DNA, 396 bp, Diabrotica virgifera
  misc_feature (2)..(203): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgaatatttagtaaatctatatggagtttagatataaaggataccgctatctaaatgtgcatatgaagtgtataaacaacttccgctggctcattggaatatgaaattttatttcgagaaccaatttgtgggagcggcatatattatcaagaacaatccattgattacaattatcatgactgatttagca

SEQ ID NO: 10795 - DNA, 236 bp, Diabrotica virgifera
  misc_feature (4)..(32): n is a, c, g, or t
  misc_feature (34)..(80): n is a, c, g, or t
  misc_feature (87)..(187): n is a, c, g, or t
  misc_feature (205)..(225): n is a, c, g, or t
gacnnnnnnnnnnnnnnnnnnnnnnnnnnnnngnnnnnnnnnnnnnnnnnnnnnnnnnnnnnnnnnnnnnnnnnnnnnnngggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaagggaaaacccgcnnnnnnnnnnnnnnnnnnnnngtcccaaatcc

SEQ ID NO: 10796 - DNA, 622 bp, Diabrotica virgifera
  misc_feature (13)..(32): n is a, c, g, or t
  misc_feature (87)..(105): n is a, c, g, or t
tttatatgtttgnnnnnnnnnnnnnnnnnnnnctatgagaaaagaaaaattatatcgaacggtaggtattaagtattgacgacagannnnnnnnnnnnnnnnnnngaacgaccgcttatctggaacgcataggacaggggaacatctgactacatcaataggacgacggccttaacgacacagaacgcgagacatcttgtactagtccagcattgatagtcgacatcccttcccgtgatatcgatggatgatcgttcgactagggatagttgcaacatagacccgggtgcgatggagagggtgaaacaacgattggtaactccatgtgctaattcctatgatgaatgtcctttgtatgcgagatttgtcttggaggtgtcacagatttaatttgatctattgatctcgggactgtacaatgtagccgccgtgtaatcactgttgtgtaagatgttgcggaataggaaaggggcatattctgtgaatgttttatgaagagaacatgaccgagcagctttcaccccggacgatcactagcgaaatgtcggagtaccaaaaaggccctgcaacatgaaccggacgccccggatgaagatgcccgtgatacgagaagggcttgccc

SEQ ID NO: 10797 - DNA, 577 bp, Diabrotica virgifera
  misc_feature (235)..(235): n is a, c, g, or t
acagagatagaaaacaaaaactaaacaagacagacgagagaaaaccaagccgccgaaccagacgcacacaaaggagccgaaaggagcaaagctggacaagcagcagaggacggaccacgaggagaagaccccgcaagggaagcacgcccaagacaacaggacgagacgacaggaacgggacaaaaaaaacccaaaggaggcgacgaaacacaaagaaaaaaaggaagcccgaccnaagaaaaccccaacgagaacggaaaaggcacaaacagcgatgacagggagaaaaccgggcaacacacgagccacaaggaacacagaggaaacccagaagaacacaccgccctgccgaccgaagcacatctcagtcacaattgcttcagagaatagatgagactaatgaagtttgaaacttctatcacacacagcatgtatgttgacattcatgctggagtctccttgtatgcgatccgttcttacctctgcaattgcgttggattcaggtgatggagtatcccagacagacaaatcctatgaaggtaatgattcttcttcatgcacttcttccattggacct

SEQ ID NO: 10798 - DNA, 176 bp, Diabrotica virgifera
  misc_feature (2)..(31): n is a, c, g, or t
  misc_feature (33)..(103): n is a, c, g, or t
gnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnntatttcatgggggggattaaaaagaaaaaatttagttctttttatttttttccaacccctccggcaggttttt

SEQ ID NO: 10799 - DNA, 805 bp, Diabrotica virgifera
  misc_feature (694)..(712): n is a, c, g, or t
ggcagcggaagttgttcaagaaagaatttctgacgatgaattgataattattaaaggaccaaagcacgtacagcagcctctatcatcttgcggggacccaacgatttctattgtgatgaaatggaaagatctgttcacgacgccttgtccgttgtaaaacgcgtactcgaatcgaaaagcgtcgtagtcggtggaggcagtgtcgaagcagcgctttcgatatatttggaaaacttcgcaaccacgctaagctccagagaacaattggctatcgccgaattcgccaggagtttactggttattcctaaaacgttggcagttaatgcagcgcaggacgctacagatttagtagctaagttgagggcataccagaattccagtcaaacgaaaaaggatcatgcgcatttgaaatatgtaggattagatctcatggaaggtaccgttcgagataaccgaaaagccggagttttggaacccaccatgtccaaaataaaatcccttaagtttgcgacagaagctgccattaccatcttgagaatagacgatatgatcaaattggattccgaacaaagaggcggaaagagctaccagcaagccctggagagtggaaaatatatgattaatttgatataaactctgtattaccaatttatacgcttctgcctataaatgtaactcattttcagctaatctnnnnnnnnnnnnnnnnnnnccaagtatttttcagtacttcatcctttgtgagggattttataattaaaagacggttttgaaagctttttcccaaaattaatgttacattttc

SEQ ID NO: 10800 - DNA, 629 bp, Diabrotica virgifera
gccccttcgcggccggccaaattataatgtaccaggatgaaattttttaccagtatgcaaaattctaattcgcataaccaagatagatatgatgtgaggtaaccagatgtgaattatccaaagtatgataatagtgctaatatgcataaccaagatacctataatcgtgaagggacttatgcaagacctgctggagaaaaaacagtagtatcttctcgaactactctataatggtttagatgatgctatacgatctaaccaaggattaagtgctaatttgatggcattacatcgacgaaaaagaagtagcgatatcctccgaagatacgtgagtaatgacactgtagtgaatgcccccttagaaaatgtaagatctactggaaagaaattactactgaatgaactactatagatgatgttcctttaggcgcttattactggtagtcccgatgcaggtggtctcgctactgaatctaaggtctagaggatagttcatatctacttcttggaagaggataacaaatatgctgattcacagcaacacggaaagagcgtagacgatattttgagagcataattgaacattaacaatgacggatcatctctaagaacaacaatactgagagaaa

SEQ ID NO: 10801 - DNA, 190 bp, Diabrotica virgifera
  misc_feature (6)..(31): n is a, c, g, or t
catagnnnnnnnnnnnnnnnnnnnnnnnnnnctctaatatgttagtatttattgaatatataataaggcattttatagactgtactatgacgagaacatgatcaactagctttcaccctcgacgatcaactgctgatatgtcgtagtccccaacactgtccctgccactgaaccccgcatgactccggat

SEQ ID NO: 10802 - DNA, 69 bp, Diabrotica virgifera
  misc_feature (2)..(19): n is a, c, g, or t
tnnnnnnnnnnnnnnnnnnaaaagaataaaatttcccttaggggaaaaacggccgtaattttttttggg

SEQ ID NO: 10803 - DNA, 598 bp, Diabrotica virgifera
  misc_feature (326)..(348): n is a, c, g, or t
gaacagagtgaaactgtaaagggatatccctttgtaagagtcagaacccttcgtattcaacggtagagactaaatatagcgagagaccatacgatcttcataaaagaagaatagattctgctgtacctcgagtctcacgtattggtagctttgaatgatatatttattgttttccattccacatcaggtgacaaagtcaaagctttattgcaaaatgaatattctcagatcacctgttctggaacgagccgagattagctctcagatatatgtaatgtccttagacacacagaatatttatgaatgatcaaaatattaatgattgnnnnnnnnnnnnnnnnnnnnnnnacaaatttgtagggatgaccttattatgacagattgtctgcagattcaatttatatgtaaaaagtacgactgaaaagttccctagactcaaaaatgctattatcggattttgatatattatcatattaagtttagatagataatgtattacaagaagcatatgaatgatctaaattcactatgtgacgatgaaattacaaattccgtatagtagacagagtatggatagccaagtattcactaccgaatg

SEQ ID NO: 10804 - DNA, 819 bp, Diabrotica virgifera
  misc_feature (130)..(147): n is a, c, g, or t
  misc_feature (545)..(567): n is a, c, g, or t
ttattgtatttaatttggtaggtatttgtacaaaatttgggtttgtctctgatttattcttcttgcttataactgaactctccaattttcgtaactcacctatcaatttttccattgttgcaacctcagnnnnnnnnnnnnnnnnnngtatatgaattggcaaatttgtcacaattaaatcaattaatatatcaataggaaaatcatttttgatatttagcaataaattttctttgcgaaatgcataatcaacaagactaccacctatatacttaaaagaataagcttttctatgattatcccaacctgtttcacaaaaactatcaaaaaaattaactttccatacctcaaaactattatctaagcctaatgttattatttttgattcaaaccattcctttgctattccatcaagaaacagacgtaaaatcaaaatcttgtctttatcagtatccacctcacatcgcgaacattctgattcgaaggtcttgagccatgaattcattggaacatttttaccatcaaaatttcgaagtacgaaatcnnnnnnnnnnnnnnnnnnnnnnntcttttcaactttaggtatactagtttcaccaagtttctggagcaactcgactaatgggtggagattgttcaatcgcttctttcttctcatacactggtaataagggtctgttgtaggtactcattttgataaaccacatcaccatctgaatcaaaataaatcactttcaaattatcatctaaaggtaattggtacatgttctaaagcatcctcttgatttcatagatgctaaaacatttttcacttttttc

SEQ ID NO: 10805 - DNA, 50 bp, Diabrotica virgifera
  misc_feature (2)..(48): n is a, c, g, or t
gnnnnnnnnnnnnnnnnnnnnnnnnnnnnnnnnnnnnnnnnnnnnnnngg

SEQ ID NO: 10806 - DNA, 506 bp, Diabrotica virgifera
  misc_feature (233)..(251): n is a, c, g, or t
  misc_feature (322)..(340): n is a, c, g, or t
cttttagcgtccgcaagaacattcgaaggtcgaggtattcaaaggtagtaacgaagccgttgaatacctcggcccaagaacattcgaaggtctttctaaattcgtagaatctggcggtaaagatgactccgaagactctgctgaagaagatgctgaagatgatgacgcttccaagaaagatgagttgtagagtgtaaaagtgcatttgttagtttaactataaagaactttannnnnnnnnnnnnnnnnnngttttgtacagatttttgtgatttttttactattatcgttttttcagttttctcatgatttgttcaggatnnnnnnnnnnnnnnnnnnncggaataggaaataattaactctccatttattggagaatgtatgagactggttgtgttccgtgctgtcattgttgacagttgtaaatcctccgaacatttttttataaagttgataatatattttgtggaattatgtataaataatattaaatgcggctaccactc

SEQ ID NO: 10807 - DNA, 348 bp, Diabrotica virgifera
  misc_feature (5)..(128): n is a, c, g, or t
  misc_feature (279)..(337): n is a, c, g, or t
taagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataattaccttaggatacagcgaatttttattgaagagtcaatcgatataaagtgcggccctcccgggggggttaaggttttaattggggaacacggttatttttttaaactggttccccttttaaaattttcttgtttggggtttaacnnnnnnnnnnnnnnnnnnnnnnnnnnnnnnnnnnnnnnnnnnnnnnnnnnnnnnnnnnngaggggccccc

SEQ ID NO: 10808 - DNA, 810 bp, Diabrotica virgifera
  misc_feature (97)..(115): n is a, c, g, or t
cctcgcgcctggtgttacatcccaagtagtgttccttttattctaagtttaatttcgaacagttgcatttactttatttccgaacaagcaaaatggnnnnnnnnnnnnnnnnnnntgacataggaggaagaagatatagcaacaaaaaagctccataattcattgcgatgactacattaagaccatttacgggtgacgacttgttctagtttaataatgataatttagaccccttaagtgagacctatggatcatcgttctacatgcagtatttggctcattggcccgagtattttcaagtagcagaatcaccaagcggagaagttatgggctacataatgggaagagccgaaggtataggagagaactggcatggagatgttagagccttaactgtatctcctgacttccgacgtttaggattagcaggctgtttgatgaattttttggaagatgttgcagaaaagaagagggcctattttgtgaatctttttgctagagttagtgacaaagtagctataaatatgtacgatcatttgggatatatcgtgtatcgaacaggtcttgaatatgattcgggtgatccagatgaagatgcctatgatatgagaagagcttgttctatagatgtgaaccaacaatctgttataccattgacgcatcctgggaggcccgaagatgttgattgaaactaactatggaggaatttttgttattttttcgtcgaaatgaataaacacgtaatcacaatccgcgatggacatggcttggaaaatataattgttttttttgagtaattttgtggttgcc

SEQ ID NO: 10809 - DNA, 119 bp, Diabrotica virgifera
  misc_feature (3)..(88): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnttacccttagggaaaaaaggcgaaattttta

SEQ ID NO: 10810 - DNA, 601 bp, Diabrotica virgifera
  misc_feature (9)..(73): n is a, c, g, or t
  misc_feature (75)..(90): n is a, c, g, or t
  misc_feature (120)..(187): n is a, c, g, or t
  misc_feature (197)..(214): n is a, c, g, or t
  misc_feature (217)..(229): n is a, c, g, or t
  misc_feature (274)..(306): n is a, c, g, or t
  misc_feature (347)..(428): n is a, c, g, or t
  misc_feature (463)..(480): n is a, c, g, or t
attaatagnnnnnnnnnnnnnnnnnnnnnnnnnnnnnnnnnnnnnnnnnnnnnnnnnnnnnnnnnnnnnnnnncnnnnnnnnnnnnnnnngtaatttgaaatgggccgggaattttgacnnnnnnnnnnnnnnnnnnnnnnnnnnnnnnnnnnnnnnnnnnnnnnnnnnnnnnnnnnnnnnnnnnnngaacttgtcnnnnnnnnnnnnnnnnnngannnnnnnnnnnnnctcaaaaagcttaaatttttcttaaagacgagaagatcctataannnnnnnnnnnnnnnnnnnnnnnnnnnnnnnnngattaactttatttaataactaaaattaattaattgggggnnnnnnnnnnnnnnnnnnnnnnnnnnnnnnnnnnnnnnnnnnnnnnnnnnnnnnnnnnnnnnnnnnnnnnnnnnnnnnnnnncctcaggaaaaacacctaatttttttgggggagtnnnnnnnnnnnnnnnnnntgcacccccaggtggcataaaggtaatattggggggacgccgcaaatctttttaacctgtctccattttttaaatttttacccgtgcctcggagcttaaaacccgcgtggcgcccccctcc

SEQ ID NO: 10811 - DNA, 957 bp, Diabrotica virgifera
  misc_feature (30)..(52): n is a, c, g, or t
aaataattgatgggtgcgtactaatactgnnnnnnnnnnnnnnnnnnnnnnnaagaaagtattaaaaagctatagtattacttaaagcgacaatagtgcttcataaataatcttaagaatttgatagtttagcttggatttgtacatttgaatttttggtaatggtacaaccggccaatcgtggatgtttaatcaagagaggtttttgaaacatgtctaaaaccatcaatgcgtataggatcaagaagatagaaaattacggcaaaatgacgcagatgacacaagaagaaatcgttgccgctgttaaaacagtagctcagggtttggaagccttaagatcggaacatacaggaattttacatagcctccatgaagcccccgatcctgtagttagcgaacgagctggtctggtgcaacagagtgccgatatgatagaattgggcctcggtgaagcacaggttataatggctttagcagcacacttgcagttagtagaagctgaaaaacaaaagttgcgtacacaagttagaagattgtgtcaagaaaatgcttggttgcgtgacgaattagcctctacccaacagagactgcagtccagcgaacagatggttgctcagttagaagaagataaacgtcatctagagtttatgagttccgttagcaaatacgaccaagatgttaatgaagataatgcttcagaacaatcgaagagtgagaaacctgatccagtagttgatctattcccggatgatgatgctgatgacagacataatatgtctcctacgcctccaaaccagctacagctttctcaacaagtaaacgctggatatgaaattccagcacgtcttagaacacttcacaatttagtcatacagtatgcttcccaggccgatatgaggtagcagttcctctgtgcaaagcagcggtagaagatttagaaaaaaccagtggtcatga

SEQ ID NO: 10812 - DNA, 251 bp, Diabrotica virgifera
  misc_feature (2)..(42): n is a, c, g, or t
  misc_feature (44)..(69): n is a, c, g, or t
  misc_feature (214)..(233): n is a, c, g, or t
cnnnnnnnnnnnnnnnnnnnnnnnnnnnnnnnnnnnnnnnnncnnnnnnnnnnnnnnnnnnnnnnnnnngttcctcttatttatattcaccagtgacgataatatcactgttaacgatttgcatatttagcatatctatatgcatactaaatgactacggcgacatgtctctcacccgtccattaaagacgtgactgtctgtatacttcacagnnnnnnnnnnnnnnnnnnnncttctccaaagaacgctt

SEQ ID NO: 10813 - DNA, 873 bp, Diabrotica virgifera
  misc_feature (79)..(96): n is a, c, g, or t
  misc_feature (293)..(364): n is a, c, g, or t
  misc_feature (374)..(386): n is a, c, g, or t
  misc_feature (388)..(403): n is a, c, g, or t
  misc_feature (441)..(474): n is a, c, g, or t
  misc_feature (477)..(499): n is a, c, g, or t
  misc_feature (649)..(669): n is a, c, g, or t
  misc_feature (688)..(712): n is a, c, g, or t
  misc_feature (714)..(735): n is a, c, g, or t
  misc_feature (764)..(787): n is a, c, g, or t
  misc_feature (789)..(810): n is a, c, g, or t
  misc_feature (812)..(834): n is a, c, g, or t
  misc_feature (847)..(864): n is a, c, g, or t
gttgaaaataaaacctcaaaatggtaaacggtaggataccgtcggttcatttttaatgctatgtaatgactaggcgtgnnnnnnnnnnnnnnnnnnataagagaaaaataatattgtgtgtaccttgcgcatccgggattactaattatagaattatatattgagtattttctaatttataagaggtaaaaaattaagatttatattgtaacagaaatattttatatcatttttgtgtagtgaagtgttatccgatctgaaatatatcaaatttttagagaaatagtattaannnnnnnnnnnnnnnnnnnnnnnnnnnnnnnnnnnnnnnnnnnnnnnnnnnnnnnnnnnnnnnnnnnnnnnntttaggaatnnnnnnnnnnnnncnnnnnnnnnnnnnnnngtacgtatgattaaagatcttcctatttaacactatgnnnnnnnnnnnnnnnnnnnnnnnnnnnnnnnnnntgnnnnnnnnnnnnnnnnnnnnnnngaattttcattatttagatggagcaatgaagatcatattactattagaagattgtatatttagtagaagtattatagacctaatacagggattcggcagaatttttttaccctgagtattaagagcatgtctttttgtatgaaagatacnnnnnnnnnnnnnnnnnnnnngatttgaatgtccgcgggnnnnnnnnnnnnnnnnnnnnnnnnncnnnnnnnnnnnnnnnnnnnnnngctggaatggacgggtggatgaaaaaagnnnnnnnnnnnnnnnnnnnnnnnncnnnnnnnnnnnnnnnnnnnnnngnnnnnnnnnnnnnnnnnnnnnnngaccctatacagnnnnnnnnnnnnnnnnnnggttttttt

SEQ ID NO: 10814 - DNA, 68 bp, Diabrotica virgifera
  misc_feature (6)..(65): n is a, c, g, or t
gtatannnnnnnnnnnnnnnnnnnnnnnnnnnnnnnnnnnnnnnnnnnnnnnnnnnnnnnnnnnnttt

SEQ ID NO: 10815 - DNA, 982 bp, Diabrotica virgifera
  misc_feature (829)..(829): n is a, c, g, or t
gaatagtttccaataagatcctttcgaaatgggactttacagtggctttccggagatgtttggctacagggaacccaaagaacattctaaaaagtggttctagtgatattagtattcctactgttaccttatccgagtttgtctttgagaaagccgagaagtttaataaatatactgcatttatatctggaacgactggaagaagctacacattcgaacaaatcaggataaaaagtaggaatttttccaaagtattgcgcgagaaattcaagttaaaagacggagatgtcatagcaatgtttttacctaacgtacctgagtacgtcatctgtttcttaggatcattggaagctaggctcatagtgactactatgaatcccatgtacacagcagatgaaatagcaaagcagattatagatgcttctccaaaattaatcgtaactcaagctaatttggtcagtacggctagatctgcattagaactaacaaaacgacagctacctttgatcattgttaaggagacgcaagcggaaagtctgccagaaggtacaatagatttgtcagaattaattaatacacatttggacgtacctgatcttctaccaggaaaagcagacgacgtggccatcatgccgtactccagtggaacaacaggattaccaaaaggagttttactcacgcataaaaacatgacatccaatctgacacaaatgagccatccggacttctcttcagtggaacctccaacagataactttcaagacatgtccccagcagtgctgccattttatcacatatatggcttaacgttgaacttcctcttcatctngccaggaactagatgtgtagctctttgacaatttactccagaatcttacatagcagccttgaaagataaccctatcagtatgatttttgcagctcctcctctagtcctatttctgacagcccatccagatgttaaatcagaatattttaaaaa

SEQ ID NO: 10816 - DNA, 878 bp, Diabrotica virgifera
  misc_feature (64)..(81): n is a, c, g, or t
  misc_feature (368)..(397): n is a, c, g, or t
  misc_feature (519)..(533): n is a, c, g, or t
  misc_feature (762)..(762): n is a, c, g, or t
  misc_feature (788)..(788): n is a, c, g, or t
  misc_feature (818)..(818): n is a, c, g, or t
ctacatacagagttgttgctaaattttcaaaaccgtttatttacaatgattaatgaataggttnnnnnnnnnnnnnnnnnncaattcaagaaaacatgtttactactaaggcatttattaaaaagacaaaaattggtcattttctaaagaatgttagggaacattatatacgagatgacatcttttgtggaatttcaacctgtgaaaaatgccatcctgtggactcaaacttaagtacaacccatcaaaacaaatgtggtctctttgattttaaccattttctaatactagacaccaacatcattctagatcagatggacattttggatgagccaatacttggaaatgtaattattttgcacacagtnnnnnnnnnnnnnnnnnnnnnnnnnnnnnnaacatacaaaaggcttcacagcattatcgagaatcccagtagacatttctatgtctttaccaacgaccatcataaagatacatatattaaacaaaaagatggtgaattaattaatgattacnnnnnnnnnnnnnnnagaaagtcatgttcatggtatattcaacatctgcctaaagagaaatttgtatttcttagtgacgatgcaaataacagaaatatagcacttgaagaaggaataccagcatgtacaataaaggattatatcacaaatgtaccagataactcaatcttacaagacaaactttctaaaaaagaaatcgctattgatagttacacaaaagatgtatttcctccgcatttatcanatgtggcactgctaaaccggtgttanagaaggaaaactgtatcaaggtacttttcnggcttctagggataactttttggaaggattcgtgaacgttgatgcttttaaagattcggt

SEQ ID NO: 10817 - DNA, 486 bp, Diabrotica virgifera
  misc_feature (13)..(50): n is a, c, g, or t
  misc_feature (243)..(278): n is a, c, g, or t
  misc_feature (280)..(298): n is a, c, g, or t
  misc_feature (304)..(370): n is a, c, g, or t
  misc_feature (388)..(466): n is a, c, g, or t
gggccctttcgannnnnnnnnnnnnnnnnnnnnnnnnnnnnnnnnnnnnngggctccccccggtttaaacccaaatctggaaaaattttaaaagccaaacaaatttaaaaaaatagctgctaccccaattaaaaattttaacccaacatcggggccccaatctttattatcaatttaaaccccccaaaaaaattacgctgttaccccaagggaaattttttcttaaaaccaaaaaaatgggtnnnnnnnnnnnnnnnnnnnnnnnnnnnnnnnnnnnngnnnnnnnnnnnnnnnnnnncccccnnnnnnnnnnnnnnnnnnnnnnnnnnnnnnnnnnnnnnnnnnnnnnnnnnnnnnnnnnnnnnnnnnntctatagggccttcccgnnnnnnnnnnnnnnnnnnnnnnnnnnnnnnnnnnnnnnnnnnnnnnnnnnnnnnnnnnnnnnnnnnnnnnnnnnnnnnnaccccttctttccagttttc

SEQ ID NO: 10818 - DNA, 974 bp, Diabrotica virgifera
  misc_feature (823)..(823): n is a, c, g, or t
  misc_feature (855)..(855): n is a, c, g, or t
  misc_feature (945)..(945): n is a, c, g, or t
gcagtaaaaagttgtgtaaggaaaataagcaaccacgtagcagaatcacgcacaaagtttaatatagaaaaactatcagatatcaaagatactgtactttttgcctctccacttgatagaaaatttttacttttatatatgcataattctgaggaggagttttcgaatacattttttaaatatctgcgagacgaagacatttcgaaaattttaaacgactacttttatattattggatgggatgtagaaaacagagcttatcacccggcgctttgtaaagcagtagaagatgctaacttcggccatctatcagctttaattcagtcagaagcatgcgcagcagttattattcagaatatcaacggttgtccaaatattctttcttttttgatgggaaatgacgtagattcgagcagggattcatttttattgtgtctacaaaactgtcgagactttttgattgtggatcgcatgtctgtaaatggattagatggttctttacagagcaacgaattaacctcggaagcttttcaaaaaattatggcagacaggcttggcgatcgagattacgatagttttgcttttgaccagcatgagctgttggagaggaaaatcggttttgctttgtttggccaaccagttcaagaatcggggaatggatatgacaaagctcaaaataaacaaattaaaaatttgtacaagattattctaaaacacaataatttatatgccgaatacaaagatcaagttgaaataggtttcatgtacatcgtgttagagccaacagatgatcaagcaaaatctcgtagaaaaaaagatccanagtataatccacatattgatatatctccttcnccgatatttgttttaagaaagtgcccgaagagaagaaggtgatgcctgcagaattttatagatcacgggtgggagagtatattcgatttnggcagattttttaaaaataacagttactg

SEQ ID NO: 10819 - DNA, 68 bp, Diabrotica virgifera
  misc_feature (6)..(59): n is a, c, g, or t
aaagcnnnnnnnnnnnnnnnnnnnnnnnnnnnnnnnnnnnnnnnnnnnnnnnnnnnnnngttttttag

SEQ ID NO: 10820 - DNA, 720 bp, Diabrotica virgifera
  misc_feature (108)..(174): n is a, c, g, or t
  misc_feature (439)..(481): n is a, c, g, or t
  misc_feature (550)..(567): n is a, c, g, or t
ggagagaatattatgttagtatgcaaatagaattccacctattttgagtcgcgaatctggtattcggaatcatgccgatgttgtgttatgtattgctatggtgattgnnnnnnnnnnnnnnnnnnnnnnnnnnnnnnnnnnnnnnnnnnnnnnnnnnnnnnnnnnnnnnnnnnntaacagaagcaggagaggtgcacctttacactcctggagcgaatgattgggattgtatatttctctacaccttgatttgcggtgttatccatggcattattcaggaatacgtcttgtacaacgtctcccggaaactccgcctctccaattccagagtcagcagtcttcgccaccagaggtcaactgacgatattctacttaatatcaactttgtggggacttgacatcatcagtcaaagagaactttgtatttgatatagctcgnnnnnnnnnnnnnnnnnnnnnnnnnnnnnnnnnnnnnnnnnnnttggatactattgtacatttggctttataatgtccatgagcttcctgaactatattttccaacgggctnnnnnnnnnnnnnnnnnnggcgaagccacactaagtttgggaggtgagtcgctcatatttatctccttattttcctcagctaacaccgtctggtactgtctctttttggtgcgtatcacatttttgaattgggtttacggctttttcccattgatccaggctgttgacaaa

SEQ ID NO: 10821 - DNA, 139 bp, Diabrotica virgifera
  misc_feature (2)..(14): n is a, c, g, or t
  misc_feature (16)..(16): n is a, c, g, or t
  misc_feature (19)..(82): n is a, c, g, or t
  misc_feature (86)..(86): n is a, c, g, or t
cnnnnnnnnnnnnncngtnnnnnnnnnnnnnnnnnnnnnnnnnnnnnnnnnnnnnnnnnnnnnnnnnnnnnnnnnnnnnnnntttntgatatagaataaattacctagggatacagcgtatttttattggagagtcaat

SEQ ID NO: 10822 - DNA, 242 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(234): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnatatttag

SEQ ID NO: 10823 - DNA, 192 bp, Diabrotica virgifera
  misc_feature (19)..(19): n is a, c, g, or t
  misc_feature (60)..(60): n is a, c, g, or t
  misc_feature (78)..(100): n is a, c, g, or t
  misc_feature (102)..(102): n is a, c, g, or t
  misc_feature (114)..(114): n is a, c, g, or t
  misc_feature (163)..(187): n is a, c, g, or t
taacagcgtaattttattnggagagtcaatcgatataaagattgcgacctcgatgttggnattaagtttataattggnnnnnnnnnnnnnnnnnnnnnnntngtcgacttttanattttacatgatctgagtttaaacccgtgtgagcccaggttggttctannnnnnnnnnnnnnnnnnnnnnnnngtacg

SEQ ID NO: 10824 - DNA, 956 bp, Diabrotica virgifera
  misc_feature (105)..(128): n is a, c, g, or t
  misc_feature (141)..(158): n is a, c, g, or t
  misc_feature (192)..(214): n is a, c, g, or t
  misc_feature (440)..(460): n is a, c, g, or t
  misc_feature (539)..(558): n is a, c, g, or t
  misc_feature (623)..(671): n is a, c, g, or t
  misc_feature (764)..(764): n is a, c, g, or t
  misc_feature (811)..(831): n is a, c, g, or t
  misc_feature (839)..(839): n is a, c, g, or t
  misc_feature (888)..(888): n is a, c, g, or t
  misc_feature (952)..(952): n is a, c, g, or t
attatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatganatattgtatcttctattggatcactaatttctttaattggggtattnnnnnnnnnnnnnnnnnnnnnagaagctntttcttttcaacgaaaaagattaagacctttaagaataacttctttcanttgatgactacaatttaaccctccagctgaacacagatatcctgaatttgcaatattatcatcnaatt

SEQ ID NO: 10825 - DNA, 238 bp, Diabrotica virgifera
  misc_feature (28)..(55): n is a, c, g, or t
  misc_feature (94)..(111): n is a, c, g, or t
  misc_feature (126)..(146): n is a, c, g, or t
  misc_feature (191)..(223): n is a, c, g, or t
accttaaggataacagcgtaatttttannnnnnnnnnnnnnnnnnnnnnnnnnnntgcgaccctcgatggtgggattaaagtttataaattggnnnnnnnnnnnnnnnnnntaaggctgtttcgannnnnnnnnnnnnnnnnnnnntctgaggttaaaacccggggtggggcccgggtttggtttcctttnnnnnnnnnnnnnnnnnnnnnnnnnnnnnnnnnccaaaaggggccaaa

SEQ ID NO: 10826 - DNA, 53 bp, Diabrotica virgifera
  misc_feature (5)..(37): n is a, c, g, or t
  misc_feature (46)..(46): n is a, c, g, or t
  misc_feature (51)..(52): n is a, c, g, or t
attannnnnnnnnnnnnnnnnnnnnnnnnnnnnnnnngggtgatanaaaannt

SEQ ID NO: 10827 - DNA, 264 bp, Diabrotica virgifera
  misc_feature (2)..(214): n is a, c, g, or t
  misc_feature (227)..(227): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaagcttanatttttttaaagacgagagacccctatagagttttat

SEQ ID NO: 10828 - DNA, 884 bp, Diabrotica virgifera
  misc_feature (154)..(173): n is a, c, g, or t
  misc_feature (257)..(274): n is a, c, g, or t
gtagaatacgttttagatacaaacttcatgatttttcctacactagtgttttgttagccagagagtaaaaagtaactaaagactaaaggcatgttaatagttgttttaaaaaaaagttcgcgtatgttcaaattaagccgataagttcgatggnnnnnnnnnnnnnnnnnnnngttgtttgtcaataaacttattatattgtgggatttgactttatctttatttgtataaaaatagtgaaatgaaaacatcacagnnnnnnnnnnnnnnnnnnagcgctacgtctgtgaactctcaagaaaaacaaatacacaaacagccaccacatattgtgattattttagctgatgatgtgggttggaacgattttgggttacacggatctagccaaatacctaccccaaatatagatgctttaggatacaatggggttatcttggataaattttatacgcaacagacatgtacaccctcgagagctgcattattaacaggaaaataccctataagaatgggtcttcaaggaattcctctcgacgcaggagaaaaccgttcattgccattaaatatccgtacgatgcccgaacgacttaaagaactaggatatagtacccatttagttggaaaatggcatctaggagctgcttgtgaagaggtcacaccaactcgaagaggcttcgatactcattttggatattggagcggttttgtcggatattttaaccatgaacttagcgtacctaatcctctcaataaaagtgaaaatttcacggggcttaagattttcgtgacaattttcacgcctcagtggtccttagaaaggaaatatgttacagaaattattttctaaaaaagctatagatataattcacaagcataacacc

SEQ ID NO: 10829 - DNA, 822 bp, Diabrotica virgifera
  misc_feature (105)..(134): n is a, c, g, or t
  misc_feature (452)..(468): n is a, c, g, or t
  misc_feature (471)..(502): n is a, c, g, or t
  misc_feature (633)..(653): n is a, c, g, or t
  misc_feature (711)..(729): n is a, c, g, or t
  misc_feature (739)..(739): n is a, c, g, or t
  misc_feature (741)..(741): n is a, c, g, or t
cgcaaatgaaggctcattaaaacaagtatgtgtttaccgcaccttttttcatgacccctgagagaaagaagaaacttaggttactgttgagaaagaaagccgccnnnnnnnnnnnnnnnnnnnnnnnnnnnnnngcagccgaaaggaggcgtatcattgaagaaaggtgcggtaaacccaaacttgtcgatgacgcaaatgaaggctcattaaaacaagtatgtgagggatatcacagacgtattgtagacctagaaaataagaaatttgacctcgaaaaggaagtggaattcagagattttcagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtnnnnnnnnnnnnnnnnnccnnnnnnnnnnnnnnnnnnnnnnnnnnnnnnnnctggtcaaagaagggagacgaaaagaaggtacaagaggctgaagcatgatttttctcctttgttaaagcccttttgtcaacatcaagggatatgtcgttatttcgatgatcccatcgtgatttcgatatcnnnnnnnnnnnnnnnnnnnnnattactttccagactaaaagagtgtctgtccgcatgtatattatttgtttatgtatannnnnnnnnnnnnnnnnnnggtattggtngnaatttataatacaaaaaaatacagattatccgatccccctttttttaaaagataaatagaagattaaaaaatggacattct

SEQ ID NO: 10830 - DNA, 411 bp, Diabrotica virgifera
  misc_feature (64)..(64): n is a, c, g, or t
ctgaggatgtacatcaaatgaacttatcaggtacattttcttacgtttctttttccttggatcnttctctgcataatgatttggaagaagctataatgatctaactacattaccacaactatcgacttcgaggtggaggaatatccgcaaatcggagctcgcaaaaattgaaaccaatgtggaaatgagtataaatacaaaaggatttttggattgaagaacagcaatctgatgcatagataacgttgatttcgcgatcgtgtcttgtaaggtccgcatggtgtattatacgataaaatgttcgtttataattgcgcaaaacaatgacacccacaccggtcacgtaataacaaatgcctagctattgtatgatatctgaatttgtccctgaaatggtctgagcactctctg

SEQ ID NO: 10831 - DNA, 557 bp, Diabrotica virgifera
  misc_feature (2)..(553): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtt

SEQ ID NO: 10832 - DNA, 511 bp, Diabrotica virgifera
cggactcttgttcccttgcctaacaatatgagcaggtacgcgaagatgtgatagatcttacaaatagcttaatagtattagtcgataggagttatattatttactacatttatccgatattagtaatcagtcatttattccataacaagcaactaatataaggtttttcacaagaatacattgataaatatatatgaaagaaattctattaattaaatataccaaaatatataactagaaataaatatatcaggagctcatacctctacataaaaaacaccttcaacataacatataactaacacttcagtaatagaataaaatctctgacatcatcacaaatatcattataaatgaagataatatcttttaacatcttattaaaatcctagattaattacaccataatcaatcactactcaaccctcctccactcctacaacaaataattactataagtaacgaaaatcacatcatataagatatcaaaataacatgaatatatagaatt

SEQ ID NO: 10833 - DNA, 791 bp, Diabrotica virgifera
  misc_feature (752)..(789): n is a, c, g, or t
gtatctccttgcctctggacctgtctcagccatggcagtctctgacttaataaatcttacaatagcatgaccttcactcatttcattaatcttatcgtttcttccgagtctgcatgttccatcttcctcttgcaccgtcttgtatagtatgaccgtctttgatttgagttgcaacattcaccagattttattcaatcccaatagcccgatcacattttctgtggtactttcaagatattttttagctgaaagaaaaaatacacactcaaaacattgaacatgtgttcagttaaagtggactaaggcaccacttggtatcgttcctcatgttacaaactggcatctttcgccaacacaccaaaaattaaattgcatgttgatcgtgcaatactgtactttaccaaatatgatattcaggctatgtggtacattgcatgaagtaaaactcccattttcgatgccatctatcttatgtaggtactaaaatacaatgctttagtcctttgtaaggttcctctaactacgtgggttgtaccattttgaaatccacgatttacttggttcgtcaggaggtcaaccttagctaaagtatctcctcttcaccaacacaaagacaatcctgtagatccctaccttggctaactcttctcaaaggtagttcggctaatcgctattacaaacaatgttggcacccgcttggttagaacattacacatcggcgcccaacgtggagccaataaagtaacttacgnnnnnnnnnnnnnnnnnnnnnnnnnnnnnnnnnnnnnncc

SEQ ID NO: 10834 - DNA, 845 bp, Diabrotica virgifera
  misc_feature (184)..(228): n is a, c, g, or t
  misc_feature (366)..(386): n is a, c, g, or t
  misc_feature (632)..(675): n is a, c, g, or t
  misc_feature (831)..(831): n is a, c, g, or t
ctgataatttcttggtttaaaatttttgaagcaaaacttctagactggcgatgttttcatatttctctagagtaaaatgctgaggcgagcgtcacgagcgaaaaataagtcatttacgcgacgaggggagtccgctatacaacatgtaaactgtttccaattcattaaaaaatatataggaagnnnnnnnnnnnnnnnnnnnnnnnnnnnnnnnnnnnnnnnnnnnnnacagtatgaagctttgcgcttgtaccgcctactgtaccactttttttttaaatgacttctgcattaattgttttttaagacacaagaaaacagtttcagaaattctttagacaacttgcgctgccaaaataataacgnnnnnnnnnnnnnnnnnnnnncaattataataccaagtttttagagttactgcaagatttataaatatagaagtatgtacattgttctacaacaattttagatatacatattggattgttttgaaaaatctagatatatttctttattaatctatttttacaaaacgaaaatgcatttatgtaggtactaagaactgccaaattgaccctatttttatactttttccaaaatcatgttctctgaatggtaaataaggcttgaaatcnnnnnnnnnnnnnnnnnnnnnnnnnnnnnnnnnnnnnnnnnnnncctgaactcaactacatgtcaaactttttggtgtgctgggttgttttaatttttatgtatgttatccaaaatgtttatattatttgttattcatttaaagttttgaagtgtaattattttgtttgttaaaatagcactggaaacaaatgacacagntaaagaagtttaag

SEQ ID NO: 10835 - DNA, 862 bp, Diabrotica virgifera
  misc_feature (2)..(43): n is a, c, g, or t
  misc_feature (45)..(63): n is a, c, g, or t
cnnnnnnnnnnnnnnnnnnnnnnnnnnnnnnnnnnnnnnnnnncnnnnnnnnnnnnnnnnnnncacattacttaaccgtcacagacacaattcgaatatcatcatatggcttatcagtttttacattggtcttaacattactaatattttgaacaacttccatccctttcacaactctcccaaatatgatgtagtgatatcagctgacaagaaaggcatggttgaatattggcatggaagcaagcatgactatggtgttcccaaaaatataggatttgattccaaacttgacactgatctgtttgaatttgccaaaaataaaactgttccaacaggattagctttttccaatgatggaaaaaagtttgcaacaatttcgacagatagaaaaattagggtatttaattttttgaaaggtaaactgattttagttttggatgaatcattgccaaggttctcagatcatcagcacaaaacacagcaactgccaaacatggaatttggtagacggatggctgtagagagggatctggaaaagtccgatagttttgagttggccaatataatattcgacgaaagtggatatttcattatgtacgctacgttattgggtattaaacttgtaaatatacatactaataggtgtgttaagatcataggaaaaaatgaaaatttgcggatgttaaatattgctctctaccaaggttcagccaaaaagtcaaaagcagctgttacattagaaattgaagcttcaaacaacccaactttagacgccatactcccagatccaactcttatttgtaccgcatacaaaaaatctagattctatctctttagtcgtagagaacctgatgatttacag

SEQ ID NO: 10836 - DNA, 333 bp, Diabrotica virgifera
ctactttacttatatagtatataatacagtgctttttctacatcgaaaactctgtataatcatgatctagctgataccggagcaaataatgttaactgatgtatgtgctcttccacatctcaaacaaaaactccggaaaatctccacaaacatcatccaaatattcatacgcacgacattatgaaatctataagcatagatgtgacgcctttgaataatacaagctgttgcaatacagtgtcgtcgtgtttgtggatgatatcgtggagatgagatataactataacttgcacgattattttcgccaattatgacacaccgacatcgcctaac

SEQ ID NO: 10837 - DNA, 921 bp, Diabrotica virgifera
  misc_feature (450)..(537): n is a, c, g, or t
ccaaaaatcaattttcgaaaatcaaaaataacgttcttaatagactagaactttgcaacagaggagaaaatattttagtctttcttgaagtttcttgaagttaatgagttcaaaaacatttattttgtgtcccaactatagccgaaagcagtggcgttcagtaaaatccagtgtggaggggagtaaacggtaagaaggccaattcctttgaagatggcagactgatgtaaagattactaaaacaaaaatgtaaattgtaaattccgttttggttttcacgttgtaaaactgtataatacatgtgtaaaaatatgagccgtacaggtgtcatgtaattaaaattgtaaactattgtatttctaaaattttggaacagtctgtttcattgtaattttgagaggcggacaccaagcggttctccgccccccgctttgtagggtagctggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcttatattctcttaaaaaggttgtactttgaaacctttacaaggatattttgacaggtgcaaaaacatccataaaatttttaacatgataatattacagcaagaattataggaattgatgtgatcgttcatgggtgttcttctatttttccgactgtattttgattttccttcactctttgcaagccacgtttcttccgatgctacttataacttattccgcttatcctttcctttgtatttgtttaatacgtaatatctagaaaagtttattaatttataataaattagtgttccagctgatttcttaggaccagcattttcattttcatccattttttgggttctggattttatattattatgtgttcctcctttttt

SEQ ID NO: 10838 - DNA, 222 bp, Diabrotica virgifera; identical to SEQ ID NO: 7599
  misc_feature (6)..(28): n is a, c, g, or t

SEQ ID NO: 10839 - DNA, 58 bp, Diabrotica virgifera
  misc_feature (7)..(44): n is a, c, g, or t
taacagnnnnnnnnnnnnnnnnnnnnnnnnnnnnnnnnnnnnnntgcgacctcgatgt

SEQ ID NO: 10840 - DNA, 85 bp, Diabrotica virgifera
  misc_feature (29)..(48): n is a, c, g, or t
cccacgcgtccgattaaattgaattactnnnnnnnnnnnnnnnnnnnngataggtaatttattatgtgatgtaaagatatttgga

SEQ ID NO: 10841 - DNA, 292 bp, Diabrotica virgifera
  misc_feature (9)..(36): n is a, c, g, or t
cattattcnnnnnnnnnnnnnnnnnnnnnnnnnnnnctatgtagcagagtatcctatcagttaggattacaaaagccctggagctgagatagaaggttactggagggacgtacagatcagtcctctgctgacactgcataacctagcacccttgtatttgccacgcgataatccatctacgttcgcttaagaaaattttaactccgtagcaaggctcgcttctgacaagcatctaataatgattgagatctctccagagcgggcacgaacctgatttggactacatcccaga

SEQ ID NO: 10842 - DNA, 930 bp, Diabrotica virgifera
  misc_feature (888)..(888): n is a, c, g, or t
atctataataaaagagttagaaaatagagtatggcaaagagattatagagatagaagagccctacagccagatgccatgtattatccagacttaatgcctccccctagttatcctgataatcctattaattgtgttactactagatttgtaaaaactgctacaaataaaatgaggtgcccaattttctgtatggcctggacacccgagggcagaagactggtaactggtgctagttcaggagaattcacattatggaatggattaacatttaatttcgaaactatcttacaggcacatgacagtccagtcaggacgatggtatggagtcacaatgacagctggatgataacaggtgaccattctggttatgtcaaatattggcagtcgaacatgaacaatgtgaagatgttccaagcgcacaaagaagcacttcgaggcataaggtatctacaacttctctccgtaattataaaacttgtacacttacttatattttactttatcaataaaagatccctccttctccctacattagtgcaaaataaagaaatcaattttaaataacgccatcaatattttccaaacaatacattgcatttcaaattgtctagttggaaacattgtacttaactgactctattagagtttctgaatagaccatacaaaactaattcccttaaagtaagatggtgaatggacattgattccgaaggcaacagtccccaaacaaagacacacacaaagtgatttattttgatagcaaatgagtacgaatagtacattgtgatttttcaaatattggaattagtgcattatatcaacaagtatacatttcatacattttaaacaaaaatgtgctataatgtacatttgattactggcgtccnatgaaaattgcacaaaaaatcatgtaggtacacataaaatat

SEQ ID NO: 10843 - DNA, 708 bp, Diabrotica virgifera
  misc_feature (197)..(217): n is a, c, g, or t
  misc_feature (296)..(315): n is a, c, g, or t
  misc_feature (380)..(428): n is a, c, g, or t
  misc_feature (568)..(588): n is a, c, g, or t
aatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataatttcttcaattgaatgactacaatttaaccctccagctgaacacagatattctgaattgccaatattatcatc

SEQ ID NO: 10844 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10845 - DNA, 333 bp, Diabrotica virgifera
  misc_feature (10)..(69): n is a, c, g, or t
  misc_feature (72)..(88): n is a, c, g, or t
  misc_feature (100)..(170): n is a, c, g, or t
  misc_feature (172)..(192): n is a, c, g, or t
  misc_feature (195)..(264): n is a, c, g, or t
  misc_feature (281)..(298): n is a, c, g, or t
gctggaatgnnnnnnnnnnnnnnnnnnnnnnnnnnnnnnnnnnnnnnnnnnnnnnnnnnnnnnnnnnnngcnnnnnnnnnnnnnnnnngaaaaaccctannnnnnnnnnnnnnnnnnnnnnnnnnnnnnnnnnnnnnnnnnnnnnnnnnnnnnnnnnnnnnnnnnnnnnngnnnnnnnnnnnnnnnnnnnnntcnnnnnnnnnnnnnnnnnnnnnnnnnnnnnnnnnnnnnnnnnnnnnnnnnnnnnnnnnnnnnnnnnnnnnncttaggggtaaaccccnnnnnnnnnnnnnnnnnnggttcaaaacgataaaaaaaaatttcgcccccccc

SEQ ID NO: 10846 - DNA, 303 bp, Diabrotica virgifera
gctgataaaattattggagcatctgacactagtggtcaattgatgttcttgatgaaatggaagggtacagatgatactgatttagtttatgcaagacaagccaatttgaaatgcccacaggtggtcattaaattttatgaagaaagaattgcgtggcatacgccagacgacttttaattttacttagtgataagatttgttgtagatttaatttcttacttttaaataggtagagttcttatattattaatccatatgtattttttttaaatggaagaaaccacgacttgagttgttgtattc

SEQ ID NO: 10847 - DNA, 907 bp, Diabrotica virgifera
  misc_feature (35)..(52): n is a, c, g, or t
  misc_feature (702)..(730): n is a, c, g, or t
  misc_feature (850)..(850): n is a, c, g, or t
  misc_feature (862)..(862): n is a, c, g, or t
gaatatctgatactttaatcctggtaaaagctagnnnnnnnnnnnnnnnnnngagacaatagcgacaaatttaaaagtaccaatatattaaacgacgtcgaatgtgcactcatatccccccaaccccctgtcgtattgcgtcgaaataagcaagccccccccccttcctcttctcaacgacgtagtttatggatgtcccctaaccttatatcccgacaacaaagaaactttttaagtttaatgaatgatacacgtgctatttcaatacgtgtcttgtcttaatttctttggtttggtctacatttgatgttatccatgaaatatcataccctacacgaaagatggaagagtttttcttgttgaaatgacttgtttttcttgtttttattgagactttggtataatccatgcatcgagcaagtttttttagataataatatatacctacaggaagaatgtatcctaaaaataattcggtgtcgttgttagcggtgttgttgttagttattaacaattaggagcgaaaaattaaatattttcgaagctttaatttaccactaaaaagatcaagtatttgtgttattgttttacttatttatctgaactatttatgcacttgaagacaataagcaaaaaattgtcagggagatactattcaatcattttactgttgcacaaccatctgtcttatggacaaaactnnnnnnnnnnnnnnnnnnnnnnnnnnnnntggttgccgatagtagaatcttcaatctacaagatcttatcgtcgatgggatatgtcgaaagatctctaaacaattgttcatccggatgaaaattgaatagaaacgcttgtttaagcttnaatttaattaangagttctagtaattactgaacgaaagtaagtgagccttgataata

SEQ ID NO: 10848 - DNA, 710 bp, Diabrotica virgifera
  misc_feature (376)..(392): n is a, c, g, or t
cactctctataggagagggtggtgcgccggcaggcagcggcgggggaattccgcggcgccccccacccctccgctgttacctgccgtttggtaaaaggacttatcatatccaccggccagcattattatttgaacgtatagacaaaaaaatctcaatgatatgctcctgataagacagcggaaccatcgacctccagagctccagatcaaatcctaagctcacatgttgttgcgcaacatagaagattctaaaagaccctcttcatggaggcaagaaagcatgacccgcacaacatatgaagctctagagtattgttaaatcatatagatagcaaattgctcatggaaagaattcatttgcagagctagcctcaannnnnnnnnnnnnnnnngcagtctaaagagtggtgattttgatgcgttcggtaatggagctatgcacaaacctttcgaagatgctgcttttgcgcgttatgccgaagatgtctcagaacctgcgtttgcagattcaggacgacttatgatattgtcgcagtgtctacttatatcagtatacgcggcattgaattgttatacccttgctgaacagacatattgctatgtaagatagttgtgtacggagttcagtggcgctgcgaaagacacacttcgaactgaagtagcatatatccaaagatatcttgataatggatggcgtcctcttgatgctc

SEQ ID NO: 10849 - DNA, 888 bp, Diabrotica virgifera
  misc_feature (8)..(25): n is a, c, g, or t
caagttgnnnnnnnnnnnnnnnnnncaaaataatattctcacatatgaaagaaaaacagctacacgtttaattttttgaagacttttcaatttctttttgtatttcttgcaaaataaatttaagctggtttggttcggcatagaaatacatccacagctgtcttctataattctgccatttcgatggaacttttttcgcacacgcaataatttctattgatgacttaacagactctagttccttcttgagaagatgctctactcttctaataagaagctgaagttcgcttggtagtaaaagaacccgatgggtaggaccactgattaaaaatgattgaagcgtttttatagaacttctcaattgcccacctttagattttaaatctttaaaacccggtgtaaataatttgttttctaaaagttcaacttctttgttaaactcactgatcagctcaaaagctctatcgatagaataatttccttcattcttagagagtagcttgacaattgttttagataactttagtctttcagaggacgaagtctcatgatggttttgaattacatctttcattttatctgttctgataatacaactttccatgtcccaacttatgtaacttataactcctttaaaatattgttcatactcttcaatctgttgtgtctcctcacgatacattatttttagaacaaaataatgtgccaaaagtttctgaaccatgtcttcaagatctttcagttctagtaaacttttttcgtaaacttctacttcctgttccatgtattgtaattgggtccgactaatgtgttgatctgcatatttctttgtacaatcctcaagcatatcacacagcctttttcttggtgtctaattttactgctata

SEQ ID NO: 10850 - DNA, 594 bp, Diabrotica virgifera
accttgagggtaggaggctgtacgaacccaagttaatacttttaggacgaatcccccttttatcagctgtagaaaaagcgaatagtgcctcatgtttcgtccttcgcaacagcagcgcaggcagtatggcgataggaacgagacctgtaacgatatattaaagacgttagatgaggtgattatgaacagcatgattcacaagatagcatattttcctgaattagcattacttaaaattgacgacggacgcaaggaatggagttaccctcgagttaatgggaagaatataaggaagagtagatgcaaatactatgatatgttatggtctcatttgctttgccagtataaggaattgatatttcgtgattatgctcaagtcaaagctaatgagtttatgagattactagctcgaagtattatactttggtaggtagacatgaatatgcaatagagctggtatcgcagccatcctgggatacggttgctggttatgtggataagatgggaacactctgtatgtagaaccaatactaccctgaccactgacgacgtaatatggcccccagcactgttgatcaccttcacgcatgtaaa

SEQ ID NO: 10851 - DNA, 198 bp, Diabrotica virgifera
  misc_feature (7)..(40): n is a, c, g, or t
  misc_feature (63)..(76): n is a, c, g, or t
  misc_feature (79)..(101): n is a, c, g, or t
  misc_feature (109)..(131): n is a, c, g, or t
  misc_feature (161)..(192): n is a, c, g, or t
taacagnnnnnnnnnnnnnnnnnnnnnnnnnnnnnnnnnngattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 10852 - DNA, 94 bp, Diabrotica virgifera
  misc_feature (6)..(59): n is a, c, g, or t
  misc_feature (69)..(91): n is a, c, g, or t
gggggnnnnnnnnnnnnnnnnnnnnnnnnnnnnnnnnnnnnnnnnnnnnnnnnnnnnnngttaaaagcnnnnnnnnnnnnnnnnnnnnnnngac

SEQ ID NO: 10853 - DNA, 626 bp, Diabrotica virgifera
cctttgcgtccgcgtgatttacggaagtttttggaatggacccccttacaacaacacgccgacgattatcttattccacatcttaataatccggtggacttcagaaccgtgagagggaagccgcgatgctaatatagaatccgagctagcccacagtaatacgaacacaagtgctgtcaaaacctgatatgcccttgtattatgtatttttaataatagcccgaaacagcgatggagaggacatcgagtatcgcaagtgtaatcgtgtggcatgtaactcgcctccgactgatgcactaataatcctggtttataagaatgcagcgctcgcaggtgcctacccgctgatctcttcccgctatgcgttgctttccgttcgaagtcatcctatgcccgtagaaagagttacgaaactgctctataccatgaatacccacacacagaataccaagtgtagacgcaagctatccccttaatactatgaagtaatatcatgtgctagaaggaaagcgttcggccgcaatccccattgggcagtatcatatctcatgtgtgatatagcttgatgtaccgaagtttacgatgcaggcgttatagtatcctatattagtacaatgcgtcgacac

SEQ ID NO: 10854 - DNA, 903 bp, Diabrotica virgifera
  misc_feature (872)..(899): n is a, c, g, or t
tacttgcagttggtacagtgatctcaaaaatggcatttaaactcatcagtttcttggcacttgtcgccgccgctcatgcaggagtcataagcccacagcattcttactccgatgctccttcagtttcttattcaagtgtttcaactcctgatgtgtcatatggtggaccaagttatgctaaagttgctgctccagttcactacgcagctgcaccagcatataaagtagccgcgccagtatcgtactctgccccagtagcatatgccgctccagcttataaagtagctgctcctgtgtacaaagtagctaaacaagttgtatctgaagattattactcaactccagctcactatgattttggatatggtgtagaggatccccacactggtgatgtcaaaagccaacacgaaactcgcgaaggagatgttgttaagggaagttactctttaattgaagctgatggtaccaagagggtagtagaatacaccgtcgatgcccacagtggtttcaacgcagtcgtacaccgcgaaccatctagtcattcagttgctgccaaatatgctgctccagcagcctatgcccaacctgccaaatatgctgctccaatagtctatgcccaacctattgtaaaagccgttgcaccagtagcttatgctcaacctgtcttgaaggcggttgctcctgtagcttacgctcaacccattgctaaagcttcatatgcacctaaactagtaggtaaagtacccagctttcaacaaagtctcataattctaagtgcccctgaagtggcttactcccagtgtttctggctccagaagaacatgctggttccttcctactaccaccactaaaaaaaacagcaagctgctggnnnnnnnnnnnnnnnnnnnnnnnnnnnncttg

SEQ ID NO: 10855 - DNA, 745 bp, Diabrotica virgifera
cggacgcgtgggaaactgtacaagttgttatcgtttcaagatgatgttcaaatttgttttttctatttctgaagtggctgtgtctatgccgcagcccactcgtgatccactggtagactttttccggggtgggctgtttcgaaaaccgttcagtttacccaatactgagatacagtcttctgtttttgaaggtgcgttttcttttccgctacctgttcgcgatccactactagacttgtgcttgggtatgcttttccgaaatccaagctttgctgatattcaggcacagatcttctctcttatggtaactagctctttagcttttataccagaaataattggctttggtcttggcgtccacgcattacataaagtggcagagaagttgggagttcctgacactgtgttcaaagttgaacacaacgtcccagatcaagtattcgccgagcccgacggtcgtcaatatgttctgaagaaacagtggattggtagtacacctgttttagccaaggtctacagtgacaatggacaggtcgcttttgttgacagcagttcaagtgttggaactcctgtcaacaacaacgctgtcaaccaaggagaaagtggaagcggaaatgccgccattgaatacagtaacgaagaagaatggaacaacagacataactgatttgatgtttgtaaagcgattatttgtacttaatatgttataaaagcacaaatgcaaataatattgaatataattatg

SEQ ID NO: 10856 - DNA, 538 bp, Diabrotica virgifera
cattatattgttagagaatatattagagaatcaactaaaactatggctcgtcgagatgataccagaaccacaacatcctctccagaagggaggacgtatcaggtggagtatgccatggagggtatttcatcatggaggtacttgtctgggcattttagcaaatgatggaattttggtggctgctgagaggcgtcacgctaacgaattattagacgacgtagttatttcagaaaaaatatacaaatctaaacgaagctatggtttgcagtgtggttggaataacatcagatgctaatgttataacccacgaatggagacttataggtcacagatatttatttcagtatgcccgaatccattccttgcgaacagttagtttcctggctttgcgatgacacgcaggcatacactcagcatggaggtaaacgtccatttggtgtttcaatattatatatgggatgggataaacatcatggataccagctatatccgccagatccccgtggctactattctggttggaaagctaccctgctag

SEQ ID NO: 10857 - DNA, 647 bp, Diabrotica virgifera
  misc_feature (3)..(38): n is a, c, g, or t
  misc_feature (278)..(292): n is a, c, g, or t
  misc_feature (295)..(320): n is a, c, g, or t
  misc_feature (362)..(395): n is a, c, g, or t
agnnnnnnnnnnnnnnnnnnnnnnnnnnnnnnnnnnnngatatatactacaaccacgcgttagtaaattaaagatagaaaccaacctgactcacaccggtttaaactcagatcatgtaaaattttaaaagtcgaacagacttaataatatagctgctacaccaattataaactttaatccaacatcgatgtcacaatctttattatcgatttgaactctccaataaaaatactcttcaatccctaaggtaactaattcttataaacataaaatacagnnnnnnnnnnnnnnncannnnnnnnnnnnnnnnnnnnnnnnnnctaatattcatataatacactagaaaaccctaaaagagactnnnnnnnnnnnnnnnnnnnnnnnnnnnnnnnnnngtacaaacattaactcagtccataatatgagacattagattttaaaatgttttatcttaatttatgaaatgcatagatagaaatataatccttctttatttagatgtagcaacgatcacaaaattgacaataaaaaattgtatattcattaaatccaaatactgtcctaaatgatactcctagtaatttttttcatctttttcataaaaaaatggcgttttgtattgatattaagaagcatctgacccctaa

SEQ ID NO: 10858 - DNA, 143 bp, Diabrotica virgifera
aaccggggcgaatggtggcccagaattaggagcgcgcttatgatgccgacggaagaagaggatactgcaagtgctattatcagagaggctgacgaggacgtcgatggtggcagctgagggggtgaacggggaggggaaggcca

SEQ ID NO: 10859 - DNA, 245 bp, Diabrotica virgifera
  misc_feature (6)..(6): n is a, c, g, or t
  misc_feature (18)..(55): n is a, c, g, or t
  misc_feature (70)..(70): n is a, c, g, or t
  misc_feature (87)..(87): n is a, c, g, or t
  misc_feature (89)..(112): n is a, c, g, or t
  misc_feature (120)..(142): n is a, c, g, or t
  misc_feature (176)..(200): n is a, c, g, or t
  misc_feature (209)..(237): n is a, c, g, or t
accttnaggggatacagnnnnnnnnnnnnnnnnnnnnnnnnnnnnnnnnnnnnnntgcgacctcgatgtntgatttaagttatattngnnnnnnnnnnnnnnnnnnnnnnnntgttcgannnnnnnnnnnnnnnnnnnnnnnagtttaaaccgtgtgagccaggtgggttctatcnnnnnnnnnnnnnnnnnnnnnnnnngaaagggannnnnnnnnnnnnnnnnnnnnnnnnnnnnataattat

SEQ ID NO: 10860 - DNA, 389 bp, Diabrotica virgifera
  misc_feature (3)..(15): n is a, c, g, or t
  misc_feature (41)..(66): n is a, c, g, or t
agnnnnnnnnnnnnncgagtaccccgtgtatcgaggagtannnnnnnnnnnnnnnnnnnnnnnnnncatacgaattctaatgagatataaaattaaaatgtctatatgtaacataaatatagaacatagtgtatattagaatgaaatgtaatacgtttttaagcatatctaattgattatcaaataaattaactttattgatcaccagtatatttatattgaagtgtttatatagaatcagtatatagcatcctcaacggaggatgttagctgataactgtcgtaagaactatattattaagtgctgtacgacgattaaaatctgacgtagtctaagtgtagatgtgagtgacccctttagactactatcttaaatctcttagtacaag

SEQ ID NO: 10861 - DNA, 295 bp, Diabrotica virgifera
ttacgtatgtgggtgttacatcgaaggatacatagataagaaaaagtgaatactaacaacatagggatagccgtacaatatgtacctttctcctaaggcgcagcatgcgaggctacgggcgacctcacaaattctacgtattatatctgatgttagtggtgttactctgaaggttgtggggtccctgcaccgtgagcgaactaaatgggcacggaagactgtccacctacgctaggctctgtactataaaaaaatgacctccaatattcactctacaactccgcatcgcgagttg

SEQ ID NO: 10862 - DNA, 875 bp, Diabrotica virgifera
agtgacgaagctataatcatcattggtcttctagttggtttgaatgtgatagattgtaacctatgcgttaaggaggaagatttagactgtcctcaaggagttatcgacttttcgttgtatttaagatcttcaagtcacgtgtcgacggattccagtaatgaagaacaaggcgacgctatgattacagtgttagatcaaaaaaattatatagaagaacttaacaggcacctaaatgcaactgtagcaaacctccaaaccaaggtagaatcgcttaccaccacaaacgcactgatgaaagaagatctagctatagccaaaaacaatctcttaactctttacgatgaaaatagacaactaccattaaaattaggtaaggaatctgatggatatgctctaggtattagtggtggacaaattactaaagtagaggaaaaggaaacaaaagaaataagtaaattaattggtagtgaagtagaggaattgaaacataggttagaagaggagagaaaattgaggcaagaagctgataatgaacttgaaattcaaatgtgcatgaaagcagaaatgggagtagcgatgaaactgctagaaaaagatatacacgaaaaacaggatacaataatatccttaagacgacagctagatgacatcaaattaattaacttggaaatgtacaagaaactttcaggaagcgaggcttctctaaggcataaaactgagtttattaccaaactagaagctaaagcacaatctatgaccgataccatacaatctctcgaaaataagtatcgcgaaagcgagtctaatcgtgtaactgctgaacagctgaagcgtgaggtagatatgcaggcccgctcaagtttgaggacaggcta

SEQ ID NO: 10863 - DNA, 975 bp, Diabrotica virgifera
  misc_feature (810)..(828): n is a, c, g, or t
aaacattttaaagtaaattaggtgacacatcaaatttaattgtaccactgtgacttcagacgactgacgatggatcttgccatattgttgattggattcatcattctacttctcatatttttggcaatatgggtaatatttcctctagtatttatgaattccatatcagtacaaaggttcttcatattctttaattttcaagatccgaagaatcccgaattcaacaatcctcaaaaatatggcatgaccggggtagtaaatttctatataaccaccaaagatctgatagacggctctctagtaagcatcggagcttggctgttgttacaagaaaatcagatacaatctacaaaaatcgcaggtcaggatgacaaaacagcgagtgaaatcattagaaatacaaagagtccaattgcaatatatctgcatggtgttgggtgtaacagaataaagccaaaagaaacgtacgaggttttgaggaagcactttttggtcatttcactggaccacagaggatatggtgattccggtccagataaaccaccaacagaactaggaattgttggtgatacatcccaggtatttcaatggatccgagctttaacagacaacgatatttacgtatggggccattcgttaggaacagctttaagcacccactcagtcaaaaggctcaaggaacaaagtatcgtaccatccggactaattttagaatctccgtttactaccatgagggaggaaattccagcaacgtcgttaggaaagatattttcttggatgccatggttcacagcgactgtactaaacccnnnnnnnnnnnnnnnnnnncaatttaaaactacaacaaatatcctcgatgttgattgccccatcatggttatgcatgctcaagacgacaacgtaattccctacacccttggcgaaaagtgtacatgttgccagtacggaacgaaaaattcagatcaaggaaacgtt

SEQ ID NO: 10864 - DNA, 411 bp, Diabrotica virgifera
  misc_feature (99)..(127): n is a, c, g, or t
ggtgggacgggtgcaggtatcgggaaggcctccgcgcgtcccctaaaaggtccagcgaggcgtaagaaaaagcagacgaaactctttaaagagaccgannnnnnnnnnnnnnnnnnnnnnnnnnnnnagagagaggaaaggcgaacagaaaaccacgcaacaaggaagaggcaaggaggagccgcgacaaccgagaaaacgaacaaacaaacgaagaacggagaaccgaaggaaagagaacaaatgaaaaagtaaaaaacagtagtgtcaacaagaaaagttgagatattatggttagtatatggaatagaggttagagtgagaaaaacagaaagacaagttaataaaaaattcacatatcacgaagggagaatatcacaatcagagaatactactataaccagaaaagat

SEQ ID NO: 10865 - DNA, 809 bp, Diabrotica virgifera
  misc_feature (53)..(67): n is a, c, g, or t
tttttattaatttattacgagagggtgctctttcttttagatatatcgcttannnnnnnnnnnnnnnagagatattttgcgtgttgtggcacctcttaatgtaccaacattaaaccatcgcatgacgatctgactacaaaaggaactgctgcaaattaagaatgttaatattaattctacttatgatgcttctagaaacgagattctgtatgaaagatattgcatcacatagagatctctgcgcagtatcgccctcgagaccagtcagaatcaccccttatgatcgacggaaatagattccaatgtcaaaaaaactttcttaatacaaaaggcataagatagaatcatcccggtatgagaataactattcatgtcataatgaacactatcataaagacgtagtgactgctaaatgagtatgatgagagtaccccattctcgagaaatatatgtttctagaatttgaatatataaagattgaagcccaatagtaatccctaagagaatctagaagtatgaaaaagactcaggaaaacgattatccaggttttgtctggctggatggtattccatgtgaggatccttataaggatttagcctctttacgggcaataaagtaatgtgatgataccttgtttctagtgaattgatagataatacaatttatgtcgtctgtataacaagtaagctatgatgtcttaaatacagatgtaaaatcacagcaaacacaggatctccattcatgtgttcttttttaagtatataatttatttgaaggaacggttgtaccttttaccataaattcttcc

SEQ ID NO: 10866 - DNA, 448 bp, Diabrotica virgifera
  misc_feature (2)..(18): n is a, c, g, or t
  misc_feature (20)..(439): n is a, c, g, or t
cnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttttt

SEQ ID NO: 10867 - DNA, 107 bp, Diabrotica virgifera
  misc_feature (3)..(106): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 10868 - DNA, 902 bp, Diabrotica virgifera
  misc_feature (297)..(319): n is a, c, g, or t
  misc_feature (357)..(377): n is a, c, g, or t
  misc_feature (379)..(408): n is a, c, g, or t
  misc_feature (482)..(502): n is a, c, g, or t
  misc_feature (504)..(517): n is a, c, g, or t
  misc_feature (532)..(564): n is a, c, g, or t
  misc_feature (612)..(631): n is a, c, g, or t
  misc_feature (699)..(721): n is a, c, g, or t
  misc_feature (817)..(836): n is a, c, g, or t
  misc_feature (849)..(873): n is a, c, g, or t
gaatatgttgtgtaacaatcaacattccctttttacccttagagaaactgtcaactactgagagactgttaggatggtgagagaaggagtaattgttatagtgaaaatatgtcttctctctagcttccggatcgagagtcattacttaataatgcatacacttattcatgttcagagaccacccgagccaacaaacttgaagaatttattgtactgcaaatatattaagtagattccttgcaaggaaatggtattcgattttaaatatatcggaactttccagaaataaagtaaacnnnnnnnnnnnnnnnnnnnnnnngattaaatattgctatagtagaaatattatatatgtcnnnnnnnnnnnnnnnnnnnnncnnnnnnnnnnnnnnnnnnnnnnnnnnnnnncaaggattagaaattttcatattctggaatatgttattagtgatttgtacatattattattgctatgtgttatnnnnnnnnnnnnnnnnnnnnngnnnnnnnnnnnnnngacttagttatcgcnnnnnnnnnnnnnnnnnnnnnnnnnnnnnnnnngaacaatatataggcgaaataaagagaattcgccaacatttatttctnnnnnnnnnnnnnnnnnnnnctttttgcattaaagataaagtctcgcatgcccactgataattttgaaagaccgcgacattatgacgnnnnnnnnnnnnnnnnnnnnnnntagtgttttttattgaacaccggaaggaagggctggatgaacacgaaactgcctttatttaatctataaaaaattttatctttaagttaaacagcnnnnnnnnnnnnnnnnnnnnccacaaaaacccnnnnnnnnnnnnnnnnnnnnnnnnncaaggtttttttagaatcaaaattaattt

SEQ ID NO: 10869 - DNA, 647 bp, Diabrotica virgifera
  misc_feature (192)..(206): n is a, c, g, or t
atcctttttaatggcggacacatcgttcgcttgatgtgtgtgtgatctactgaaaatatgtgatacattaatagattgtgggagatattttcttgtgcccgatgaacaactgaagtcgctgtgatttccatggaaactgccacaacataggactcataatatgaaccgtcagaagaacatccaaaccaaaannnnnnnnnnnnnnntgtattacgtggatcttcagtatattccctcaggtatttttctcctacagaataataatgacggcaatagacttccactcgtacgaatcactttctaaatacaatacggatctgatagaatatacgcgattctagaataaatattcatgccataatgacgactttcctaaacacttagtgattgatagatggtattattaggttatcacatttttagaaatctatattgtcaaataagaatttatcatgacagatgcccgttagcactcctctgatgtctagacttctgagcaagatcaagaaaaaatattattcaggctttgttgtgtcgatgtatattcatgtcattattttagaaggttttagctctttatgggcaagaagatatgagatgttacctattgctgaaattttatacatagtacaaataatcgttgtata

SEQ ID NO: 10870 - DNA, 420 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(244): n is a, c, g, or t
  misc_feature (246)..(258): n is a, c, g, or t
  misc_feature (280)..(364): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnannnnnnnnnnnnncctaacaataaaaaaagacaannnnnnnnnnnnnnnnnnnnnnnnnnnnnnnnnnnnnnnnnnnnnnnnnnnnnnnnnnnnnnnnnnnnnnnnnnnnnnnnnnnnntctagaggtcacaagtaaaaacccgggggtgggacgccttaatttttcaaaggggc

SEQ ID NO: 10871 - DNA, 948 bp, Diabrotica virgifera
  misc_feature (27)..(48): n is a, c, g, or t
  misc_feature (53)..(73): n is a, c, g, or t
  misc_feature (920)..(920): n is a, c, g, or t
atctttattaaaaatgtcatactcacnnnnnnnnnnnnnnnnnnnnnngaagnnnnnnnnnnnnnnnnnnnnntaaccatttaatttaaaattgtttacatgtttgaaaattgcaataaagctacggtagctttagctgatcggaactgttatagataatgaaactgttcaatctctaaaggtaaaaacaaaagagaatttgacaataaaatctacggaaaaatttgataaggaaagaatacaatatttctctaatttttattgatcttacaatttaaaaattacagaataattcatttagatactgaaaagggccctgcaattaatactgcctcgattggaatcatcatcattgttggacatagatatccctcgtaattttccatctatttcgatcttgtgccttttacatccaattcctatggcaacgttttagatcgtcagaccaacgtgttggtggacgaccattgaaatgataagacttaattatacttatccttcattcttcaaagttaagcagaaagaaaatatttcaaattaataatgccataacggaaatatcatgattgtttactatattatacgagtattataaccttttaacatgtgccgatgaaaaaggtgtgtcaggagtatcatagtgatgctgagagttaattattatatctataataatcccattacgtaattattttctttggttaactatcattacggctatcttcacctgtggtaatgctactctatgtaaataccccaacagtgttacagttaaaccattgtctcaaattatctagtcaggctacatgtagtgttcataatatgcttcttctgaacaatatgcttccctgtttaaatgatttgcaaaacatgatatttatatatttctcctctagtgacatggcccagatactgaattntcttatattcattgtaatcaaaatctcc

SEQ ID NO: 10872 - DNA, 216 bp, Diabrotica virgifera
  misc_feature (20)..(215): n is a, c, g, or t
ttcgcgtccgatcctgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 10873 - DNA, 795 bp, Diabrotica virgifera
actaaatgtcgaaaagtatttgcttcttcggcattttacgaaaaaggtttccatccaacggttgaggatcagatcaagttagccaacagaatatcgagttcgttgtcggacattagtaacaagagcagcaagggacagtcgatgtacgtgaaacgaatgaaaagatctgttaaatgggtacacgaaggagaaggtcgtggaggcttcaatggtcaagaactaggcagcagcgatggcacaccaaaagaccctcttaaacttgttatgaacccgcatgggcaggttcatgacataaattctctaagaaaacaaggatacaacgtcgaaccagcgctactttctccggaaatcgcacaggagattgtcaaaggacttaattctccaaaaggaaaaggagccgagttattctcaaaatgacgcaaacgctcagaaaagtgggtagatgtaagatagacagatgcccataaggactcctattagtgctaaaagtatgagctcgagttccactgaagatactactagctttgctgtcgcgatgagaaagtatgcgatcatctaccaaggtgtttgatctttacgagaaagatggatatgagattataactgtggctggtatttgatagataatacaaatgatctttgtataatgtagttgatgatgtcttaaatagcagaccttaaaattagagcaaacagaggagctcatcatgtgtcttttttcagtatttatttttgaagggactattgaccgttttttcggaagaacttgcttgatctgattattgcaatgaattt

SEQ ID NO: 10874 - DNA, 510 bp, Diabrotica virgifera
  misc_feature (89)..(127): n is a, c, g, or t
tgaattaaaaagtaacttccacacttccagtattttcgtttttgttagtaacttaatctgggagttacttttcagtttgaggcaccgtnnnnnnnnnnnnnnnnnnnnnnnnnnnnnnnnnnnnnnnaaaaagaaactgcagagtattaagaatcttacaagcaacttacttatgtgcttgtttatctagactgttcagatgaatatcgcacgacatgagatctctggtatacccacaggaatccaggtcgtagcccaaccatagcacgcagaaatagaggccaatgtcataaaacactttcttaaaccaaaacgttaaagacagaatcattccggcatgagaataaccatagcagtcatcatgaacaccttcatgatgacgttctgtctgctaatggaggtgatgaggaatccagtttcgacaatatgacgcttctggacttgaatccagagagattgaaaccacactcagcgaccctaatatgatcgggcagtatgaatatgactcag

SEQ ID NO: 10875 - DNA, 97 bp, Diabrotica virgifera
  misc_feature (6)..(93): n is a, c, g, or t
ttttannnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 10876 - DNA, 758 bp, Diabrotica virgifera
ctgttattattcattttacatacaaaagatcaaaaagaatgggtaccagtaaccaagctaggacgtttagtcaaggatggaaagatccgttctcttgaagaaatctacctgttctctttgccaatcaaagaattcgaaatcatcgatcatttcattggatcagacttgaatgatgaggtattgaaaatcatgcctgtccagaagcaaactcgtgctggtcaacgtacacgtttcaaggcgtttgttgccattggagatagcaaaggacacattggattaggtgtaaaatgcagcaaggaagtagcaactgccatcagaggtgctattattttagccaaactgtctgtcgttccagtacgaagaggatactggggtaacaagattggtcaaccccacactgtaccttgcaaggttactggaaaatgtggttctgttactgtgcgtttgatcccagctccccgtggtaccggaatcgtttctgcccctgttcctaagaaacttctgcagatggctggtattgaagattgctacacatccgctagaggttccactggtactttaggtaactttgccaaagctacatacgcagccatcgcaaagacctatgcttacttgacacctgatttgtggaaggatatggctttagctaagacaccataccaagaatttgctgactacttggctaagaatcaccgtcctgtcactggcccagctcgtgcggaaactgcttaagttcacgtgttttgtgatcttttgta

SEQ ID NO: 10877 - DNA, 56 bp, Diabrotica virgifera
  misc_feature (9)..(9): n is a, c, g, or t
  misc_feature (20)..(20): n is a, c, g, or t
  misc_feature (34)..(34): n is a, c, g, or t
  misc_feature (50)..(50): n is a, c, g, or t
aaagcttanatttttttaanagacgagaaacccntatagagttttataanattatt

SEQ ID NO: 10878 - DNA, 222 bp, Diabrotica virgifera; identical to SEQ ID NO: 7599
  misc_feature (6)..(28): n is a, c, g, or t

SEQ ID NO: 10879 - DNA, 96 bp, Diabrotica virgifera
  misc_feature (5)..(28): n is a, c, g, or t
  misc_feature (34)..(90): n is a, c, g, or t
aattnnnnnnnnnnnnnnnnnnnnnnnngggggnnnnnnnnnnnnnnnnnnnnnnnnnnnnnnnnnnnnnnnnnnnnnnnnnnnnnnnnntttttt

SEQ ID NO: 10880 - DNA, 436 bp, Diabrotica virgifera
  misc_feature (92)..(110): n is a, c, g, or t
  misc_feature (376)..(394): n is a, c, g, or t
gcgcgcgtttttatcttaaaatacaaagatattttttttcatagtatagaaaatttatgtttaatgatttatatatagttttgggcgatacnnnnnnnnnnnnnnnnnnnatatatcttttttttgtgcctcgggtgcatggataacctattagtaatccactattgcttttcttcaactacacaggtgggattagatctgtatcgtttatacatctgtttattatctcttgtggatggacgtgtaactcgctcgtatgtacacccaatttaataattagataagtaaacataaatttattaacacctcatgtaatctgatcattcttttatatctttaatactggatattgtgagggatgggcttaaacctgacnnnnnnnnnnnnnnnnnnnatctagatcaccagacacgacaaatcgatattatgtatcttt

SEQ ID NO: 10881 - DNA, 254 bp, Diabrotica virgifera
  misc_feature (3)..(169): n is a, c, g, or t
  misc_feature (179)..(241): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggaggnnnnnnnnnnnnnnnnnnnnnnnnnnnnnnnnnnnnnnnnnnnnnnnnnnnnnnnnnnnnnnntccccattttttt

SEQ ID NO: 10882 - DNA, 928 bp, Diabrotica virgifera
  misc_feature (711)..(711): n is a, c, g, or t
  misc_feature (736)..(736): n is a, c, g, or t
  misc_feature (766)..(766): n is a, c, g, or t
tggggtcgaaaactgttttacgatgaagatcacaattttaatgtgttgtttaacgggagcaatgtgttatcttcctccagccaaggaaagtcttctctctgggctatttcttcgcgacttggtaaatcgtatcaacggtaagggcatctctgaaggggatggagtatcttacttggattttactgatggactgccactagatgggcgctctttatctggtactctcgaagaagagcaaatgtttccagtggattatgaaacaatgggtgaaatgaacatgcatcccagcattcgtgatcaagaatacttgcaacacagcaccttatgggggaaacagtatttgaatggagacagggatgaaaactcaatactacatcacaacggatttaagaataagaatggtctaaaaggtgaatccactttgccagcttattgcagtccaccgaatccatgcccgataggatatacagctgatcatggatgcattgagatgtttgacaataccgcttcattcagtcggagataccaagcatcacaaaactgtatgtgtgatacggaacatatgtttgaatgccctacctcaaatgatatttctgatgacaattccatggatatgatcgacagttatcattttaacaagatgttacaacaatcggctaagtctaagaacaatccctttttaactggagaaaaattacccgtggcagctanaaaaggcaacaatgttttactgtanacgtacaacaccaacccccaactatgaacncatccggacgacaacaaataatgactttggctatgaacatggacgatccgaagaacataaccattttaattctacccctgtacgataaactatatgtaagaacttagatagtagttgcttttaatgtgagcatataataaacaaagaatggtacccatactg

SEQ ID NO: 10883 - DNA, 685 bp, Diabrotica virgifera
  misc_feature (594)..(611): n is a, c, g, or t
gtatcttcaaagagtacttcaacagaccagaagccacccgaaaagagtttaccagtgacggttggttcaaaaccggcgacgtttcagaatactccttggaagataaagaattcaaaatactaggaagaaaatctgtagacataatcaaatcaggcggatacaagctgagcgcattagaaatagaaaccaaactattactacatccacatattttggaatgcgtcgttgtagggctagacgatgataaatggggccaaagagttgtagctgccgtggtattacatgaaggaaaggaattaactttagaggaacttagagagtgggcaaaagataaaatgcctccttattggataccaagtgttgttaaacctgttgctagtataccaaaaaatgccatgggcaaagtcaataagaaagacttgattaagagttggatgtgagatgtttagtttagggtttttgaagaatcattttttgttttcgtaacaaaatgctgaatgtttgctgcgcacgtttttttttgtgtatatatttcaaatcaccatcattttattcatattcatcacagtagctcaataatacataaaaatatgnnnnnnnnnnnnnnnnnnctcatgatttgaaagacgttaaacaatgtcagatgacgtcagacgtgagcagatgatatgtctgcagaatctat

SEQ ID NO: 10884 - DNA, 361 bp, Diabrotica virgifera
  misc_feature (159)..(209): n is a, c, g, or t
gtgactgcttactagcatttgcgacagactagtcgtaacctgaattattattagaaataattgtgactacattgcgtatctcacattattagatttatcattatacattgaatgaatctatcatgggcaccatataccgtccgttgctatggtagtctnnnnnnnnnnnnnnnnnnnnnnnnnnnnnnnnnnnnnnnnnnnnnnnnnnncactccagcgactgcatgaccacaagatcttgattagttttctgaacaatattcctgggtgtgaagaccaagacgttattaagaggtgcagcttttagagacgacacttagtaatgactgttttgttcaacatgtaccattaataaattgct

SEQ ID NO: 10885 - DNA, 1183 bp, Diabrotica virgifera
  misc_feature (580)..(599): n is a, c, g, or t
  misc_feature (650)..(669): n is a, c, g, or t
  misc_feature (1001)..(1039): n is a, c, g, or t
  misc_feature (1138)..(1159): n is a, c, g, or t
gttaaaactattgctacagatatgtgtactgatcctcgcagctagctacgtagataatagagttataaataagaggagtacggatagttcgattaaaggatacttgactgagagaatatgttggtggaacgagatctgtaaagaggaattccggagccagtttcggtgtaagtgtccggaatggtcgtactgtcgagcccccggcaaatattacaacgctttctgtaccatgaccacgactggatacatttggcaacagcctggatggagagaagcagctgaaagccagaactagactcacgaaccactttacagctcactttaggatctcaaagtcacaagtttgtgacaatctttatgtgaacattttatattttattcgtcaatcgtaatttggaaagagtacccccgttaagatgagagaatgcccccagtactagaattcaattgttttcatgtttttacgttctatgtgattaaagaattttaataaggatttggcgcaattttaaccctcctcccctatcgccaaaaacgtaattttttcgtttttattgttcttttaggagagatacgatcnnnnnnnnnnnnnnnnnnnnttcacaggcgttgttgaggacaaaaatgagttgtgtccataacctcaaacnnnnnnnnnnnnnnnnnnnncgtgtttttgttgttttgtgttttttggagatcgctacagctccataatttttatttggtgtattttatcaaaaactatatttccaaatttttcagactgttccgtaaggtgcgtcagcttcaaaaatccgaaaaactgatttttaagaggatttttggggattttcccccattttgtaaacttcaaaatagataaaatcaagggttttttatggagtgatataatatgaatttgaaccgagaaaataaagggggatttttttgagaggattttttgggagtttggaacgggtttcttccaaattttggaaacgccctaaaggggctccagnnnnnnnnnnnnnnnnnnnnnnnnnnnnnnnnnnnnnnnccctttgtttttgaattatttttttataggtctggggaaaggggggggaaatttcgcccaaacactttccccttaaaaaacccagaaaaaatctcggtnnnnnnnnnnnnnnnnnnnnnnccccttaaccggagaaaaaattcg

SEQ ID NO: 10886 - DNA, 239 bp, Diabrotica virgifera
  misc_feature (2)..(51): n is a, c, g, or t
  misc_feature (63)..(167): n is a, c, g, or t
  misc_feature (170)..(229): n is a, c, g, or t
gnnnnnnnnnnnnnnnnnnnnnnnnnnnnnnnnnnnnnnnnnnnnnnnnnnttagtaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnnnnnnnnnnnnnnnnnnnnnnnnnnnnnnnnnnnnnccattttttt

SEQ ID NO: 10887 - DNA, 1187 bp, Diabrotica virgifera
  misc_feature (439)..(458): n is a, c, g, or t
  misc_feature (481)..(503): n is a, c, g, or t
  misc_feature (560)..(584): n is a, c, g, or t
  misc_feature (642)..(659): n is a, c, g, or t
  misc_feature (662)..(678): n is a, c, g, or t
  misc_feature (896)..(914): n is a, c, g, or t
  misc_feature (974)..(1017): n is a, c, g, or t
  misc_feature (1072)..(1114): n is a, c, g, or t
  misc_feature (1121)..(1159): n is a, c, g, or t
gaggatcttaaaacgtaataggtcagaagagaagactgttgcatttgaatatatcaaagccttacatgagatacatgatgattggctgtataataaaactttacatgactgtaaggctcctgttattgttctaaatgctgatctggatagatctgttattgaagaagagtatgaaaagtatgagcctcatattcttaataaaaaacctgtaggagttaagataggttaaagatatttatgtaaaagataaaatgtaagggtttttcatgtatactgtgtgatattaattcctcaaggtcataacgttaaaagtagaggtcaggataataatattaaagtagaaaattgataccaaattgactgcattggtgtctattactaagaaccttaattaaccacttaatgcacatattaattttgagtttactgtaaaagaatnnnnnnnnnnnnnnnnnnnnagtagtcgagtatgcatataagnnnnnnnnnnnnnnnnnnnnnnngggatgtaataagtgtatttttcatgacagtgatttttaatttagtaaattatatgnnnnnnnnnnnnnnnnnnnnnnnnngcctaattaaaaccaaaaacatattagcagtgtagaattatagtacctaagggccagnnnnnnnnnnnnnnnnnnggnnnnnnnnnnnnnnnnngtctcatatggtaaatcataaaacaagacaatcacatagtcctcattagagtttctgcagtaatacctcatttttttggcactctgtcagtctaaatggtctggctttgttagtaattcttccccttttctgtagggtggtggaactgtttaataatttttttctattaattaaatgacaaatttctttatttttgtccccttttgccccccattttnnnnnnnnnnnnnnnnnnngccattttgggcttttatcataactaagtgaccatcatccaatactgggggggggaaggnnnnnnnnnnnnnnnnnnnnnnnnnnnnnnnnnnnnnnnnnnnntcccgggtggcttacgctttatttagaaaaagattatttccaaccccccctaatnnnnnnnnnnnnnnnnnnnnnnnnnnnnnnnnnnnnnnnnnnncaagggnnnnnnnnnnnnnnnnnnnnnnnnnnnnnnnnnnnnnnncacccggaaaaacaggaaagggggggtg

SEQ ID NO: 10888 - DNA, 689 bp, Diabrotica virgifera
  misc_feature (2)..(403): n is a, c, g, or t
  misc_feature (412)..(432): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctattttgnnnnnnnnnnnnnnnnnnnnntacagattaaattatttacaggtattgctgacgctaataaaaggcatgagaacatctataatgggggtagatctataggtgcaggaggatatgtcttgatcctttttctgacaccgtatacataatacataatcatcctcgtatagcgaaaatgatgatgccctcatctgcgcacttaaaattacagcaaacccaggagctcatcaacgtgttctttgtcagtatatatttttgaagggactatgcggatcgctttt

SEQ ID NO: 10889 - DNA, 1016 bp, Diabrotica virgifera
  misc_feature (108)..(133): n is a, c, g, or t
  misc_feature (563)..(582): n is a, c, g, or t
  misc_feature (748)..(748): n is a, c, g, or t
  misc_feature (832)..(832): n is a, c, g, or t
  misc_feature (896)..(896): n is a, c, g, or t
  misc_feature (963)..(983): n is a, c, g, or t
ccttcgcgtccgtgataacaaaatcaatcaaagagttgtttactaaataattttgataatatatttgaataataataattgatgtaaggcgtacaattaataaaaagnnnnnnnnnnnnnnnnnnnnnnnnnnggaaaatccaagtatttcaagtcattaaagttcaaataaaagtattattttataagagtttgttccgataaccgtaaataggtacgagtttagctataaagtaaagtgaccgtggtggcataaaatgtagtaaatgctaatgcttcaagcacgtactacatttttgaagatttcactacacttaaaaagcatatttgcttttctccgtagtatttgctactatttaccagcctacatagaagaatgtactacgctttttaaatatgtgcttgtttagtactatttggcttcagtttaagtgaagttggtgggtggacgttttcggcgtaggtatttttttgttacaatatggcagcatttatgaatgtatgtcatagaaaaatttacaaactacgaagaagattcttaatttttggggtcattcttttannnnnnnnnnnnnnnnnnnngtgaagaagattaacaaataacaattgtttatttttatccttgcgtaactctttggtcgcttcggatctgagtcactcatttttactcatgtacaattctaataatttggtacgtaaaatgtgaattcacaaatcaaaagcacatggaaaactaattccatcacgnatggtgtaatgcagacaccgctggcgctacgctttgtagtagatacttctggtcagtagtaggtactttctgtgtgtactaagntctcaacaaaagcacctactttttatgtaaaagaaaatgctacaaagtaatgactatttactgnagcaataacatctactacgtttatgcattccgcccatttcttgagtgaattattaaatgtgacttcnnnnnnnnnnnnnnnnnnnnngggttttaaattaaaggttcccttttaccgaaa

SEQ ID NO: 10890 - DNA, 910 bp, Diabrotica virgifera
  misc_feature (143)..(159): n is a, c, g, or t
  misc_feature (603)..(622): n is a, c, g, or t
ggttttgcttactagcatccatttggtttttgtaatcttcagtttgagcccgtattctgcacttcttctttgtatgttacccatccggcaactcagctcctccatgcctaccttatgttattaattatttctccatttatctnnnnnnnnnnnnnnnnntcctctagcgctgtcttaaatacttcttcagagtatatgttaaagagaatatgagataaggtactgccctgtcgtacctcttccttgatttcaattttattcgtcaatgtagattctattttcactgtggctgtttggcctcaatagagactcactattgttcgaatgtctctgtagtcgattccggtcttatggagtacttgaattatcttttcgtgctttacattatcaaatgcttttgcgtagtctataaagcaaatatacacgttcttgttcatatctctgcaacgctggatgagtactacctgtagactaaaaagtccacttgtacaaagagcattacgaaacccaaacagcgaatagagtatggtcaatttcaactttatttatgaaattatcaacattattaacacctatatcttccaatgtactatctaacctcgnnnnnnnnnnnnnnnnnnnncagaatttatatatcgaacaagcagtgtagaaataggaaaagagatgtgagaaagatactacttagtcattattattttatttgggattttgctgaaattgtggggtgtgggggtggggcgtgtaagaatttaccgaaaattaatattggtttctaggtaattctgtaaatagaccaagcgtagaaaaaacactacgttcgtggtaagtctttcgcttgataaccatttacaacatggtacaaataagtaatgatatgatttgtaaacatttacactctttttctact

SEQ ID NO: 10891 - DNA, 184 bp, Diabrotica virgifera
  misc_feature (8)..(30): n is a, c, g, or t
  misc_feature (45)..(79): n is a, c, g, or t
  misc_feature (81)..(117): n is a, c, g, or t
  misc_feature (120)..(175): n is a, c, g, or t
gtaaaaannnnnnnnnnnnnnnnnnnnnnnaaaaaaccctaatannnnnnnnnnnnnnnnnnnnnnnnnnnnnnnnnnncnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnaccaatttt

SEQ ID NO: 10892 - DNA, 894 bp, Diabrotica virgifera
  misc_feature (564)..(589): n is a, c, g, or t
acggaatgatggtgcgtctttgtttatgtttatttttgtgatttacatagatagtttcatttgtattctgtgtacggcggcgtcgaagtaagaattggctaagtcgaaaaatcgtttctttggaaagttttccaaatatatttttaaatcagattagtatacaataagagtaagcaggcgtccaaaaacatcgtcaccatgtctagggaaatatcgagaagactctctctgacagctttacaatttcagagaacttatgcaacagatcggccatattctacagctcttggagttgtgtctgacgaaatgcaagacaaagacatctacgaatacaagatcgaaaaggtggatcctatccccaaagactacaaagagattcctggtcccaaagagctcccatttattggcaattcttggaggtttgcacctattattggtcactataaaattcatgaactagacaaagtgatgtggtcgttgcacaaacaatatggcaaaatcgccaaagttagtggtttgattggccatccagatttgctgtttatttttgatggcgacgagatnnnnnnnnnnnnnnnnnnnnnnnnnnccatgcctcatcgaccatcaatgccctcgttgcactattataagcagaagttgcagaaagattttttcaatggaaatgagggaattattggagtacatggtcccaaatggggagacgtttcggaaacaagtgcagcaattcttgctacccccaataacagctaagaagtatatcgaacctttagaatgagattttcactgacttcataaatcgaatgggaaacatgttagataccaacagagaattaccagatcacttcctatcagaaatttataaatgggcatttagatctggtagcgagagtc

SEQ ID NO: 10893 - DNA, 823 bp, Diabrotica virgifera
  misc_feature (448)..(471): n is a, c, g, or t
gcgtggagaaggtcttataggcaattattaggtcctgaaaatattttagcatagagaagtgaaggaaggagacgaatctcggggatgcgaaacttgagggaatggtacggatgtacatcttgcgaactattcataggagcagcgtgtatgatcggaatagacttgatgattgccaacctccggcgcagagatggtacgtgaacaagaagatacatggattctttttattatcaccgtgagggaatgcatgattagtcaacacgccactaatgattccagagtgctatattgggtgcgttcggacgacgtccgcgggagtgtaagcacaaagcgacttagtggctgagtcaagcggagatagggaatgcttcatcattgattgaaagggctgacttccaacagtgtcgatctgaacgctacagacttactcaggtggtcctccgctggnnnnnnnnnnnnnnnnnnnnnnnnttggtgccgatatcccgccagtaggaatcacgtactggatatggaattccatattctagagaactcataactgggcacatgaaaaggtgtagaaacgtaggcctcatcttttacctatttcatgactgtattccctacacctataacctttaaacccttcctagattggagaaccttgttggcatgactaattcacaaaagtatcctatagcttcctactttagcctgccaatatctcttctctggataataatcaaagtaattgccaaaactttattagtaaaatgactcgcatacttattgcgatcgccccctagcgccagccgtctaaatttgaatactttttaattcc

SEQ ID NO: 10894 - DNA, 662 bp, Diabrotica virgifera
cggaattgacggggggcattaaaagtgcgggtatgaagagaagtaattgaagtatgtgacctcttgatgtgtatataataataggaaaaaagtaagtgtaatgggatattgtttgagagatgaatgtattaattttcgttcatttgtggatcataatatttggtaatactataggaagaatttgaagataaattggaatgatcatagtacagacttgaagagttgcacgggatggtgtatacttgtgaaaactctaagagactcgttgtctttggaaagtagtctacatttgtttaggaaggtatagatagcattagagtatgctgccacatataatagtaatatataggtttttaaattcggggatttaatttctcaacattgtgacactacacgagtctaaagagctcaccgaagaaaagtccaagattatgtatttgatatctatatttattttactttagaattttttaaatttttctttgaactcggtaggaggaagatgcttattcatgatcttgtccatagttttctcgagaaatgagtatccttttgaggattaggggtaataagtatgtacaaatcgtgtcttgaatatacccttggtaggagagtgaagttgtcgacaataatggaagtatttaaatccttgtatttcgttt

SEQ ID NO: 10895 - DNA, 937 bp, Diabrotica virgifera
  misc_feature (848)..(848): n is a, c, g, or t
gtaacgaacaagtgttccgtacgacacctgtcaaagtttcggtaaacaattaaaaatttcgcatatttgatcgatctcttgttcctacttatgtggtgtgtttttggttatttgtgaattgtgttttacaaaatacgaggcttagtttttcaaaatggatatgacacctacttattgggaggaaaattcgaacatacagcccattcagcgggttaaatacgaaagttgtaatgcccatgacgaaagttccagaatgaaagaagaaaggacagtttatacatgttgcgatacaaatttaaatttttctacagctacatgtagtgaagacgattgtgagtatggaccctataaaaagaataaagtagctcggcaagatccaatgtcacatcgaataatagagaaaagaagaagggatagaatgaacaattgtctcgccgatttgtcacgattaatacctacagaatatttgaaaaaaggacgagggaggatcgagaagacggaaatcattgaaatggctataaaacatatgaaatatttacaacaggaccaagggaatccaactgagcactatcggctaggatatcaagaatgtatgtcggaagcgatgcgattcatggtagaagtggaaggacattttccacgtgaagccatttgcgtcagactgttgaatcatttacaaaaacacggagattcgttttcccgtgcgtcgttcaacgggaaccaccattcttcattgttgacagaacacattgtaccagtaccgaacataccagaaccaatttcaaatgacgtaaatcccaagacagtaggctactctctgcccaaatggaatccgaacccacaataancacggctcttacatagtaacccccaatagtcagatggtaacagaagctgagtacgagaaacacgcagatcacccagaaactcatgcaat

SEQ ID NO: 10896 - DNA, 111 bp, Diabrotica virgifera
  misc_feature (2)..(37): n is a, c, g, or t
  misc_feature (43)..(110): n is a, c, g, or t
gnnnnnnnnnnnnnnnnnnnnnnnnnnnnnnnnnnnngggtgnnnnnnnnnnnnnnnnnnnnnnnnnnnnnnnnnnnnnnnnnnnnnnnnnnnnnnnnnnnnnnnnnnnng

SEQ ID NO: 10897 - DNA, 270 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
  misc_feature (242)..(242): n is a, c, g, or t
  misc_feature (246)..(246): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattagnagcngccgaacaaaccaatcatgaagag

SEQ ID NO: 10898 - DNA, 315 bp, Diabrotica virgifera
  misc_feature (4)..(75): n is a, c, g, or t
  misc_feature (94)..(94): n is a, c, g, or t
  misc_feature (261)..(301): n is a, c, g, or t
ggtnnnnnnnnnnnnnnnnnnnnnnnnnnnnnnnnnnnnnnnnnnnnnnnnnnnnnnnnnnnnnnnnnnnnnnnngaataaattaccttagggnataccagcgtattttattgggagaagtcaatcgataataaagatgccgactcgtagtttgaattaagttttataattggtgtagcagctattttaataaagttctgttccactttttaaaatttacctggatttgagtttaaaaccgggggggggcccgggttgggnnnnnnnnnnnnnnnnnnnnnnnnnnnnnnnnnnnnnnnnnaaaggggcccacca

SEQ ID NO: 10899 - DNA, 1019 bp, Diabrotica virgifera
  misc_feature (12)..(690): n is a, c, g, or t
  misc_feature (692)..(823): n is a, c, g, or t
  misc_feature (830)..(853): n is a, c, g, or t
  misc_feature (902)..(922): n is a, c, g, or t
  misc_feature (936)..(936): n is a, c, g, or t
  misc_feature (938)..(938): n is a, c, g, or t
  misc_feature (940)..(940): n is a, c, g, or t
  misc_feature (988)..(1007): n is a, c, g, or t
tagaactagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcgataaataagattgcgacctcgatgttggatttaagttataattggnnnnnnnnnnnnnnnnnnnnngtctgtcgactttnanantttacatgatctgagtttaaaccgtgtgagccaggttggtttctatcnnnnnnnnnnnnnnnnnnnngtacgaaaggac

SEQ ID NO: 10900 - DNA, 394 bp, Diabrotica virgifera
  misc_feature (2)..(20): n is a, c, g, or t
gnnnnnnnnnnnnnnnnnnngatattatttatacaatttacagttaaaaactaatatattaaagctatgctaacaacaaactaagcttctccgagaataagcgcttcgtatggatccagcaccagacttttgttgtcaacaatgtcacctggctttcgttttgaatttttactgcatataagcactttatatccaacattgttattttcgagctaggaaacatcagacgcagagtttcctaaaatacaaataaattcaacctaatcagaatttgaaccgttaactttgttaaaacttgctacttcccatacatttttatggctcccttgagaatatacatcgaattcagacttactgttaaaagtcttcctcaatttttgtatactttttataa

SEQ ID NO: 10901 - DNA, 1253 bp, Diabrotica virgifera
  misc_feature (810)..(811): n is a, c, g, or t
  misc_feature (1060)..(1082): n is a, c, g, or t
  misc_feature (1111)..(1177): n is a, c, g, or t
  misc_feature (1192)..(1226): n is a, c, g, or t
tggagaaggtcttataggcaattattaggtcctgaaaatatttttgcatagagaagtgtaggaaggagacgaatctcgtggttgcgtaacttgagggaatggtacggatgtacatcaaccgaactattcagagcagcagcatctaagatcagaatagccttgatgattgccaacctccgtcgcggagatggtacgtgaagaagaagatacatggattctttttattatcaccatgaggttctgcatgattagccaacacaccactaatgaatccaaagtgcatattgggtgcgttcggacgacgtcagcggcactgtaagcacaaagcgacttagtggctgtgtccagcggcaatagggaatgcttcatcattgattgaaaaggctgacttccaacagtgtcgtctgaacgctaccgcttactcagctgtccagccgctggctgaggtcgtccgaacgtatccattgttgcccatatcccgccactaggaatcacgtactgtatatggaattccatattttagatatattataactgggcaaattaaaatgtgttgaaatttaagcttatcttttacctttcatgaatgtattcccaacactatacttttaaatctttcgagattggaataccttttggcatgactaattcacaaaagtatcttatatcttctactttaactgcaaatttctttttctggataataattaaaatattcgaaactttatgccaaaatgagctcatattatttgatcgccgctaatgacagccgtctactttgatcttttaattccactatatttacatgcnngtgtatgtatatagtattgcttgatttttgttcaaaattatcgacagcttctgagatgaattattacattttgtgaaaaaattcttcatgggagtcttgtgaattttttaattttggggcttgctactaaatctcaattttcatttagggtttggtaaatattattgatttaaagggtttagtttttttcccaacttccatgtatattttcccgaaggaatacaaacttggcttcctcttgaccacttnnnnnnnnnnnnnnnnnnnnnnnggggccgggttagggtggccttttgcccnnnnnnnnnnnnnnnnnnnnnnnnnnnnnnnnnnnnnnnnnnnnnnnnnnnnnnnnnnnnnnnnnnncaatttaaaaaaggnnnnnnnnnnnnnnnnnnnnnnnnnnnnnnnnnnnttgggggggggtgtttttttttttttt

SEQ ID NO: 10902 - DNA, 120 bp, Diabrotica virgifera
  misc_feature (11)..(116): n is a, c, g, or t
gtttaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 10903 - DNA, 621 bp, Diabrotica virgifera
  misc_feature (97)..(112): n is a, c, g, or t
  misc_feature (115)..(128): n is a, c, g, or t
  misc_feature (132)..(148): n is a, c, g, or t
  misc_feature (150)..(184): n is a, c, g, or t
  misc_feature (202)..(335): n is a, c, g, or t
  misc_feature (337)..(375): n is a, c, g, or t
  misc_feature (380)..(407): n is a, c, g, or t
agtcgatacaagcaagcaagatgaaaaagtaaaagtaaaaagttaagatgtgtttcacgccaaatatggtttttttgtactttttcaagtggcctgnnnnnnnnnnnnnnnnccnnnnnnnnnnnnnngtgnnnnnnnnnnnnnnnnngnnnnnnnnnnnnnnnnnnnnnnnnnnnnnnnnnnngtatatatgtgtatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnncacannnnnnnnnnnnnnnnnnnnnnnnnnnncgtgagaaacatattataatatttcttttttagtttgtgaacacgtgtgtatatatagacgcgcgtgtgtggggaggcgtgggtatagcgagggggtgcgggggggggtccgggctctcgagagagtgtgtggtgagagagcggcgcgctcgcgtgcgtgtgtgttttgtgagagtcgagaaccgtgtacatatgtgctgactgcccactattt

SEQ ID NO: 10904 - DNA, 875 bp, Diabrotica virgifera
acaattagtctcctgctccctggtcaattaagtatattggaagttccctagctgaacatttactgagtaaacgtctaaattaagtgtgactatcttcactctaaccttatatattttcccgccaataacaagaataaatagtttttaaattcacccctgtctgtacctgtcctgtaaagaaacacttttatgaaataatttaaataatgtctgttgaatacaatccagacactttaggtgaccttctgcctttatattatagaagactgttcccccattcacagttttatagatggttaagttatggacatacattaacatttgccaaaagagaaatatcctttactctacttggagatatttacattcgatatcaatcatttgatacccaagaagatttttcaaacgagctgcaaaagaaattccctatgaagatcgatttgggggccatatatcaaaccaagccgagagacaaaggccctgtgtcacagattgtacctgtagaaaaggaaatagtgtttgacattgatatgactgactatgatgatatcaggacttgttgttcaggtgcagacgtctgcacaaaatgttggaaatttatggtcatagcttgtaaaatattggatgcggcactttaccatgatttcggctttaatcacaggctctgggtgttttctggaagaagaggtatccattgctgggtgtgtgaccctcaggcaagagtcatggatgaatctattagatcttgtataggagattaccttcagattgttagaggaggtgctaatgtttataaaaggtacagttgcctggagaaaaaattcatgcatctctagaaaggggcttgggcattataaatacctattttaccacta

SEQ ID NO: 10905 - DNA, 894 bp, Diabrotica virgifera
  misc_feature (740)..(740): n is a, c, g, or t
  misc_feature (766)..(766): n is a, c, g, or t
  misc_feature (865)..(866): n is a, c, g, or t
cccacgcgtccgaaccgtgatacacccgatgtatccaacatggcactgcctaacgatccaacaaactctgccacacttccctacccccaaactttcaaccgtgatacacccgatgtatccaacatggcactgcctaacgatccaacaaactctcccacacttccctacccccaaactttcaaccgtgatacacccgatgtatccaacatggcactgcctaacgatccaaaaaacagtccaaaacaaccctgacccctgaacaaccaatataaatttcgactaatcaattgataacaatgtttcaagcttcttttcaaagttatcggtgtagtaggacattatttttcatattcgatgatttactactttgttctatgattattgactttatattgtatctttatgttatcttttattacgttatgtacttttttatgttttacgattattagttttatagtaggggaggaaagtaggctaaatttgcagttactcgagcgttatggggaactactgcgttgtgaagattaggtcataaaaccaaataaagttaagtaaaatttgtcatttaagtggggactttccattttaatttaagtttccatttccaacaatcattttttccgtttacagcgccatctatgcataatttgaaaaaatgtttcgaataaaattacttatttttacgccaggaatccaaatctgcaatataaaatgggggctccaatttaatattttanagtaaccccccaccccacctccgtgnggggtcatgtttagtgtcattcgatagatttttcaaaaataatgaatacgtgtattttgcagtttttcggtctgatgtttatttcgcgaaatatcgcgnngttcctatttgaaatttaaattgacccc

SEQ ID NO: 10906 - DNA, 862 bp, Diabrotica virgifera
  misc_feature (126)..(147): n is a, c, g, or t
  misc_feature (315)..(333): n is a, c, g, or t
  misc_feature (344)..(356): n is a, c, g, or t
  misc_feature (358)..(400): n is a, c, g, or t
  misc_feature (827)..(827): n is a, c, g, or t
cccacgcgtccggttacccacaaagttcaaagactgcaggctagaaagatttaaaactgaattaaaagagttacttcttactaactactacaacagatagctttaattgaatataattctataacnnnnnnnnnnnnnnnnnnnnnncaatcatttactttaatacaatttctttaatgaatctatataggaaaacttaaccttcagtgtaaagtagtctaaaaagttttatgttatgtaatctgttaccattatatttatgtttattatgttaccacaaaaccagcatagctacggctcttggtttttttaatnnnnnnnnnnnnnnnnnnntgttattacgnnnnnnnnnnnnngnnnnnnnnnnnnnnnnnnnnnnnnnnnnnnnnnnnnnnnnnnncattaagcagtataaagttactgtcagatcttttctaccgccattgtttattgatataaattattttccggtagcttgggttatatattaaaaaaactttattttaatacataatattggaatgtttatacagtactctgtgctgtttccttcattgctgttgtggaattttattgacttcttctagaattgtatatttgactatgttagaaaccatcctgatatttaattttatctatcggtattttaactttacttttccgtttatttaaaagaaggtcttttgtgggttcaaattttgctgaacagactcaagctttaaatctcatggctgtcgctaccaaagcttttttcaaaaccaactattgtcaacgtattttaaaaccaaccaattattgttatcacctacaccgattagaaactatanaacgacaaaatttaggaaattttcaatattttcta

SEQ ID NO: 10907 - DNA, 467 bp, Diabrotica virgifera
  misc_feature (5)..(24): n is a, c, g, or t
taacnnnnnnnnnnnnnnnnnnnngattctgtgtcaataggtagagactattcgtagaatcgtcatatctttttactgcaatgatatatgtatatccatgagtagagaggcaattacattgttccggcggacctagaaggatgtatgtaatagtaataagatagtatattgatctatcactgactcaaacgaactgaccaattactcttttctacgatgcatatgtacagaaaagacattctatgtaatagacagcgagtcggatcgcacttaaactagattaatagatcagcaattgaattagcttcatttagttatatattaagtacaataaatgtatattgagcctattaataatttacacgtctaagctaaggaatactgtgatattcaaatataatatggaaattttgataattactacacgagatcatatcgtggtagcgataaacgttattattagatat

SEQ ID NO: 10908 - DNA, 361 bp, Diabrotica virgifera
  misc_feature (27)..(64): n is a, c, g, or t
  misc_feature (124)..(138): n is a, c, g, or t
  misc_feature (140)..(157): n is a, c, g, or t
  misc_feature (160)..(178): n is a, c, g, or t
  misc_feature (193)..(222): n is a, c, g, or t
  misc_feature (225)..(257): n is a, c, g, or t
  misc_feature (261)..(280): n is a, c, g, or t
  misc_feature (310)..(347): n is a, c, g, or t
tcataattttcatattgtaaaatatgnnnnnnnnnnnnnnnnnnnnnnnnnnnnnnnnnnnnnnctatcaaaatattaactttgattatttagatttcgtaatgataatcttagtattaaaacnnnnnnnnnnnnnnngnnnnnnnnnnnnnnnnnnctnnnnnnnnnnnnnnnnnnnctcccctgtttatgnnnnnnnnnnnnnnnnnnnnnnnnnnnnnngannnnnnnnnnnnnnnnnnnnnnnnnnnnnnnnncggnnnnnnnnnnnnnnnnnnnnccatattccttcagcctttttttattgagnnnnnnnnnnnnnnnnnnnnnnnnnnnnnnnnnnnnnncatctattttatac

SEQ ID NO: 10909 - DNA, 922 bp, Diabrotica virgifera
gattagtttaaaaacaattatgacaaaatgtctctaaaaaattttacaactacacctaacgatccagtttctacagtcagaataatatcaacatgtgtatcagctataattctgagatactatttgatgctttccaagtatcagtcagtaattgcaaaccatgtagaggtatcaacgcccttaaattcatggaagagggtatcagaaggattgtacttattatcccttaatattaacccatataatggagatgttttgcatgagacaccattgtcattgtattggtacaagactagtttacaactgttccaaggaaaagtacacctaattttcataactttggagatagcaacatctattgttctgtattacaccataaaaagatttgctgcagtaatatacgaagaagaagaaagggacagaaagactttctccaaagatgccgaagatagcttattaaaacccgaaaaaatatttcgaaccccttactacgttcttttggcctacttgtttaatccgtatactttattgaactctgttggtttctcaaccacagttttttataacttctacctctcagttgtactattttcgatggtttatggattaccattactatgtggagtatttctggctatgtcagcatcagtatcattctatccggtagttttattgttaccagctagtttttactaccaacagatctttaaaagtagtctgaaaactgtaacgtgtgttgttagttttattgtaacctcgttattgattgtgtcagtgtgtagtgacagttttaacaactttagttatatacgaaatgtttatggttgtatattgaacgttccagatttacaaccgaatattggactgttttgggtactttttactgagatgtttgaaacacttagagaactattatatatgc

SEQ ID NO: 10910 - DNA, 176 bp, Diabrotica virgifera
  misc_feature (75)..(96): n is a, c, g, or t
actcactataagggagagcgtggcacgccgtgcagggaccgggcccgtccccgccggcccccccctttccgggcnnnnnnnnnnnnnnnnnnnnnncaattcttccccaaacgaaaaaaactaaaattattgatgattggtaactagtgattggggaggagatattactatggtat

SEQ ID NO: 10911 - DNA, 535 bp, Diabrotica virgifera
  misc_feature (2)..(25): n is a, c, g, or t
  misc_feature (27)..(54): n is a, c, g, or t
  misc_feature (100)..(119): n is a, c, g, or t
  misc_feature (124)..(192): n is a, c, g, or t
  misc_feature (195)..(235): n is a, c, g, or t
  misc_feature (256)..(364): n is a, c, g, or t
  misc_feature (366)..(382): n is a, c, g, or t
  misc_feature (441)..(459): n is a, c, g, or t
cnnnnnnnnnnnnnnnnnnnnnnnngnnnnnnnnnnnnnnnnnnnnnnnnnnnngtgaagtgatgttcgtcgttaaatatatctacttttttaataaagnnnnnnnnnnnnnnnnnnnncaatnnnnnnnnnnnnnnnnnnnnnnnnnnnnnnnnnnnnnnnnnnnnnnnnnnnnnnnnnnnnnnnnnnnnngannnnnnnnnnnnnnnnnnnnnnnnnnnnnnnnnnnnnnnnnaattcttcttattttaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnntaaatatataggattagtataggaattcggcatcatcttctgcacctgtttatcaagcnnnnnnnnnnnnnnnnnnnatacagcctcccctgcccactgttatgttcatgcccccggactgtgaccggtcaaggtacctaacccttttttttt

SEQ ID NO: 10912 - DNA, 771 bp, Diabrotica virgifera
agtttgagcaaatttgaaactaatttaattttgatttaagtatttgtgtttaaaaatgtcagaatctcttatttgtcttcctggacaaaggctctgcctatgtgataaagtttatacatctggacaaggaacttacgaacggcagggatatgtttattcacaattagctggttatgtggatgtagtggaaaaggatggtgtgaaaattgttgaagtacatactagtggtgaacaaacagttgttccagctcaaggagatatagtaacagctcaagtatcagtcattactcaacaatatgccaagtgctttataaaatgtgtgggagatacagtgttaagaaggccctttaaagcagtacttcgtagagaagatgtgagagctaccgaaaaagataaagttgaaatttataagagttgccgaccaggggatatcattttagcaagagtgttacccataacagaagctcacaattaccagttatcaacagctgaaaatgaattgggagtagtgatagctcattctgaaaatggccatccaatggtaccaatcagttggacagaaatgcagtgctctaaatcattcgttaaagaaccaagaaaggtagcaaaggttgtaccagaaaattataatcaagaaaatacatctgcagggtgatataacgtggtttaatggtatttttacctaaagccaatgtgacaaaaagagacaagatagttatatctttgatgtagttattactgtttgtatatgtatttttgttttctgacaat

SEQ ID NO: 10913 - DNA, 426 bp, Diabrotica virgifera
gggcaagtgccacttgctcatgtgactgtgacttgtgaccataccataattagtgaggtattaagacccagaacatgtgaatttttagataataaatccgatataattgatgtatcataaggcaatgtctgataaaagcgttttttaacttcgttgttcttaaaacattacttatgtggtgtattgaatctgactgtgtaggaataaaattatacaaaagatacatagatgtataatgttatgtaatttgtgtttcttcatgcttagttgattcttattgattcattgcagaaactttcagtagaacttatttcgtaagtaattatataaccacatttttctattgtttagcactctgtagagagtttaaatataacttaatttaatttatgtctgcttataatacgtaatacattggtgttgtat

SEQ ID NO: 10914 - DNA, 437 bp, Diabrotica virgifera
gttaattagtattgagaaataaaaatgcacccttagaattcggtactctctggtgtttgggatgtttatgatctgatctggaggacagatcgaagagtcaaaaaacccgagcctactgtgagtgtaattacgacgaatcgaggaaaggaaggtacgacttggaatgaaaccagcaacggaatcaccagcgaagaatgtatcgaagtgtactacccatcaacagcaacacgaattccgtaaaggtacaggaatgttcgctctatccgggtcaaggttgtgttatgttatatgtatcatacaccgaagatgataaaggattccgaccagaaggagatcacattaaggtaccgccttttgttgcgtgtattctccaacattccgaagatggatcaaatggttctgacagcaataatgttcctgatagcgatgctgaccaa

SEQ ID NO: 10915 - DNA, 393 bp, Diabrotica virgifera
  misc_feature (3)..(116): n is a, c, g, or t
  misc_feature (121)..(183): n is a, c, g, or t
  misc_feature (298)..(317): n is a, c, g, or t
  misc_feature (358)..(385): n is a, c, g, or t
gcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatannnnnnnnnnnnnnnnnnnnnnnnnnnnnnnnnnnnnnnnnnnnnnnnnnnnnnnnnnnnnnntagaataaattaactttagggataacagccgtatttttttttggagaggtccaatcgataataagatgtcggcccccccggtgtgggttaaaggtttattaaatggggggaaagnnnnnnnnnnnnnnnnnnnngttccccctttttaaaatttttatgtttcgggagtttaaannnnnnnnnnnnnnnnnnnnnnnnnnnntttttttc

SEQ ID NO: 10916 - DNA, 856 bp, Diabrotica virgifera
  misc_feature (11)..(34): n is a, c, g, or t
cagttactgannnnnnnnnnnnnnnnnnnnnnnnctaaactcaaataagattataatcaagaaaagtaatattaaaattagtgtgttaaaacttaatagttgtttaactaacagattatacattgtaggaactgaaacattgaagttttgaaatataacccttacttttacaaatgaaaacattgaataatgcctgctgaaactattcagtattcggaaaaatattgtgacgaaatgtatgaatatcgacacgtaattcttcccccagatttggcgaaattagtgcctagaccacatttaatgacagaaacagaatggagaaatctaggagtacagcaaagtcctaattgggtccattacatgttacatgccccagagccccatgttttattatttagaaggccgttacgtttggtacatttacactagttataaaggaattagattaacatcttggctgtgtaacggacaaacagacctcgtactacaccaacgctaggctgtgttgactgtgtcataacgcacggtggcaagtgggatatatgggatttatatgcctcataacccacccaacgtatatttataaatatctctaaacacagccaaggtgttaaagtttggttataaggcaagaagtagactaattttattatcgtacctcctttgtagtcagagaacgaaatagttgtcagtgattcattttgaagtttgtggattattacagattttgaggagaaagagtaattcaaatgggggtgtaaaattatactatagatttttacgtgtataaatttttataagtatactaattatttttagtaagcaataagtaaacatttcatggcaacattcactg

SEQ ID NO: 10917 - DNA, 237 bp, Diabrotica virgifera
  misc_feature (6)..(51): n is a, c, g, or t
  misc_feature (54)..(91): n is a, c, g, or t
  misc_feature (100)..(118): n is a, c, g, or t
  misc_feature (120)..(162): n is a, c, g, or t
  misc_feature (169)..(196): n is a, c, g, or t
cgagannnnnnnnnnnnnnnnnnnnnnnnnnnnnnnnnnnnnnnnnnnnnnggnnnnnnnnnnnnnnnnnnnnnnnnnnnnnnnnnnnnnnggggggggnnnnnnnnnnnnnnnnnnncnnnnnnnnnnnnnnnnnnnnnnnnnnnnnnnnnnnnnnnnnnnatccccnnnnnnnnnnnnnnnnnnnnnnnnnnnnttacccttaagggagaaaccagcgcgaaattttttttgggg

SEQ ID NO: 10918 - DNA, 67 bp, Diabrotica virgifera
  misc_feature (3)..(52): n is a, c, g, or t
ccnnnnnnnnnnnnnnnnnnnnnnnnnnnnnnnnnnnnnnnnnnnnnnnnnnaagcttggatggaag

SEQ ID NO: 10919 - DNA, 901 bp, Diabrotica virgifera
  misc_feature (555)..(582): n is a, c, g, or t
  misc_feature (774)..(774): n is a, c, g, or t
  misc_feature (855)..(855): n is a, c, g, or t
  misc_feature (872)..(872): n is a, c, g, or t
atccaaatgcattcgtagttgaggttgttggtgcttagaatgtggatcaaacatacaaggttctgcctagttggctgtgacacaaaatttgcttgaacatttgacattgtactatttatatagttccagttgatttgataccattactaatattaatttttctaattaggaacggattaaaatggctttgtgctgggggagtataacaaaagtgagctgcttgcaataaaaatttgtcatcagggaatttctgatgaggaattcttattgctagtggcacatttttgttatattccactagcaccaaagtcttattaatcagtttctcataagaaaagtacatattggtaatggtgacagagcaactggatctatagaaatggtataatgtcggatttttaggggaatttggtgtcatagccgactaggtagaatgttgtatgtttttattaatattttgcgcaccaacaaccttgactacgagtttgtttggatatttcatccaatggtaataaattaaggatcggactagattatgatgtattttcttttccnnnnnnnnnnnnnnnnnnnnnnnnnnnncagccgcctagtggcatttcacgtggtttttcttacaattgatgtttggcttgaagaatcacgaatgacttgcaaattggagcacttaggtgtagggaatgcttgagaaatggggaagtgccatagaatgtcatttccttgcaatacttgaatgcagggtgttccatttgagaaagctcggagagtgctcgnttctgagttttgaccaccctgcgtactgaaattgaacattcccctgtgctgttaatgtttaacagtagtagactttattanaaatcgtttgaacatanaataaaaatttgttgtcaatcactgaaat

SEQ ID NO: 10920 - DNA, 185 bp, Diabrotica virgifera
  misc_feature (14)..(48): n is a, c, g, or t
  misc_feature (51)..(140): n is a, c, g, or t
  misc_feature (142)..(180): n is a, c, g, or t
gaaggggttggatnnnnnnnnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnggggg

SEQ ID NO: 10921 - DNA, 264 bp, Diabrotica virgifera
  misc_feature (203)..(252): n is a, c, g, or t
acccttagggataacagcgtaatttttatttggaaaaggtccaatcgaataataagatgtgcgacctccagggttgggataaaagtttttaaatttgggggagccagccttattttatttaaagttctggttccaccttttaataaattttttacattgaattctgagggttaacaacccgcggcgggaggggcccccgggcnnnnnnnnnnnnnnnnnnnnnnnnnnnnnnnnnnnnnnnnnnnnnnnnnncaaaaagagggc

SEQ ID NO: 10922 - DNA, 984 bp, Diabrotica virgifera
  misc_feature (874)..(874): n is a, c, g, or t
  misc_feature (954)..(954): n is a, c, g, or t
aaatgttggaaatatcttagtttatttttagttctagcttatttatggctagattgaaaatctgaattttctaatattggtccatgattatcatcagggacttgattcggttcttaaacaggtaaattttctgtctcatctgatattgatttggtagtggaattctttagtgtattatttggactttcattttcatcttaatcactattgtgattcaataattttaggtcatttttaggagctgagtacttcgttgcaactgtacttttctttctgtttggatactgcattaaggcataatctacattggcttctaaaagataatccttttcaactaaaggatcaaacttactcattcatacaaattttcttagtaatactttgtctgaatctttcatgaagaaatagaatttctgctagttgatcttcattgataagtaaacacatgttcatgatgtgtacaattggttgctgtagacagtaaacttcatatagagtgcagagcatttggtatatagaacatttttccatttagtgatgtctaaatttctggttttcaatgctagattcactgctttccatataactccattgtatcttttaacttaaccatttccttcaatatggtgttgttctacttgaagatattcctttagagtgtaggtaattaataaattcttggtaagtcaagctagtcccccctgactggacgtatcttagcatggaaatcttgaaaattcatcaatttttttttgttcagaatctgtgaggatacgtgagaaaaaagtaacgggtcttccagattgactcagcatgatagcaaatagcaattcattcatgtatctgttttcacatgagaaattatttttcattnattactgtcatagaaagtgcatattgtatatcccaaatatttatagcttttgatgtagtgacatttattttgatttaaangtaacccatattttttaacggcatttaaaa

SEQ ID NO: 10923 - DNA, 907 bp, Diabrotica virgifera
  misc_feature (16)..(35): n is a, c, g, or t
  misc_feature (757)..(775): n is a, c, g, or t
caccccccccgcgcgnnnnnnnnnnnnnnnnnnnngtaatacaatatttatactagatacgagcatggacaaattgtatttatctggcagcagctactatacgagagagaagattttattttcactcattaaaattatgtcttttgtacctataacgtatcaaggattgttcactaatatacatgtatcccttatctcctagttcaagatagctcaaaaactacggttgctcttgaacaaccaatctttctaaatgctttttgtgcactgatatgtctttcgtattgcacgcctatactacctttctcaggacctatgttaacttcattaattctgcaaatatctcttaatgcaacccatactttatctcattgctactcaaccttctttggcgatgtgcttatatttcacaattgtattacacccttcttcctacataacgactggcaccaaaaatttccagtatgccaccacactgtaccgatgcattatcctctatgattatgttgattctttatacctgtcttcttaacatacgaatctccattgtccgctccgatctcctgatgataatactattatcaaggagctgcagtcttcacccatcaagatataggcttgatcccccgcatccgcccccatttacttcaccaggttactatagacgtgtcactgtgaaattaaatattaactctcgcctgccccactgattaatttcgatggccgcgccattttgaccgtgcccaaggtaccatannnnnnnnnnnnnnnnnnnacagaccgactgaccggtttggctgaaactgaaactcgccttttacttcaattcataaaccaatttaatctttcaaagttaccacacttacatttttttccaagaccgagaacccccccgaaggaagtttta

SEQ ID NO: 10924 - DNA, 529 bp, Diabrotica virgifera
  misc_feature (312)..(337): n is a, c, g, or t
  misc_feature (339)..(355): n is a, c, g, or t
  misc_feature (371)..(401): n is a, c, g, or t
  misc_feature (434)..(457): n is a, c, g, or t
aatgttgaccgtgctaaggaagaataatcattagtgtgtcaagttactggtagagaggaatatttagttgaggaagaactcggttaaattcattaagaagcaatatgatgcttagtggatatgttctaaatgatccacatgaagtatcattgcggacgggcttgaaaatagagtcttataagtgtttaattattaaacaaacactctgattacaaattctcatgatagagaatatgatattattcattttgatatatgattattttgattttttagatttactcgatcccaatataaatttgaggttatttnnnnnnnnnnnnnnnnnnnnnnnnnncnnnnnnnnnnnnnnnnnagaataagaatatagnnnnnnnnnnnnnnnnnnnnnnnnnnnnnnncacagctgtttattaaaaagctgccctttttgnnnnnnnnnnnnnnnnnnnnnnnnacactgctcagtttgactggccgcggagtgtcgacccgtgctgaggtagcagaaccatcatcttgtttattg

SEQ ID NO: 10925 - DNA, 261 bp, Diabrotica virgifera
  misc_feature (3)..(45): n is a, c, g, or t
  misc_feature (51)..(73): n is a, c, g, or t
tgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattctt

SEQ ID NO: 10926 - DNA, 801 bp, Diabrotica virgifera
  misc_feature (86)..(123): n is a, c, g, or t
  misc_feature (142)..(171): n is a, c, g, or t
  misc_feature (188)..(207): n is a, c, g, or t
  misc_feature (212)..(241): n is a, c, g, or t
  misc_feature (272)..(308): n is a, c, g, or t
  misc_feature (311)..(385): n is a, c, g, or t
  misc_feature (387)..(408): n is a, c, g, or t
  misc_feature (443)..(525): n is a, c, g, or t
  misc_feature (554)..(576): n is a, c, g, or t
  misc_feature (718)..(735): n is a, c, g, or t
  misc_feature (737)..(765): n is a, c, g, or t
aaacaacgaaggttgagattttgacatagataggccatctacaagaatgtattacatatacagggtgcgccggacctctggtgagnnnnnnnnnnnnnnnnnnnnnnnnnnnnnnnnnnnnnngcacctggtgtatcaaggnnnnnnnnnnnnnnnnnnnnnnnnnnnnnnctaataattaaaaactnnnnnnnnnnnnnnnnnnnngtagnnnnnnnnnnnnnnnnnnnnnnnnnnnnnngatgagatgttattcgttaattaatacatcnnnnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnatgatgattaatattcatcttatatgaaaagatgnnnnnnnnnnnnnnnnnnnnnnnnnnnnnnnnnnnnnnnnnnnnnnnnnnnnnnnnnnnnnnnnnnnnnnnnnnnnnnnnnnngatgatgttagtattagaatattgaatannnnnnnnnnnnnnnnnnnnnnnagattggaattcggatacattaatatctcctgcatctgattatcatgactttgtgttttagatataaagactcggcagcccactgacaatgttgaatgtccacgcgaccttgaccgtgctaaggtatcataatcattagccnnnnnnnnnnnnnnnnnnannnnnnnnnnnnnnnnnnnnnnnnnnnnntctttatttactttttcaaagatttacattttttaa

SEQ ID NO: 10927 - DNA, 310 bp, Diabrotica virgifera
  misc_feature (8)..(29): n is a, c, g, or t
gatgaggnnnnnnnnnnnnnnnnnnnnnnctttagtttttatatcacaattaggattagaaattgtcagattttaggttagtgtacgatctatcagtccacgtactacaccgacgctaggatgagttgagtgtgacataacggacggtggcgagcgtgatatttgggatttatatgcctcttaacccacccagcgtatatttgtagaatatctctactcacgggctgggtggtaacgtttggttatatcgcaccaggttgactatttttattatcgtacctcctttgtggtcagagaacgaaatgattgt

SEQ ID NO: 10928 - DNA, 453 bp, Diabrotica virgifera
  misc_feature (85)..(97): n is a, c, g, or t
  misc_feature (99)..(114): n is a, c, g, or t
attttcttggctggtgccacgttgatgtgtgaatattgtctaattatgtttaatgtaagtatataggggtagagagagaaactgnnnnnnnnnnnnngnnnnnnnnnnnnnnnngtacttgaggatcagggactgtaaaatcagaattttataatcccgatttacaattttcttatatgtgcggctgaacaagaagacagatacaattctatgatgaaatattaatgttattaattttctgtttttagcggggaaggagatccagaaagagaagactacattaaaagtactggtgtttactataattatgattggattattagataacactaatattgaaagtctttatgtttgtcttccatcggaaagaaaatccaaatcgaatattcgactcacgaacgtgggtgacgagtttgaatcttgatacacagtatgatataacattggatttgc

SEQ ID NO: 10929 - DNA, 553 bp, Diabrotica virgifera
cttggatattgtagcttcaggcaaatatctaagttggctttcgccctgtctgttgcttcaagaatccatgcctccgtcttcacaagcagtttagcgatctgtggatacattcgaacctatggtgaaatgatctgcatcaaatatgaaataaagtattgttgtacggcccttgtagtttgatacctgtaatactaccaactcttatgtacgattaatatagtagcttattatcaggattccactcatatcgtgtgcagatgaaatgctgggataaaattgtgttgatttctatactaccaagacgaagtagcaactggaaaccgggcactccttaacaaatgagacgagtatggcactgaagagaatgatataagtaatcaaaaataggaccacaataggaggacgttggatcctcagaaacttgcatgactgactaggtaaaagctatcggatacagtgtatacgatgatgacttgtagtgagaaattgcttgagggaacagtaagcagcaatattctcgaagcgggagataaggatcatcgggaacacatct

SEQ ID NO: 10930 - DNA, 915 bp, Diabrotica virgifera
  misc_feature (13)..(15): n is a, c, g, or t
  misc_feature (80)..(97): n is a, c, g, or t
  misc_feature (785)..(907): n is a, c, g, or t
ccaccttacgcgnnnccggaatgtataatacatttattatttagtagtgttgtaatagtgtaagtggagaggaacgttcnnnnnnnnnnnnnnnnnncgaacaaaattgctaacgtcctcatcttgacttgcaaatgctcaaaattaaaatgatattgatacccctcatgcattaattatattgtactgtagtaatcttcccactataattggtggatatgaaagttgacttgcaccctcattgcctgaagctcccgatataactgccctctattaaataaaacataattgtgattgcttccccccacgctgacatcattattactacacttactactgccatagctaggggactacggatgaacggtctagccgccacggtccctatgatgagacgtagaaagccctcaagagattatacctatgtataaataacattgaacttcactttcttcactgtacgaagcagataatttaagcacatacagattgaccataacatgaatattgaataacctatatgataacagccgtatctcatatggatggcgctataacagctgtacctcctccagaagcactaccgccactaactaggagaatcactacattattgtttacagatctgaattaacaacatcattgtgtgatgcaactgaggtgacttatccgattctctatactgtatatagtgatactgtaaatcacatagctacttgatgatattggtactgatgacaccaatacgccattcatatttgtatctgcattagaggatatgaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagttc

SEQ ID NO: 10931 - DNA, 847 bp, Diabrotica virgifera
  misc_feature (19)..(37): n is a, c, g, or t
  misc_feature (111)..(133): n is a, c, g, or t
gtttcttatgatcctgagnnnnnnnnnnnnnnnnnnntcccgtcgcctttatacaccgatcatttttatttttcatctttcacatttttatatttctttgcgtctgattcnnnnnnnnnnnnnnnnnnnnnnnatatttctaataatattccgaactgtaagatgctttgatgctgacgcgtgcgtttcataagcgacgagtatgtagaatagaaagaaattgactgtattagaacaacccgagctgcaaaaacaaggaggatgcatgcaccagctagacggggacaacgaggactgctgaacttggagcacgtccccatgtctacaccaagatcatgaacatatgagttctctcatcaagaggggctagggaatccttcttcctcttaatgaaaactcccgacgacaaagcgaagtcaatgagcgctaaaacataataccgactaaggagtcactattactcgcagcaacagaccgaataaccctgcaagaaaatgatagctaggtaagacctcagttacatcaaaagagatttcgtagctgcctcaacagcatgtgtatcattatcagaagtatccatgttgtcagagagaagaagatggttatatttgcgaggaactatgatgactatgatggctacgttgatgtgtctttcccttcctcatatctcctatggaggcatgtgaatctatcagacgcaggtgtatttggtgattgctggatatgcgtggatttgtgctctatgatacccaatgatcatccagatgagtaaattgcgaggcagagatttcgtagccattcattggattcgttggttgatttcattgttaagcttcagaaaacggct

SEQ ID NO: 10932 - DNA, 239 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (170)..(193): n is a, c, g, or t
  misc_feature (200)..(230): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttacaattttacatgatctgagtttaaaccggtgtgagccaggttggtttctatcttnnnnnnnnnnnnnnnnnnnnnnnntaaaggnnnnnnnnnnnnnnnnnnnnnnnnnnnnnnncataatatt

SEQ ID NO: 10933 - DNA, 145 bp, Diabrotica virgifera
ggttgaataacggaattcgcgcacatctttttttccctgactattaagaacattgtttttttgatttaatttgaaagtgtactttttacccctctacttataccgcctcggcgcttcctcgcatacgccagacctcttccacaac

SEQ ID NO: 10934 - DNA, 839 bp, Diabrotica virgifera
  misc_feature (303)..(324): n is a, c, g, or t
  misc_feature (599)..(622): n is a, c, g, or t
  misc_feature (772)..(772): n is a, c, g, or t
  misc_feature (801)..(801): n is a, c, g, or t
gaaaaaataaagttccggaccgacctttgataactgcagctgatctggaaggaaagagtgcagaggagcaagaaatgatgaaattaatgggattttgtaatttcgatacaacaaaaggtaaaaaagttaatggaaatgacgtgggtgatgtacacgtgatcctcaaacgaaaatataggcaatacatgaataggaaaggcggatttaatcgacctctggactttgtagcataatttgtgattcaacaggcattactttgaacaaccaatacctcaactcagtaacctcattcatcagaatgcnnnnnnnnnnnnnnnnnnnnnnacctatacctccatagtttcaggttatttatattgaaccaagggacatttgcttcattttttagttggtaaatatcattattaacatgttaagtgccaagggggttcctagggtccaccatagaaagtaccccataccctatggaggaccctagagaccgctgcgtatttagttcaaattatttgtcacccaaaccgaagtctgtttgagcatcgtaaacggatatctatggcttgttccttatactcaaaattgagtattgcacattcacaagnnnnnnnnnnnnnnnnnnnnnnnngagatgtattaataattacattaacgatttaatttttttagtgattttgctaattttctgagaatactaacatttttcagattaatttaaaatgttcttttgcattctcctcctctttggttaatctattaccttagggaagtaaacaanacatctctgttatagatcctgatcagacnagacttttttatgtattataaacctctatacgttgttt

SEQ ID NO: 10935 - DNA, 885 bp, Diabrotica virgifera
  misc_feature (104)..(138): n is a, c, g, or t
  misc_feature (172)..(191): n is a, c, g, or t
  misc_feature (232)..(257): n is a, c, g, or t
  misc_feature (302)..(320): n is a, c, g, or t
  misc_feature (337)..(391): n is a, c, g, or t
  misc_feature (393)..(433): n is a, c, g, or t
  misc_feature (435)..(450): n is a, c, g, or t
  misc_feature (458)..(539): n is a, c, g, or t
  misc_feature (541)..(644): n is a, c, g, or t
  misc_feature (646)..(718): n is a, c, g, or t
  misc_feature (720)..(752): n is a, c, g, or t
  misc_feature (787)..(820): n is a, c, g, or t
  misc_feature (829)..(847): n is a, c, g, or t
  misc_feature (865)..(883): n is a, c, g, or t
cttgtcgaagttggaccatgttgggtgctgcttatagagcatcttccagcctattggctgaaaaatcctattcaaggatagtagcttcagtattgtagtcagannnnnnnnnnnnnnnnnnnnnnnnnnnnnnnnnnngaaccacgtgcaccggggattattcattaatacnnnnnnnnnnnnnnnnnnnncctttaactgagataaaaaactaagactcttatcgcaaaannnnnnnnnnnnnnnnnnnnnnnnnnctgccacgttcttcgtttttatgaacatctagttttttaagaacnnnnnnnnnnnnnnnnnnnagctccatattgataannnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnncnnnnnnnnnnnnnnnngaatatgnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnttggaaagaagggctggatgaaaacaaaactgtcnnnnnnnnnnnnnnnnnnnnnnnnnnnnnnnnnnctaataagnnnnnnnnnnnnnnnnnnnccagagaccctataaagnnnnnnnnnnnnnnnnnnngg

SEQ ID NO: 10936 - DNA, 639 bp, Diabrotica virgifera
aagagcaaggtggtcgtgttcactaatcaatagttaaatttcaagttttgtattcacgaaaagcaattggtaacctcttggaataggataataagtgtgagaggacaactatgagtaatccgaagacatccttcaaacagtcaacccaggaccattgaatgatcaaccccaggtgacagacataaaagaaatggctaggtattcctttatgaataaacaggtgatagaacggaatggaccaatgagaaaaacaagatcaagggggtgacgcaaggagattgataggggatgagagtagtgtatgatctcttctccaattaaatgagctaccacagaaggtgacacagttatcgcaattataaatagctggagagaaaactacatccgaatgagtaaagatgcccctaggcgatacaggattaatctccaccaaaccacaggatgaacttatcatcgagggacctctcgttggaggagcgtattaaagacagctgccctgatacaatgatctaaaccagttaaaactaaagatatccgtaagcttccacatggcatttatgtatctgccaaaatcatccggtgtacacgaggaataactaggattattgttttcagtttaagttaatactttaaaataaa

SEQ ID NO: 10937 - DNA, 903 bp, Diabrotica virgifera
  misc_feature (354)..(376): n is a, c, g, or t
  misc_feature (604)..(625): n is a, c, g, or t
  misc_feature (629)..(649): n is a, c, g, or t
  misc_feature (709)..(738): n is a, c, g, or t
  misc_feature (795)..(795): n is a, c, g, or t
cttcaatataatattagatgagaaaaaaaccagtgataaatcagatatattccaaacttttatgggatacagaaatctacaaccatgaaaatggagtgtgtctgatacgctgactataaatttcatactgatggcaaatactatcttgtgctaatcttctctatcttgtgctaatcgtataaatttgttagccttcctgatttcgagccgttggcgtaagttacgcagtcaagagaacttctttcgtccgatgcctcgttttccttccatcttttctttaacgatcaactgcagaaaaccatacttatcgcttctaaagatatggtcaaactaagtatcttttctgtaaataannnnnnnnnnnnnnnnnnnnnnncatatttagttatcagaaaaaaccaacctgccggactatagcttaaagcagaactaccaaaacctacaaatctgacctattccactaaggcactaaatcttttacttaacctatacatgagtatagtaaaaaacaacaattgctgcaattgtaacttacgcccttgaaaatagacgattcgtgcgtttgacaagtcaaacacagtttatacaaacattatacaacagnnnnnnnnnnnnnnnnnnnnnncccnnnnnnnnnnnnnnnnnnnnngctccaatatttaaaccacaaaaaggaacgcagtcatttattgagtcgttaatttgtcannnnnnnnnnnnnnnnnnnnnnnnnnnnnncaataattcaagaaggttgtagttggagttgaaaaaacctataaaaatccgtactanatattttatgtttaaataatattagttaacaagattttgatgttaataagagcataaatacagggtgtgataaaaaggtgagtcataatttaaatcacatattctggg

SEQ ID NO: 10938 - DNA, 973 bp, Diabrotica virgifera
cgttagcataagatcaaccaaacccgattctagtctgttagaaataaaggagcagctatactacgagaaggaaaaatataaaatagtactgaaagagcatttaagaaaaaatgaagagtaccaattagatttaaattttcatgggaagttgagtggacatttgcaaggattttataggataaaatattacgacgagtaccacaggcaaaggttaattgcctctacacagttttctccagttgatgcaagaagtgcttttccatgcttcgatgaaccatcgttcaaggccaatttccaaataactataggacgaccagctgacatgttatcactgtcaaatatgccgttggcccagaaaactccattttcaacgaacaactcagaactatggagttgggacgaatatcccgaaacccccaagatgtcaacgtatctagtcgctttcatggtaatggacttcattaaaggtgctggagacgatccccgaatgatgttttgggcacgaccacaaatcgctggaaactctgcttatgctgcccagataggacctaaaatcctcagtttctatgaaaactattttggcattaagtttccgctatctaaaattgatattgtagctgttcctgagtttggtttcagtgctatggaaaattggggccttataacattcagggaggatgttctcttatacgatcaacaatcatcaactaatgaggacaagagaactacagcaacaattttagcccacgaactagcacatcaatggttcggtaatctcgtgactccagtattttggaacgatctctggttgaaagaaggtttttctaatttcttggtatactcaggagtaaactatgctgaaccaaaatggatgtttgctgaagaattcatgctatctgaaaatctcgacgctatgagtggagacgcttttgcaacttctagaccattttcttcgatatatccaaaacacagt

SEQ ID NO: 10939 - DNA, 909 bp, Diabrotica virgifera
  misc_feature (265)..(285): n is a, c, g, or t
  misc_feature (492)..(511): n is a, c, g, or t
  misc_feature (783)..(783): n is a, c, g, or t
caaaaatttatgcactatagtggatagtgtttggctaatatcaagtatcaagtatagaaaagagtgtgtattcaagatgcctgttgttatcagcaaagaactgttctatgagaagataagcaaagaactggactgtcgtgtcatacattattggacagataattgtgtacaaggagctttacctgcgttgcctcaagtggctattggagttgccaaatttttcttgcctatatatttgttaagaatggcaatcgactacagacgnnnnnnnnnnnnnnnnnnnnngacatttgtgataagggaattacgatcaatcctgtatggtgcaagtttgggtcttattataatttcttcaatttgtctattaggaaaaatatgtggaagaattcactattataacttattactcataccaggatttttgtcgggtcttggaattctcgtggaatctgatgaaaaccaaactctggatactctaattttcttcaattnnnnnnnnnnnnnnnnnnnnaatgctctgaaagttaatacgactaaacaggcaattcttttcgtcatatttagtggaattttaatgcaactttttgaaaatagaaaggaagaacttaatttcaactattggtggttttatactcctcctttaaagaaaatatcaaatgataaccaccaaaataaatgttctcatgagaatagttgcagattttttattacaaatggagtcaaaaattattttatgttaggtgctggaataaatatcaccaaacgcctattaggatcatttanactgctaataaaatctcccgccaaactggtcaatgtagtctttcataaatcaaatgtgtattttggtctcctgattgctgcttacgtgggaatttatagggctattacatgttacttgagacaaac

SEQ ID NO: 10940 - DNA, 629 bp, Diabrotica virgifera
tgggatctcgatgtggtatgacaggcattaaattaagaataagtatgaccagggtaagaacgatgtgcgagaaattaatccttacaagaccatatgaagaacgtaaatgcaacaactactgggtgaagaaccctgaaatagatggatacaacaagtatattagatattgatttgtttattagttgggacaatacgcacatggaagaacccgagttacaaaggcctcggtaacctcgcatctagatttagtgggatagccacgattatgtaaacttgagtactagccaatgtgtacaactaggtcgttaggatctgaacgctcacaaacagaggagccgatgagaactctgttcgaatcaatgaatactatctgagtcaactgatgtcaaacatcttcctgttcactacaatctaacgaagacgatgattctacccaacatactacattacctcgaactggatggcgcgatagatatgcacttgctacatccagagatctctattagctgacacaacaacatgtgatgtaccatgaaaagtaccgattgtgccagcgtgataggcaggctgtatgttcccaagaataattcacgaaataaaatgaaaagtagaagtcagtgtaccctcct

SEQ ID NO: 10941 - DNA, 568 bp, Diabrotica virgifera
cggacgcgtgggcgacctacgatatccattgtttttgatcaatgtggataatacaacacatacagctgatacacatgatagatgctgaggtaatatatagatagaaagagctagagaacttgcatatatatataaaacagaaatagatttaacatcctgaagaaatgaccaaaagaaacgataataattcttcttgagcttttggacgcgcttatttccacaaatgaaagacagcaatactctttttagacaagtgaatttcaccacattttttggagagatcttcgatgatgccttagtagtcggcgcacaaaacaaattccatttgcttatgactctgcataagatgcttaacacacatataaatggtagaaacataccccgcttccgtcatgtgaagataactcaccttttataacttttcaatcagcctcacttaaaggaacgatttaacgatatggatcatttaggagatagccagcatcatcttgataatcagaaagatcgtcggaggatgtaccgactactgacgctgtccataagctattttccccccgagaaggtctcc

SEQ ID NO: 10942 - DNA, 886 bp, Diabrotica virgifera
gatcgacattggagaactttgtggccacgaggtttttaataatctttaaaatttgtatattttgtttcaccgggtttaaaacgttcacagttaaagtgaaaaatcagaaatgccctctagtaagccgctaccaccgaaagaaaatgccttatttaaaagaatcttgaagtgttacgagcagaaacagtacaaaaatggtttgaaatttgcgaagcaaatcctctcaaatcccaaatacacagaacatggagagacccttgcgatgaaaggcttgaccctcaactgcctaggcagaaaggaggaagcttacgaatatgtcagaagaggtttaagaaacgatctcaaatctcacgtgtgttggcatgtttatggcctgctgcagaggtctgacaaaaagtatgatgaggccatcaagtgctatcgaaatgccctcaagtgggaaaaagataatattcaaattcttagggatctgtctttgctgcaaatacagatgcgggatttggaaggttatagagataccagatatcaattacttatgcttcgaccaacacaaagagcttcctggatcggttatgcaatgtctttccatttattagaagaatacaaaaatgcacttaatattttagacacatttttggaacaacagaaagcaaacagttttgactatgaacacagtgaacttctcttataccagaacctcgtcatccaagaatccggtgatttgaaagaagccctcaaacacctcgaagcctcacaaaaccaaatagtcgacaaattaaccttaaaggaaaagctaggcgaactgtgtcttttattaaaacaatttgataaagcgacaacctgttacgaagaactcatccaagaaatcccgaaaaacaaattatta

SEQ ID NO: 10943 - DNA, 181 bp, Diabrotica virgifera
agttgaaacgtacatgcgctacgttgtgaggactcggaaacgaaagttaaaactaggagtagcaactccgatgttcgaagagaggcaatgatgattgactaatagagaataatacctgagacagtctctacgttattcatggtgatatggatgctacatccagatcaggtaaagatgatga

SEQ ID NO: 10944 - DNA, 964 bp, Diabrotica virgifera
  misc_feature (208)..(225): n is a, c, g, or t
  misc_feature (269)..(286): n is a, c, g, or t
  misc_feature (292)..(310): n is a, c, g, or t
  misc_feature (354)..(370): n is a, c, g, or t
  misc_feature (373)..(388): n is a, c, g, or t
  misc_feature (390)..(402): n is a, c, g, or t
  misc_feature (522)..(538): n is a, c, g, or t
  misc_feature (541)..(558): n is a, c, g, or t
cattacgcgtccggtgcacactgggagaaaaatctcacaagtgtgaattttgttttaaacaatttagtctcgcatgtgctctaaaagaacatttaagaagacatactggagaaaaaccttacaagtgtaaaatttgttttaaacagttaatttcagcaagtgtgttgaaaaagcatttgagagttcacactggagaaaaaccttatcnnnnnnnnnnnnnnnnnntgcgatttaatcaagcaggtactttaaaaactcatttgagaatnnnnnnnnnnnnnnnnnnttatcnnnnnnnnnnnnnnnnnnntcggtttgcccaaaaagttcaattaacttctcacatcagagttnnnnnnnnnnnnnnnnntcnnnnnnnnnnnnnnnncnnnnnnnnnnnnngcgcagcaagtaatttaaaaaaacatttaaaagtgcatactggagaaaaacctcacaagtgcgaaatttgttttaagcaatttagtgaagtaggttgtttaaaaaaacatttgagagttnnnnnnnnnnnnnnnnntcnnnnnnnnnnnnnnnnnngtaagcaatttagagaagcaagtaatttgaaaaaacatttaaaaacacatactagagaaaaacgttagaagtgtgtgatttgttttgcagttttctgtgaaaagtaaattgaagctattactgcatgaagatgtcaagtcatttttttaacaattttgagatatcaagggttaacactttcttgctcgaactactttagacaaaacttgacttgacgtgtttttaacattggattttagggtctccagcgacatctatgcaccaaagtctttgcgcacaatgcaagaaaatgagttaacactttcatgcataccattatggcatttttgaaaaaatggagattgaggttgcatacgccaaagacgtaatttttcccgttttttttgcttatccaaaaaaattaaaa

SEQ ID NO: 10945 - DNA, 261 bp, Diabrotica virgifera
  misc_feature (10)..(175): n is a, c, g, or t
  misc_feature (177)..(259): n is a, c, g, or t
tgaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 10946 - DNA, 1165 bp, Diabrotica virgifera
  misc_feature (507)..(529): n is a, c, g, or t
  misc_feature (735)..(757): n is a, c, g, or t
  misc_feature (787)..(808): n is a, c, g, or t
  misc_feature (1086)..(1103): n is a, c, g, or t
  misc_feature (1129)..(1153): n is a, c, g, or t
ctgctacagagtctagctctcaagtctccatgaaacaatcctatagaatgcaggtattcgttgactggcgcatgtccagtaaggaagcctgtcatgactctgagctgattcatctttgtttttcgcactacttcagccctattaacacatatccgtccaatatatattttgctatgtgtttttccgggtatattttcccagtaagggttacgctcgatgcacatttgcgccttttcaagctgcgtgcgatagctggcggttcagcagtacgtgagttgaatttatttactgcacactcgagctgaaccgtggcgtgcaagccgcgtggaccgagagcacgcccgtttctgctacgccgccacgtgcacgcggcttgaaaacaagtcatgcggtttagcagtctgtactgggcaatcagtgagtacacgttaaccgcgcgatggatttcaacgtagatacagagctgtttatttctggcgtgtattgccccccgagaaaccgctcaannnnnnnnnnnnnnnnnnnnnnncttgaaaaaaagcagcttgcaaagccgcacatgtgcatcgagccttatattttatctagctttttccggccgcgaacaatactttttgccactcccacctaatctgcacctaaggattttatagctgatgttctatctggactgttagacgtatatactatctttgttgggacacatagaaacaaaggaaagatataatggaaagnnnnnnnnnnnnnnnnnnnnnnnctatttcggaaaaaaaatgtataggtacgnnnnnnnnnnnnnnnnnnnnnngggtagtgtaagtattttgaactgtaatattttgttatttacactgaattgttgtcttaccaataatcaaattgttttgtttattggcttaccagtgaaaggttttatacaaaatattgtttgaccccccgttttttttattctgaacttttgtttaaaagaattggaatggtttccacaaaagtaattatgacaattttatttggaaatttttaagatttttcaatttttctttggttttgggctgcggatttttagggaaaaatttaggagattcnnnnnnnnnnnnnnnnnngggataaggcgcttataaaaggggcnnnnnnnnnnnnnnnnnnnnnnnnncaaattttttcc

SEQ ID NO: 10947 - DNA, 867 bp, Diabrotica virgifera
  misc_feature (692)..(709): n is a, c, g, or t
  misc_feature (738)..(738): n is a, c, g, or t
  misc_feature (747)..(747): n is a, c, g, or t
tgttaaatagattattgtattttgtattattataattttcagattaaattgtatataatttgacaatttattaacttaaaattttattaatacattgcatcaaaatgaatcgttcttggaacagaaattcgagttcatcctcaggttttgtgtatttcgctaaagaatctcaaaaagaatgtggagattccgagaactttttgtcatttcaggagagccctcaaaaaagttataaccatatttcaccgaattatggaacgccaatgtcccatagcagccctagaaatttcaataagagaaataattacagatattctgggagaaatagaggaaacagatcatatgttagtcctaatgtaaattttaaatcttggaataactacaactcacccaaaccacatcatcagaagaaaatatcatttaataaaattccaatgatgagcgcagatggccagagagacatgtcgatgttttatgatcatacatgtacttggaatccatgggcagatttagaaaaacatttcaaagaagaggaaccagttaaagaggagaagatgattgaaagcccatcagtaccaatagttagtgaaccggaaagcaaaacaataatagatactaaaaaagaaaatgagtctagttctagtgatgacagtagtgattcagatgaagatactagtagtagtgatagtgannnnnnnnnnnnnnnnnncacgtcatagtagttagtataattattanatacattangaaaatctaatatatgtaacacagtatatctacaaagtttatcacaaaaatttatgattatctaaattatatttctagctaattatgaaagcttattatcaaataaggttccccaaaggg

SEQ ID NO: 10948 - DNA, 243 bp, Diabrotica virgifera
  misc_feature (188)..(234): n is a, c, g, or t
taccttaaggataacagcgtaattttatttgaagagttcaaatcaataataaagattgcgaacctccatggtggaattaaaggttaataatgggggtagcaagttatattattaaggtctgtttcgacttttaaaatttttacttggttctgaggtttaaaccgggggggggaggccggggtgggtgnnnnnnnnnnnnnnnnnnnnnnnnnnnnnnnnnnnnnnnnnnnnnnngggcacccc

SEQ ID NO: 10949 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 10950 - DNA, 876 bp, Diabrotica virgifera
attcttggataatacttagtaccactttgtcgtgtatagtttacgtattactagtttgcaatggtatctagttcaatggctttattgtggaaatctttgttattatttataattacatgttttttggtagtggttaaatcccaagattcggctgtagatgatgatggttgtcgaactcctactggtggtgctggtcactgtatacctctaaggcaatgtaaaccgatgatcaacgttttacgaactgcaaaaagaccattatcgccaagcattagtaagcaattaaatgcatattactgtaactttacaaagagcgtatgctgcccgcaagagcctatcatactccaagatgattcggtaacagaagtgcctcaacgccctcaactcccaccagatgtatcgaatcatagaaacttaaatttactaccgtctgattgtggttatctagatctaaatgataggattagaaacggacaggatgctgatttaaatgaattcccttggatggctttactcagctacagaacaaggaggggaccagattttaagtgtggtggcactattattaatagtagatatatactcacagctgctcactgtatttcaaatttggatacaccaatgttgggtgtacgagtgggagaatataatactaggactagacgtgactgtgttatgggaaaagatggaactgaaaaatgtattaataatcctgttccagatttggcgatagaaaaaattattcctcatccccaatttgatgctagctcaatctcaaacgatattggacttttaagggtggcaaaaataaatttaaatgttgaaaacgcgagaccagtatgtttgccgcttggtgaatatcgaactaaaaacgtc

SEQ ID NO: 10951 - DNA, 245 bp, Diabrotica virgifera
  misc_feature (118)..(137): n is a, c, g, or t
  misc_feature (154)..(228): n is a, c, g, or t
tacagcgtaatttttattggaaaagtcaatcgaaaataaagatggggaccctcgagggttgggataaaaggtttttaaattgggggaccagcttattttttttaaagtccggttcccnnnnnnnnnnnnnnnnnnnngaactgggaggttaaannnnnnnnnnnnnnnnnnnnnnnnnnnnnnnnnnnnnnnnnnnnnnnnnnnnnnnnnnnnnnnnnnnnnnnnnnncccaaaagggcgccccc

SEQ ID NO: 10952 - DNA, 911 bp, Diabrotica virgifera
  misc_feature (352)..(398): n is a, c, g, or t
  misc_feature (667)..(697): n is a, c, g, or t
  misc_feature (781)..(781): n is a, c, g, or t
  misc_feature (910)..(910): n is a, c, g, or t
tgatgatcactacgttctctattaagcataccaaacccattaacaatcttttcgaagcgtctgttgttaatttatttttcacggacctacagaaaaaagttcaaatatcctgtaaccgatcagatataagactaaatttctccagaacacagtttctgtttaaaataatatcggcaacgttagaaactatcacagttaacgaatcaggtaaaatatacttcaccgatcacgtaaactggatggccaagtgtataaatttggggaaactctggaacctggacgttgacgagttgcgcaggtaccagatcgtccaactttattccaatggttatgacagcatagctcaagaacnnnnnnnnnnnnnnnnnnnnnnnnnnnnnnnnnnnnnnnnnnnnnnnaacgttgctgctaaaaggctctctcagttcttggtgtcttcaccacaacttagtgaaaacatcggtgctcttagtactgttctcactaactacatggaaactttgactgaagaatggtgcgccccaagtgcgctgaaggacataacgctactggcaacccatacaatacattgtttgactgaagaagacagtgaatacaagttggcatcactgttactggaatcgtgtaaaacattggaagatttgcaatcatagacgaccttgttagnnnnnnnnnnnnnnnnnnnnnnnnnnnnnnngcatttacaaagtatctgtaactaaaaatatacaaggggaatattgtttataattttaatgaaatattgattcatttttattanatgataatgattcacttttattaatttcggctataagctttatttatactatatcagatgcaaatccataaatggatataagtgatcacattttccataacgctatgtttcttgcaatttatttatatng

SEQ ID NO: 10953 - DNA, 125 bp, Diabrotica virgifera
  misc_feature (5)..(22): n is a, c, g, or t
  misc_feature (33)..(64): n is a, c, g, or t
  misc_feature (70)..(124): n is a, c, g, or t
cagannnnnnnnnnnnnnnnnnggttttttagnnnnnnnnnnnnnnnnnnnnnnnnnnnnnnnngggggnnnnnnnnnnnnnnnnnnnnnnnnnnnnnnnnnnnnnnnnnnnnnnnnnnnnnnng

SEQ ID NO: 10954 - DNA, 700 bp, Diabrotica virgifera
  misc_feature (181)..(211): n is a, c, g, or t
  misc_feature (261)..(275): n is a, c, g, or t
  misc_feature (277)..(294): n is a, c, g, or t
  misc_feature (308)..(350): n is a, c, g, or t
  misc_feature (431)..(479): n is a, c, g, or t
ggattattagttttattttatcactgaatcatttgttgatagtattataagatatttaattcctagcgtgaaacactctcctatgtacaaataaactgattgattttttgcaccttgagcttcagggaccattagcaactagttatataatgtaagaaattctatattaataaatctctannnnnnnnnnnnnnnnnnnnnnnnnnnnnnnttgataaatttttagtaaagatatgttattcgtaatgaaatagtaactannnnnnnnnnnnnnncnnnnnnnnnnnnnnnnnnctaaatcttaatcnnnnnnnnnnnnnnnnnnnnnnnnnnnnnnnnnnnnnnnnnnngtactctattataagggttgatcttataaaaatcatttaataaaaatatcattatataatatctcatattacgataaacgnnnnnnnnnnnnnnnnnnnnnnnnnnnnnnnnnnnnnnnnnnnnnnnnncttcatattttatccaatatttattaaaatagaaactgcgattatttcaaatataccaatgccgataattattaacattaataaatcgtatatctggaaaaaatatacaggtttaacaccggaattcagcaacattttttttctcctgtctattaaagacctggctttcccgtgttaaatatacagtcctcgccccgaccactgattaattatgaatggcc

SEQ ID NO: 10955 - DNA, 371 bp, Diabrotica virgifera
  misc_feature (259)..(273): n is a, c, g, or t
tgcacacgtaatttaagtatttatttaagaattgtctgcaaataattaattataagatggctaaagccccagcgtgtatgtattgacgtaggaaacccatagatcctgacaaataaaggggacctatggaacgtggacactttcaaatcatgactgagacaaataagaacatgagtggctagtgcccatagatctaactacaagacctctcgagtcatacaaaagactaaaaaaataagcgggcaagaaaatcatgtannnnnnnnnnnnnnnactaccgttgaactcagatcaaatctgggttcttaataatgataaaatatgactcagcggtattatacatacgggccccgataccttatgtatctcag

SEQ ID NO: 10956 - DNA, 419 bp, Diabrotica virgifera
ttgagcagctgtactagtatgctccttatggaatgttacgttgttataaaaaagactcagaaccttattgagcagcaggagaactatttcgatctgcgttagcctatggtgatgtacatacaagacttgatcctttcaattacacacttcaattaaatactattacacatcagggtggtgttacgtgatatgaattctacgattctggaagattatataaagcaagagtcttatggttaatgttcatggaagagattgctatgatagtcttaagagctatgggaattacaggaccaagacttatctacaatcattggatatgctgaatagctaatggactattggatatcattgtttttagagtgctgagagataatatacactaacaataccataatcataattatggtaacatataa

SEQ ID NO: 10957 - DNA, 912 bp, Diabrotica virgifera
  misc_feature (429)..(470): n is a, c, g, or t
  misc_feature (781)..(781): n is a, c, g, or t
  misc_feature (824)..(824): n is a, c, g, or t
  misc_feature (884)..(884): n is a, c, g, or t
ctaacttcagtagtatacattagtccaccgcagttttcagtttatatcgcggtagttagttacaagtgatattgatttttgtgattgttgtgagcaagatatttcaattgtttcaagagtgcacatgaaaaatggagcaaacgcccatccaaaaattctacaaaaataccaatgtttttattacaggcggtactggtttcatgggaaagatccttatagaaagattacttagatctacgcagatcgaaactctctaccttcttgtcagaaataagaaggggaagaatattcatgtccgaattgatgaactatttgatgatgtaatatttgataaactaaagaaggagtgcccaaaatttagacacaaagtagaagccatatctggagactgcacacaatcaggtttaggattaaacattacagacagannnnnnnnnnnnnnnnnnnnnnnnnnnnnnnnnnnnnnnnnngccactgttaaattcgacgaaaacctaaaacttgcctataatattaatgtcaatggaaccaaatctgttctggacctggctagacaaatgaacaatttaatgtcaatggttcatgtgtctaccgcttactcacattgtcccagatcggagatcgaagaaaaaatatacgactgtccagtgtcttacgaatatgtacaagctgtattagaaaaaatcggcaatgacgaagcacatttactaacaccaaggattattggtgaatggcccaacacgtacacatttacaaaagccctagccgaaaacatggttanagatcttggaacgaacttaccattagctatatttagaccgtcnatagttttgtccacatacaaggaacctatagaaggctggatagataatatgtatggtccnactggatgcgcctgcaggagttacacag

SEQ ID NO: 10958 - DNA, 657 bp, Diabrotica virgifera
  misc_feature (2)..(50): n is a, c, g, or t
  misc_feature (52)..(656): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 10959 - DNA, 381 bp, Diabrotica virgifera
  misc_feature (39)..(57): n is a, c, g, or t
ctacactgttctttggcttgtagatagcggacgtgatannnnnnnnnnnnnnnnnnncctgtgctacactgattgaccctgccaccataggcgcacacattgcaaacaccataaaatacttgaggcaactgaggatggttgtaacttatttaaatcatgaacgggacaaataagaccaataggagcttctgtccatgatcctcaactctaaagaaaattatcgaaatgcaaaagactaaaacactattcttgcatgaaaatcaattaccacactctgactatactatcataaaactccattcaaatctaagatattattaatcttaaactttgatctcattctattacccatacgatcctcaatacctcaaatatcttata

SEQ ID NO: 10960 - DNA, 921 bp, Diabrotica virgifera
  misc_feature (655)..(655): n is a, c, g, or t
  misc_feature (875)..(875): n is a, c, g, or t
aactgttactcagttttctgttgctgatatgttagaaaaacttaaaacgaataagaagtatttttggaacaattctactgcagtagcatcaaaaccagctagtcagtcacattcattgcttattacatgctctgaggaagaggccaagacaaaggagtttaaagatgttttaatggatagatgtttaggattgcaccacaatcgcagcagattctccgaaaagttcgaggacctctgcggaagatacggttcaagatacgtcggtgctgaaacgcaatcatcatgtacagttttcgaaacacacgtaaccagtccgatgaaacgacggaatatcaaaccgcaatggaacaccaaatctccaggaaaacgactgagccacttggccaggaggaaaatcaccttttccagcgccaaccttcagtcaggaaattcctctttggccggatctagggcccggcaaattttggttgatgctaaaaaaaatggatttactgagccgaaggaaaagtccaaggaaatcgccgagaaaaacccctagaaagacacccggaaaaagtcccaggatcaaaactcgtacgccgagcagttcagctaaaaagaagctcgccatgcggttcaggaaagttacaggagaaattgaaaaatcgagtactanaacttcttcagacgggtctttatgtgcaaaacgaacgctctttcatagtccagatgaagataagaagttgttgaccaggctgttacctagtacatccggatcatctttagcccacgaaatcaaaagatccaccacaaaacgggcacttttcatgtcccctagtaaaagttctcccttgaaaatatgggattcaaacgttcgccgattaacgacttgattntggccacgaaaagaaagagaaacgcgacgattccatcgacggggag

SEQ ID NO: 10961 - DNA, 61 bp, Diabrotica virgifera
  misc_feature (5)..(60): n is a, c, g, or t
aagcnnnnnnnnnnnnnnnnnnnnnnnnnnnnnnnnnnnnnnnnnnnnnnnnnnnnnnnng

SEQ ID NO: 10962 - DNA, 70 bp, Diabrotica virgifera
  misc_feature (4)..(61): n is a, c, g, or t
gggnnnnnnnnnnnnnnnnnnnnnnnnnnnnnnnnnnnnnnnnnnnnnnnnnnnnnnnnnnaattttttt

SEQ ID NO: 10963 - DNA, 857 bp, Diabrotica virgifera
  misc_feature (751)..(783): n is a, c, g, or t
  misc_feature (797)..(815): n is a, c, g, or t
aggcaaccatcataataagcatagccttgggaggaggaatatcttttgtaaatgtattgttcaatattttatacaaaaagctggaggaaatgtaagcccggaaactgcatccattatttttagtggtctttgtatagtttttaacattttcgtaatcagtttcatagttgacaggtttagtaggaaagtcttgtattcatcctcattagtcctttgcagcatggccatattggcattggctgcttatctatacttcgatgaatttgtccctaacacggatctggactctgtggcttggttgccattaacttgtctcattacattccagataggatggtcctatggcttggcagtcattccaactctaatgatgggagaactgttctcagttagtataaagtcaaaggctatgcttattatgatggttgccttgggaggaggaatatcttttgtaaatgtattgttcaatattttgaatagtgttttgagaacttttgctccatttgtcttctttgcgttatgtatcattggagcagccatcgtgtccttgtatattattcctgatactaaaggtaagactttggaggaaatacaaatgaatttaaaagcatcgtctaatgataaaaagaatagcaatataatacctgctattgaagcttattacagtgaaatatatatatacatataaatcctttacctgtattcttactttatatatgcatataatatgtaattcaagttatgtcccatnnnnnnnnnnnnnnnnnnnnnnnnnnnnnnnnngtagttattttagnnnnnnnnnnnnnnnnnnncaactgattttttccagtttgattttataaacgaaaatcttt

SEQ ID NO: 10964 - DNA, 603 bp, Diabrotica virgifera
  misc_feature (377)..(401): n is a, c, g, or t
  misc_feature (452)..(487): n is a, c, g, or t
  misc_feature (491)..(512): n is a, c, g, or t
  misc_feature (515)..(547): n is a, c, g, or t
ggagagcatatttgaaagccaatgaagcatttgcggaatgtacattaaaagcattaaaaaccttgcctaaaacttcgactgaaataccattgatctgggtgcacgattaccatctcatgttggcagctaactggataagacaggcagctgatgaacaagaaataaaagtgaaattgggattcttcttacacattcccttccctccttgggatatatacagactgttcccatgggcagacgaaatacttcaaggtatgctcggctgtgatctggtgggattccatataactgactattgtataaattttgttgactgttgtcatagaatcttgtaatgttaagaagatcctgaataatacagaggttgatcttattgnnnnnnnnnnnnnnnnnnnnnnnnncttaagtatgatatcatgattaaaaatattcatattttacaatatgatagnnnnnnnnnnnnnnnnnnnnnnnnnnnnnnnnnnnntagnnnnnnnnnnnnnnnnnnnnnnccnnnnnnnnnnnnnnnnnnnnnnnnnnnnnnnnnctactcaagtattgtagatttgggaaaaacatataggtttaataccggaatatcag

SEQ ID NO: 10965 - DNA, 447 bp, Diabrotica virgifera
  misc_feature (110)..(136): n is a, c, g, or t
  misc_feature (273)..(287): n is a, c, g, or t
ggggggggccggttatttcacctctaaaagcttaaaataaaccatggtctttggtaaaaaccaaaggataatcgaaaataccgacctggtagaagttaggagaaagtggnnnnnnnnnnnnnnnnnnnnnnnnnnngggccgcttccctaccgaaataaatttgggatcagattatcccgacacccaaaaatgcggtaaagcacgttcaaaggtaaacgctggcacagtgaaccaaactactactagaggaggtatgcaccgtgcctgcgagnnnnnnnnnnnnnnnaacaggttccatgtactatcaaagaaagattgtgggaccagtggccgctgaaaaattaacgtctcgtatcgctcaataatgcacccgaacaagttagaaagagtaataacggaaaagtaccatagttctgaactggtcaccgcgaggtgcatgaacccat

SEQ ID NO: 10966 - DNA, 492 bp, Diabrotica virgifera
  misc_feature (339)..(356): n is a, c, g, or t
gtccatatctgtaggagcacaattcataattccatttactggagagattacccgaatgcctggattaccaacaagaccagccatttacgacatagatctaaacattgaaactggagaaaccagttggtgctcccttaattgaaggatctgccgttaaagatagcggagttttgtcacggaatatcgaaagagaaccatgtgaaagcgcaacacattgctttgaccagatttttaaaaaagacatatatttcttttatatttagtagatatgttttacatatacttatgaagtatctctaataacgaaatattaataagtaaataattataaataagtgnnnnnnnnnnnnnnnnnngatcagcataatgataccactttaatactaatgaaaacatagaagaaaattaggattagatgatgtcctatcatcatccaggatattattaatttaaacatatagaatatactaaccctctaaaaatattatttta

SEQ ID NO: 10967 - DNA, 101 bp, Diabrotica virgifera
  misc_feature (2)..(71): n is a, c, g, or t
  misc_feature (73)..(97): n is a, c, g, or t
tnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnaccc

SEQ ID NO: 10968 - DNA, 721 bp, Diabrotica virgifera
  misc_feature (220)..(242): n is a, c, g, or t
  misc_feature (312)..(332): n is a, c, g, or t
  misc_feature (392)..(413): n is a, c, g, or t
  misc_feature (438)..(460): n is a, c, g, or t
  misc_feature (471)..(495): n is a, c, g, or t
  misc_feature (508)..(520): n is a, c, g, or t
  misc_feature (522)..(537): n is a, c, g, or t
caactacaactaaaatgagcactagcgaatctaactcagctgagcgcagtcgaagacccttcttctcctgagcgcaactctcgattacgtaaaaatagacatggatgcataaaaaaaaaattcgagtttttggacctattagtaacaaggatcattagttagaaaatatacatttattattttccaattcaacagagcttattgaattaaaattcttagnnnnnnnnnnnnnnnnnnnnnnngctttctggaatgaaatgctactcgtgttcaaatatatctaattgtttaagaaataacctaaatttatgnnnnnnnnnnnnnnnnnnnnngatatatacttaatattatgaacattaaagattttaagggatgagcttagagacatctcnnnnnnnnnnnnnnnnnnnnnngatcatcaagtacgattaacaatannnnnnnnnnnnnnnnnnnnnnnacttattttcnnnnnnnnnnnnnnnnnnnnnnnnnaagaatcttatgnnnnnnnnnnnnncnnnnnnnnnnnnnnnncaacgatgataatattagctattcaagaattgtagatccaggaaaaatatataggcctactaacggaattcgagaacatctcttccacctgttcattaaaaacatgtctttctgtgttataataataagtctcacctgaccactgaattaattgaatgccccgcagtaccttgaccgcgctaag

SEQ ID NO: 10969 - DNA, 851 bp, Diabrotica virgifera
  misc_feature (501)..(520): n is a, c, g, or t
  misc_feature (763)..(763): n is a, c, g, or t
  misc_feature (815)..(815): n is a, c, g, or t
cccacgcgtccgattctacaagcagtgaagaagacaaatctagtgaagaaaaaagagaatctgaagatgatatcttaggtgtatccctatttctacaaccgttaggaaacaaaacacccaccagagaaagggagagcaatatgaaagaaaatgtggagaataaagacagagaacaattttttaaccagaaaaatccgccaggggaaaataaagatcaagagaaaactagaacgcaaacaacaaatgttgataacaaagcaaccaatgaaaaaagtaacgttaaatctattccatacggtgactcaaaattatccttaactaaatcaaatgaaaaatctacgcattacgaagaacccaccttaccctcaggaaaatcagaagccagagctagatcttttgaaagtgatgtttcacagtttttggacgaaattgatgggaacaaaaagcccgatttggaggaacagcttaaagagttggaagagaaatttataaaacaaagtnnnnnnnnnnnnnnnnnnnnagaactagcacgactacgtaaacttttaggtaaaggtaatgaagacgaaaacactggatcaaagccactggcccaaaatgaagatcaaattgaatttttaacaaggttagagaagctaatgaaatcacgagcaacagatataaaacaacaagaaaaaccgacagactccattcgcgaagaactcaaaaagctgcaaattgctattgccaacctaagaccaaaagaggatgcccctaaagttanagaacatcccaaaattgaacccgaagccaaagaactaccccgatgaggttanacttgaccacgaagcaggttttgcagttatcaactc

SEQ ID NO: 10970 - DNA, 589 bp, Diabrotica virgifera
  misc_feature (86)..(103): n is a, c, g, or t
  misc_feature (105)..(118): n is a, c, g, or t
  misc_feature (128)..(166): n is a, c, g, or t
  misc_feature (206)..(238): n is a, c, g, or t
ccaagggaaaggttaaagggcgtcagtcgggagacgatgacgatgacgacgatgatgacgacgacgatgatttggatttaggagtnnnnnnnnnnnnnnnnnncnnnnnnnnnnnnnncagtcccgcnnnnnnnnnnnnnnnnnnnnnnnnnnnnnnnnnnnnnnnctactttggaggatttttagatgatattttaggcggagannnnnnnnnnnnnnnnnnnnnnnnnnnnnnnnntgaacctgtccaggtagctcaaccccaaccacaaccgatcgagccaattgaagcagtacctgtggcaccatcagagcctgcagatgttggagaggcaggtgctgaggtaaacccaagcgatgaattggacgcccaagaaattgcagcaggagatgccgaaggtgcaactggtacggacgaaacaggcgtgtcacaagactctgactcagccatcgtcgtcaaagatccagaggcggaggcacaaccgtgatataattccgttgaaccggttatagtacaacaagtggccgccacgactgacgatgacgacaatgacgacgaggagtatgatgacgacgatgacgatgagga

SEQ ID NO: 10971 - DNA, 725 bp, Diabrotica virgifera
  misc_feature (276)..(297): n is a, c, g, or t
  misc_feature (410)..(442): n is a, c, g, or t
  misc_feature (512)..(542): n is a, c, g, or t
  misc_feature (690)..(713): n is a, c, g, or t
cccccgcgccctataggtgctcattatacaatagtaggatacttattgagtagcagtagacaaatattcttcatggtgtagcagccgtgtgctgtagtggagaagagaataggtgatgactatcacagacacctctggtcttagtaccttgcgtatcaggactcataaatcaacaattatagatgttattcatcgacgaacttatcacagctaaattattgaaatgcttattgtaaaacaccaatctttcaagaatgactttgcccagccatgctnnnnnnnnnnnnnnnnnnnnnnccaattatgaacaaaataaaattcactcatgatctatatatttatacttaaacactattatctcattgacattaaatattcttaaggatgagctcacaaataacaccggattnnnnnnnnnnnnnnnnnnnnnnnnnnnnnnnnncaaatctttcatatgttcaaagaggttatgatcctatttttatatattagaatcctgatttttcataacnnnnnnnnnnnnnnnnnnnnnnnnnnnnnnngacatttagcactgctgataggattaccatggacacattgcatctttaccacagatatatagggtcaataaaggaatcctgcaacatttttttcccctggtgattaaaaacatgcccttttgtattaaatagaaaggctcgcctgctnnnnnnnnnnnnnnnnnnnnnnnnatattttgaccc

SEQ ID NO: 10972 - DNA, 934 bp, Diabrotica virgifera
  misc_feature (116)..(146): n is a, c, g, or t
  misc_feature (810)..(810): n is a, c, g, or t
  misc_feature (827)..(827): n is a, c, g, or t
  misc_feature (839)..(839): n is a, c, g, or t
  misc_feature (908)..(908): n is a, c, g, or t
caagacaagacaccaacaaaataaatataaaatccttcaacttcaacgatattctcaaaaagcaccttacagttgattattaattaaagaagtatacacctaagttatgcttatannnnnnnnnnnnnnnnnnnnnnnnnnnnnnnaatcgtccacactaaataataaaaatgaatgaagaatcagatcctatacatcatagatcgaacttttccagtgttgcagaaaccagaggtaatagaagcttaaatttgattaatagcaaatccactgcaaagaagttaatcataaaaaatctgaaaacccggccagtgctgcctcctgactaccaagaacaaacatggaaaaaattggaaagtgctatatttgcaatccaacaggctgtatcaaatcaatactgtttagaggaactgtatcaagcaattgaaaacctgtgcaatcataaaatgggtccaattttgtatgatcgcttatataatttgactgaagcccatgtttccactaacattgaacagtttttatcagaatccatggacagttctttgtttttacagaaaatgaatgagcattggttggctcattgtaaccagatgatgatgattagaagtatatttttgtatttagatagaacatatgttctccaaaaccccaatatcgttccaatttgggatatgggcttgaagttatttagtaaatacattgttttaaatagacttattcaaactagattagtagaaggtctgctgatgtttattaagaaagaaagacagggtgatacaggtaacaaaacattactcaaatctctcttanatatgttaactaatttngcaaattatgancatatcttcgaacaaaagtttttgcaatcaactgaacatttttacgcagcagaaggtcaaaagtgatancagacctagaagtttcaattacttga

SEQ ID NO: 10973 - DNA, 1243 bp, Diabrotica virgifera
  misc_feature (821)..(857): n is a, c, g, or t
  misc_feature (871)..(937): n is a, c, g, or t
  misc_feature (958)..(1002): n is a, c, g, or t
  misc_feature (1018)..(1057): n is a, c, g, or t
  misc_feature (1060)..(1127): n is a, c, g, or t
  misc_feature (1142)..(1224): n is a, c, g, or t
tttaactttaaagtaaattaaagaaactaccaaagaagagaactataaaatgaatcatgaaaatatagaacctcaaaagtgctgtcccaatgataaaatgaagctaaaaatcctagctattcatggttaccgacaaaacgctgaaacttttagatcaaaaactggatcttttcgaaagatgattcacaaatgggcagagttcacgtacattacagctccccataaggttattctagtagatgatcctaatgatttagagaaaaatggacctgatattggacaaagtaaagatgaagaacaatatggttggttttttaatcgagatgataaaacatttaggggtattagaaaaggagggccagccattggttttgaagatagtttaaaatatatagaagatatttgtgaaaaagaaggtccatttgatggtcttttaggattctcacaaggagcttgctttgctggattactttgtgatttacaacaaagaggattgtccaaattcacttttaattttgccattttttcttctggttttaaatctgggagccttccacatttgaaatattacatcgacagaataacaataccaagccttcatatttttggagaaaatgatcagatcattccaacagacatgagtgaagctttgagtaactgctttgaagaaccatttatagtaaggcatcctggaggtcactacttgcctgcttcagctccacagaaaagtgattatcagaaatttataaagcttcaacttcttaaaaaacaatgtaataacttaacattccatgcgggttaaataaatttgtaaaaagaannnnnnnnnnnnnnnnnnnnnnnnnnnnnnnnnnnnngcggctccgatccnnnnnnnnnnnnnnnnnnnnnnnnnnnnnnnnnnnnnnnnnnnnnnnnnnnnnnnnnnnnnnnnnnngaaagtaaattaatattgggnnnnnnnnnnnnnnnnnnnnnnnnnnnnnnnnnnnnnnnnnnnnncctggggatcccgggnnnnnnnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnnnnnnnnnnnnngaagaggtgttcggnnnnnnnnnnnnnnnnnnnnnnnnnnnnnnnnnnnnnnnnnnnnnnnnnnnnnnnnnnnnnnnnnnnnnnnnnnnnnnnnnnnctcttgtggggggggggcg

SEQ ID NO: 10974 - DNA, 328 bp, Diabrotica virgifera
caaaatgttatccaaattgttaatatttgtatttgctgctgttgaaagcatagaaaaatgattatttagtgagagcgctcaccattgggagaaaatattacaattatcataacagaaaaagtgattttttgtaccgtgtgcatcctggattattaactaataaatatatatgtattattcacgaatctaatggagatccacaataaaaatttccattgtaaaacaaataacttaaacaattttctcgcaacgaaaagctattcgcgttcttctatagctaatccttaacgacctactgtacaggtatttattaaccacatacttctac

SEQ ID NO: 10975 - DNA, 257 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnataaaactagttctagatcgc

SEQ ID NO: 10976 - DNA, 1049 bp, Diabrotica virgifera
  misc_feature (219)..(739): n is a, c, g, or t
  misc_feature (741)..(778): n is a, c, g, or t
  misc_feature (780)..(851): n is a, c, g, or t
  misc_feature (878)..(979): n is a, c, g, or t
  misc_feature (997)..(1017): n is a, c, g, or t
tttcaataatgataccaacgcgcaagcgtcaagaccaatttctatgtaaaaatatgatctcgacaaagcttttctagtcgaaatcaatttctatctaacgtgctgatagtagaggtcgagatgagtttcagaatatcaattcctacaaattgtgatccaacttctgacctctatttgtttaatttaatagagatacaaaactgaaaattttattgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnagtttatcaaatattaaataagtttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatccacaattttttnnnnnnnnnnnnnnnnnnnnnccctcagggaaaaaacggtgaggatttttttt

SEQ ID NO: 10977 - DNA, 877 bp, Diabrotica virgifera
  misc_feature (116)..(136): n is a, c, g, or t
  misc_feature (666)..(713): n is a, c, g, or t
  misc_feature (790)..(790): n is a, c, g, or t
  misc_feature (812)..(812): n is a, c, g, or t
  misc_feature (826)..(826): n is a, c, g, or t
agttaatagtgttaagtgttaagacgtgttatggggacactaacggtgtggatacccctgttagtggtgtccttaatattattggaccaacagactggaggagctcaagttcccannnnnnnnnnnnnnnnnnnnngcaccaaaacagtggacggttatatccctaatgccaatactaaatcatataccaagaccaaaactgcccatactaaatccaggcatcacggacacacctcaaaaatgttaccaccacgcgcccatgaggcaaccatgagcccatatgatgtttccggtagaaaagccagagacttcttggatgctgtatctggcccatccaaatatattagttcaggtggatcatacggtggatcttcacaaggtttttcataccaaggaggatgtcagagtatgccctcacccatgaacgctggagtaaaatgctcgtcagtgtctggatgcacagctacttgtatgccagacgctcatttccctaacggaagaacggaacttaaacttctctgtcaaaatggacaatggtttgcagaaggatataatggtgtaccaaactgtgaacgcagttctggaatgagtggctcatcatctagttctggtggatcttccatttcattccaaggaggatgtgtgggtatgccctcacccatgaannnnnnnnnnnnnnnnnnnnnnnnnnnnnnnnnnnnnnnnnnnnnnnngccaggctctcaattccctaatggaaaaactgaactccagattctctgtcaaaatggacaatggtcagcactacagntttaatggtgtaccagactgtncacttatatctggntcatccggaaatgagtgggtcatcatctagctcaagtagttcttcatcttc

SEQ ID NO: 10978 - DNA, 486 bp, Diabrotica virgifera
  misc_feature (2)..(38): n is a, c, g, or t
  misc_feature (49)..(100): n is a, c, g, or t
  misc_feature (110)..(138): n is a, c, g, or t
  misc_feature (150)..(215): n is a, c, g, or t
  misc_feature (219)..(304): n is a, c, g, or t
  misc_feature (338)..(358): n is a, c, g, or t
  misc_feature (361)..(373): n is a, c, g, or t
  misc_feature (421)..(440): n is a, c, g, or t
annnnnnnnnnnnnnnnnnnnnnnnnnnnnnnnnnnnnatgaagggtgnnnnnnnnnnnnnnnnnnnnnnnnnnnnnnnnnnnnnnnnnnnnnnnnnnnntttaaaaagnnnnnnnnnnnnnnnnnnnnnnnnnnnnnaccctataaggnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnncccaggggaacaccggaatttttttgggaagtcnnnnnnnnnnnnnnnnnnnnnccnnnnnnnnnnnnntaaaagatataattgtggggggagataattattttttaatgcggtggnnnnnnnnnnnnnnnnnnnngggtaggtcggactaaaaaaacggggggggggggcggggggagtgt

SEQ ID NO: 10979 - DNA, 846 bp, Diabrotica virgifera
tatgtgctgacatgttgtcgcctatcaagatctttctaccttcgtttctgttggcgtacggtagaaaatgtgtctcagatcagtcagtaaatatagaattttcaatccagcctgattttgaggtgttcaatatcgtaccagtaggtgcaccaaaaacccaatctgaccacttcagactacctttcattattacatatggaggcagaaactctccatctgcatttgcacaaaacagagtggtaaaacaagactccgttgaatttacgattctctcgtggattcctgcagcctcttctgaataaaagttctttttgttggaacgtcatggaaccctgtttcgtcgtaattgtaaatattgttgggtgtgatatcagaaacttgtatctcgaagttatcaaaaaatttattgattacatcttcatttacttgcgccctccttctggaaatattcgtttgaaagcgttgagcaaggtctgtgcagtttctctccaaaaataattgactccaatcccagcctcgaaaattttccttaaactgtgatacttttctcccttgagaatttaagtaactttgtgcaatgcatctcacatcaaacaaagatattggaattccattatcacttaaagaaataacatgcttggctatcgacttttcttcttcttgagaaaatactgtaggccttcctacattttttgagtggtttcgttttaatttatttcgaatcgtattacgcgggatatcgtattgttttgaggcctgtctttcactcagcattccacttttaacctgttctagtactgctttgtaggtgttcctctgtatatcgacttttagttccctaccgac

SEQ ID NO: 10980 - DNA, 699 bp, Diabrotica virgifera
attcccgagattatattctaaaaatcatggatgtccactattatatgcccaccttcgaatgctgcatgtacaaatacactattactgtgaaaactaccatttgtgcctagacacctgactggagctgtctaaaagaaccatgacttttcctcaggagtgtatcctccccctttatactaccccccaatatatcacgaagaccgtatgacaaaggcgactccgtcggccaagaacaccatgatgaactgcgagatgaacccgacatccatcgacattgtggcataatcatccttctagtccacgtctatagactcttacaattatgtgccacactgctgcagagatcttaggacacttgcgatcatatcacgatcggattgcggggaatgaacgatcacatcaaagataggaaagataaggaaaagagcattggcttccatatgaagaagaatttactatactatgacatctctgcatacatcctctacctgttcgaggaacccttctggagatcgtctagaaaactcattgacatatccctgctcaaaattctgagctgctcctgcctctgcttcctccagactatccagatgcatctctctggaacgatacatatcgaaaaggatcttagaactgctcacacctgcactgccctatgatgacgaagatatatctgctcattaacgctgtactatcact

SEQ ID NO: 10981 - DNA, 560 bp, Diabrotica virgifera
  misc_feature (495)..(510): n is a, c, g, or t
aaaatggcaatgttccagtgcttgattgtattttctctcagcgattaatcatataaaaatcacttgtaacaactgtgagatgctgatataacccacataaataacgtgctggaaacatggcttaaagatataaatcaacaatacatttcgtttcctgcataaatgaggaaaagaaacaataaaatacttcttgagtttatggaccgcttaattccataactgtaggattagaatactcttttcaaacaattgcatctcaacacattttttggaggtaccttctaagatgatttacgatacggcgcaccaaactacttcaatatgcttatgactctgccctacatgtttaacatagatttaaacgctatcaatattctaccctacgttcattggaatataactaaccgttgaaaacttttcgttcaacctcacttaaaggaacgctttaacgtgttggaaagattaatatataaccaacaccatcttgataaactnnnnnnnnnnnnnnnnatggaacatatcgggactctgaacataatcgtgtttccccatgtataaat

SEQ ID NO: 10982 - DNA, 783 bp, Diabrotica virgifera
  misc_feature (2)..(298): n is a, c, g, or t
  misc_feature (308)..(387): n is a, c, g, or t
  misc_feature (392)..(548): n is a, c, g, or t
  misc_feature (739)..(770): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggagnnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattaccttagggatacagcgtatttttattggaaagttcaatcgataataaaattggcgaacttccatggttggattaaagtttattattggggggacccgcgtttttttattaagtccgttcccacttttaaaatttttcatgtattgagttttaaaccccgggggggaccccgggtggggtttttnnnnnnnnnnnnnnnnnnnnnnnnnnnnnnnncccaaaggacacc

SEQ ID NO: 10983 - DNA, 355 bp, Diabrotica virgifera
  misc_feature (154)..(173): n is a, c, g, or t
cccacgcgtccggagtgttctgagtagtttttttcgtattaattagtatattgtatattttctagggtgaaaagcagttcactattgtaaaatacgaataggtgatgataaacatatagtgcctgtgggtggtattacctttaaatttagaagnnnnnnnnnnnnnnnnnnnngagatttctatttataaatctaattcataatagagattattgttatagttatttcttataaaaaattcatgtagtaggagcaattgcaacatcatatatatgattatatgtgattgccttaataacctaaatttgattattgataaactttcacatattgctcttacatatttgtacgtgac

SEQ ID NO: 10984 - DNA, 947 bp, Diabrotica virgifera
  misc_feature (215)..(239): n is a, c, g, or t
  misc_feature (385)..(407): n is a, c, g, or t
  misc_feature (532)..(573): n is a, c, g, or t
  misc_feature (638)..(656): n is a, c, g, or t
  misc_feature (699)..(743): n is a, c, g, or t
  misc_feature (784)..(825): n is a, c, g, or t
  misc_feature (849)..(849): n is a, c, g, or t
  misc_feature (872)..(884): n is a, c, g, or t
  misc_feature (886)..(908): n is a, c, g, or t
caaataagtgcaaacgctgaagaaacaatcttaaaaaagtctatttgcaaatgtaaaatttgttttaagcaatttaatcaggcaagttctttgaaacaacatatgaaaacgcacattggagaaatgctttacaaatgtaaaatttgttttaaggagttttctctaacaattgatttaaaaagacatttcagaacacacactggacaaaaacctcnnnnnnnnnnnnnnnnnnnnnnnnngtttactaaagcaagtaatttgaaaacacatttgggagtgcatactgaggaaaaaccttacaagtgcgaaatttgtttaaagcaatttaggcaagcaggtaatttgaaagaacatttgaaagtgcacactggagaaaagccttatnnnnnnnnnnnnnnnnnnnnnnngtttggtgaagcaagtaatttgaagaaacatttgagtacgcacactggggaaaaaccttacaagtgcgaaatttgtttaaagcaatttaggcaagcaggtaatttgaaagaacatttgagagttnnnnnnnnnnnnnnnnnnnnnnnnnnnnnnnnnnnnnnnnnncagtttggtcaaacaagtcatttgaaaacacatttggagatgcacgctgaagaaaagtcttaccnnnnnnnnnnnnnnnnnnngcaatttaggcaagcaggtaatttgaaaacacatttaaaaacnnnnnnnnnnnnnnnnnnnnnnnnnnnnnnnnnnnnnnnnnnnnngtttagtgaagcatgtaatttaaaaacgcatttgagagttnnnnnnnnnnnnnnnnnnnnnnnnnnnnnnnnnnnnnnnnnncagtttagtcaaacaagtcatttngaaacgcatttcgagacgcacgnnnnnnnnnnnnncnnnnnnnnnnnnnnnnnnnnnnngcaatttacgcaagcaggtaagttgaaacacatttaaaa

SEQ ID NO: 10985 - DNA, 1000 bp, Diabrotica virgifera
  misc_feature (901)..(901): n is a, c, g, or t
  misc_feature (944)..(962): n is a, c, g, or t
tgaatctcttagttctctagtttaactatagctagtaaaagctgatgtcacaaaataaaataaaacatctagaatttgtttcattcgaatacacacagatattaaatttccgttccgttgcgaccggtccggacaagtgaggcttgccttttaagcgggctccacactctcggcgaagttacttcgccaaagttgaccgaagtccgaagtacctctctacacactcgttctacttcgcgaggaacacattcaagcgatgcgataccgacaaagatccctttgactcggacgcgccagaccgacagagaacggaagtagaacgaagcgaggcaaagttgcacaaggtgtccgtctacactctcgtacttgttgaacctcgatcgacttcggcgagagtgtggagctcacataacattttttcatagagagtaataatgtaacagtttgtagtttctaccagttgtgatgtaacaggcgtaacgctatgttatttcacaatatggagaaggtctactacttcttcatttgtgacgagatctaccagcgaaatttcaaaaattgtcctcgagatggacatttcaaatttttttaggttctatgatcttaatttaacttccatcaacaataagatttactgtttttgattaaatagttaatctagcaaagatagaccagtaggtacttctttaaatctagtaatggtcagcgtttacatagaccaataatagtttattaagcttttttcggtcaactttttaagtcttgtttttaaaggaatgtttgtataacattttaaacctttgtgaaacatgtaccattaatgttgctcttccactcctttataaaaataattgttaaaataacttataaaattaatcttgtttaatgactcgaaatatanattttaaattttcgtataaggttcagatttacagtattagttnnnnnnnnnnnnnnnnnnntttttcatttcttttctaataactacacatacagcaaa

SEQ ID NO: 10986 - DNA, 906 bp, Diabrotica virgifera
  misc_feature (122)..(148): n is a, c, g, or t
  misc_feature (150)..(162): n is a, c, g, or t
  misc_feature (817)..(817): n is a, c, g, or t
  misc_feature (880)..(880): n is a, c, g, or t
ggggcatgctccatccaacatggcggaagcgatcccatctgcgtcgccgtaggtcacatcccctctctcccatatcactggtcacatcatacaaatgtcaaatgtctaacctgacaacagcnnnnnnnnnnnnnnnnnnnnnnnnnnncnnnnnnnnnnnnngtagaaaaatatcttattaaaatggcaaattctgacacaattcaagttagttcactacctcttcctcctatgcaatatgtaagtcaatacacagatgaagcaattagaagaggtaggactccaaaaccaccaccaccaattcaagatacctatcatatgtttggcaatgcatttaatactgaagagagcattattagaccactggaaagtcaaggcatcaaaaggctatatcccctacattttgatagaagaagggaactaaaaaagtttaaccagtccctattggctaatttcttggacttactggatttattagttaattgcccagactctcctcgaagagcagaaaaagtggaagatttaagtttgttatttattcatattcaccaccttctgaatgagttcaggcctcaccaagctagagaaactttgagagttatgatggaattacagaaaaggcaaaggatagaaactgcgaacaggtttcaaaaacatctggacagagtaatggatatcttgcaacaagctatccaaaatctcccagaacctatggatttagactcaaaaatcatgatagacacagattttttgatgcatagtgaaaacagtgataactcagaaacctcacaagatccgtgctatattttggacaggngtatgtgtaatatagtagataatatgcaataagttttatatcttgttactattattatattanttatttacatagcttctgttttagca

SEQ ID NO: 10987 - DNA, 344 bp, Diabrotica virgifera
  misc_feature (2)..(200): n is a, c, g, or t
  misc_feature (205)..(283): n is a, c, g, or t
  misc_feature (285)..(342): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnntc

SEQ ID NO: 10988 - DNA, 280 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattatgaaaatttccaaaatgaagagggataacacttacttaat

SEQ ID NO: 10989 - DNA, 1010 bp, Diabrotica virgifera
  misc_feature (22)..(39): n is a, c, g, or t
  misc_feature (326)..(341): n is a, c, g, or t
cgacgagtgtgcgtaaaagcgnnnnnnnnnnnnnnnnnncattcataattcataaccttcacaacaaaattataatgtttataacaatgttgtagattttgtttataatctattgtacaaagtcattgtttactaaagcattaaaaaacggttttaaaaatttctaaatgaaaatggaaaattcttctctaaacaaagcacaccaacaacaaaggagggccgaggctttactcagacaaaaaaagtatgaagactgcatagaatgtcatagacaagccattcaacttttagaagatagtttaaacttgacagaaaatgcgaggtcnnnnnnnnnnnnnnnncttcaaaaagaatatcacaaaaaacaaatcgaatttgtacagatgaagaaagctcaatcacagatcgagaatcataagaagttagctcaattacagaaaagaaggatatctgttcccagtaatgatccagagaatggagaaggtctagaagctgctatatacaggacaattgaagtgcatgactctttaattgattatctaggcaaaagaggcggcagtgataacgatagtataaaatcatactcaaccagtgacaacgaagagaaattagaaaaagaaacaactcaagtaattggtaacaaacatccaaaagatgactctcagatcattgaagaactgaaagtactcagtggacaacttagagattctgttaaatgtcttcttatacaattagatgatagaaacagagagattgagaaacttagagctacaatcagggtacttgaaggagaaaaacaaaaagctcaacaaactaagaataattcaagtttaaaagttgtgactgattcttcaggaggcacatctccatatatttactcaccttgcagcgaattgagcccagacatcgttaatgaaagcaggaatttaccacagctagctcctctagagatgcctaaacttcgactttctaagcctcattaagagtagcaatgttaataacaattaata

SEQ ID NO: 10990 - DNA, 643 bp, Diabrotica virgifera
  misc_feature (8)..(26): n is a, c, g, or t
atttgaannnnnnnnnnnnnnnnnnngttgtttttattaggattaataaataggatatttagtattcatatatcgcttctttaaaggaattctcgttcattcttttcacctgcgtgttataaacctgtctatctctcttatatcttaagcctctcctgccccctgatgagttagattggccgcggaattatgaccgagctactgaagcataaacattaattatttttactgtcctgtgaaatgtgggggtgcatgttcatcatatctgtgtttatttaatctcttctgaatgatatttttaagagaagctcttatgttcctccaatccacgagaagaccctacttactgttgtagcattattaatgattttctttgtgatgagagtcattgatagttatatctttcttgattcgggctgatttaccaatgaacttggcggtacctccattataatatgaattgatatatatttgatcccggttatctgcttctcacaacatgttgccttagggagaacactcatgtatatcttggagattccattcccgataatgatgattgcgacctcgctgctggactacggaatctatctgtagcaacggcgatgtcttgaccatctggacgactctttactctttacat

SEQ ID NO: 10991 - DNA, 662 bp, Diabrotica virgifera
gtaagaccaactgtagtagcaactagaagcttcagcacatcaaaacagaacaacttcaaagtagcaggatgtggaacatgagttatgaaatagacaatgactaaagcatacatgaatgagtactagaatgactaaaggaatcctggatctgaaaaaatgtcctatagaagtttacactataaaagattcattttcacttcgtgaataattattatgtacacttttgcttctaaataacaaacaaaaatccaaactaaagagtatgatcactacatgctcgaaagattttttgacagagataattgggaacttcatagatacatgccattatcctgatgcagatatcgaggtttattgaaagttttgttttccacgatgaagacgttgaagagtaacaaacacacaaacttattcactgagagccgatgagtagaggggatttgacagtttacgccagagctgatagtggaagatatgtgcattgaatttgaacaattttatcagaaaagtacaagcttcacaccgcgagagagagataccgacgaaactcacagccagaaaaaacaggtaatctctagattacacataatcttcttctttttctcaatggcctcttgtatatacagtcatccagacgaacgaatggtcatattaagatataa

SEQ ID NO: 10992 - DNA, 957 bp, Diabrotica virgifera
  misc_feature (479)..(507): n is a, c, g, or t
gttcagtggaaaatattcaattaagatattcctagagttcagacgtgtgctctgaaagcgtgactgttgaaaaatcgtcgagtgagacaccccaactactaccacaaccaaagttacgaaaattagtacccaacaacaggtaaccaaaaagcctctatcgccattcgctaaatttcaacaattggacaaacaaaacagtaccactactccaccaggaacgttcaactagacaacttctccaccagctgggcggacggacttgcattttgtgccctcatccaccatttcctgccagacgccttcgactatcatgcgttaacgccaaaagaacgaagacacaatttcgaacttgccttcaaagttgccagtgacaaggcggacatttttcctctccttgacgttgacgatatgatggccaccagaaggcctgattggaaatgcgtcttcacatatgtccagtccatttaccgacgcttcannnnnnnnnnnnnnnnnnnnnnnnnnnnntattatgtgttttgtgtttgtttttgtacaaatgtagatattagaagttgccgtcaaacattattggtaaaataataagatacaaaagagaacagaccgataaagagaatattttgttgtgatatgacaaaaagaagtatctctagaagataaaaacagtttagtcttgtgtctttagcactatcaggcaatgcaatacaattattcgagaatctttgacaatctgttctaatctgaacaaagcaatccttgaaaaatgatgtgcgcatgcgcacacgccttcggggaagaaccgttttgactgaaattagatgatggaagttaaaaaactgtgacaatgatctagagaaccaaaagcaagattggaaatatgaagaaaaatcacaaactgtatttgagaacgatgacccatcttgaaagtatttggaaaactggaggtataaatcctct

SEQ ID NO: 10993 - DNA, 392 bp, Diabrotica virgifera
  misc_feature (3)..(16): n is a, c, g, or t
cgnnnnnnnnnnnnnnagttctgtttactttaagcttatacagcgttactctacacacaatccatattgaaatggtgtcattcacagaaaaagaacataaaaataattgcgctacgaggcggcatcgggatcatagtacttctcctttataataatggctgtcgcaccacgccgctggcctccagctacaaacattccactgaatcatcgaccagttcaaggacgcaatggtgttatccccaggaaaggctatcagatttccgatatcgctttgatctccacaaatacttccaatccccatcaacttgatctagctctcatgagcttgctaattactgctaatacagattccaccatacggagcttcctttgaaaacatctcctggtgataa

SEQ ID NO: 10994 - DNA, 732 bp, Diabrotica virgifera
  misc_feature (549)..(571): n is a, c, g, or t
  misc_feature (676)..(697): n is a, c, g, or t
tttacattttacctttcaatacgtgtgttcatatgttgtttttattaacggagagcaaactctaaatggcgatacactatactgccttaataacattacattttatcttatcgaccaattcgtaccacgaagttgtatgtgatagtactatgcttattacgctccaatttattagagctaaagactcaaccgcattatcgtaagcttattatcttgcagaatgctattgtgctgtcttgtttttgttgtgaaacgatatcaaacccactaagaagcttattcagattctaaagtaacaatatattcacaataaaatatagatatcttataaatatcctatatcgatacgggatgagcttgcaagtaaaggtcgctcgacatatcattttctaaaacatatagggacaataaactcttatatttgacactacgttattatagatcgtgatacattatccattttgattattaataagttttatacgaagacataaatcataattatttgactttaggaatgttgatagtattacaattgacaaagtgagnnnnnnnnnnnnnnnnnnnnnnnaaataacggccttcggcgacgttttttccgcctgtctattactcaccccggccttttgtaccaatcttaatcgcgtcgcctgcccactgcctcctttgaatggtnnnnnnnnnnnnnnnnnnnnnnagtagcctagccatcccctctctccccgaaagctg

SEQ ID NO: 10995 - DNA, 133 bp, Diabrotica virgifera
  misc_feature (11)..(35): n is a, c, g, or t
  misc_feature (39)..(62): n is a, c, g, or t
  misc_feature (64)..(76): n is a, c, g, or t
  misc_feature (78)..(90): n is a, c, g, or t
ctattacatgnnnnnnnnnnnnnnnnnnnnnnnnngcgnnnnnnnnnnnnnnnnnnnnnnnngnnnnnnnnnnnnngnnnnnnnnnnnnnctttaggtttgatattttagagtatggaactataaaatttaat

SEQ ID NO: 10996 - DNA, 1233 bp, Diabrotica virgifera
  misc_feature (3)..(904): n is a, c, g, or t
  misc_feature (906)..(906): n is a, c, g, or t
  misc_feature (912)..(950): n is a, c, g, or t
  misc_feature (952)..(981): n is a, c, g, or t
  misc_feature (1002)..(1002): n is a, c, g, or t
  misc_feature (1020)..(1020): n is a, c, g, or t
  misc_feature (1033)..(1033): n is a, c, g, or t
  misc_feature (1180)..(1224): n is a, c, g, or t
cgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngngtgatnnnnnnnnnnnnnnnnnnnnnnnnnnnnnnnnnnnnnnnannnnnnnnnnnnnnnnnnnnnnnnnnnnnntttatagaaataattaccttnagggataacagcgtattnttatttggagagnttcaatcgaataataaagatggcgacatccgatggttggaataaagttttataattggggtaacagcataaattattaaagcctgtccacttttaaaaattttacttgaattggaggtaaaaacggggggggggccccgggtggggnnnnnnnnnnnnnnnnnnnnnnnnnnnnnnnnnnnnnnnnnnnnngagagcccc

SEQ ID NO: 10997 - DNA, 1001 bp, Diabrotica virgifera
  misc_feature (35)..(65): n is a, c, g, or t
  misc_feature (702)..(702): n is a, c, g, or t
  misc_feature (868)..(868): n is a, c, g, or t
cctttacgtccgggattattaaattggaaaatccnnnnnnnnnnnnnnnnnnnnnnnnnnnnnnnatttaaacatgggtatcttagaaaaaatctcggaaatagaaaaggaatttcaagaactcaaaaaaataaagcaaccgaataccatttgggtcttttaaaagcaaaattagctaaatatagatcacaattattagaaccatctaagaagtcggaaaagggcgaagggtttgacgtattaaaaagtggagatgccagagttgctcttatagggtttccttctgtaggaaagtctaccctactttctacactaacaaaaactgaaagtgaagctgcttcttacgaattcacaaccttaacatgtataccaggtgttatagattataatggtgctaatatacaactgttagatttgcctggtattatagaaggagcagcacaaggaaaaggaagagggagacaagtaatagcagtagcaagaacagcagatttggttcttatgatgttggatgcaactaaaaaggatgtccacagatcattactagagagagaattagagagtgtaggaataagactcaacaaaccaaaacctaatatttattttaagataaagaaaggtggtggcctttctttcaactccacttgtccattaaccaaaatagatgaaaaactagtgcagatgatattacatgaatataanatttttaatgctgaagttttattcagagaagattgtactgctgacgaactaattgatgttatttgtgctaatagagtatatctgccatgcctttatgtttacaacaagatcgatcaaatctccattgaagaagtcgatagaatagctagacaacctaatagtatangtgtcagttgtaacatgaggctgaacctcgactaccttctgtcacccctttgggaataccttagtttgataagagtgtataacaagaaaaccagtcagccaccagatttttctgacggacttattctgaggaa

SEQ ID NO: 10998 - DNA, 55 bp, Diabrotica virgifera
  misc_feature (2)..(51): n is a, c, g, or t
gnnnnnnnnnnnnnnnnnnnnnnnnnnnnnnnnnnnnnnnnnnnnnnnnnnaaag

SEQ ID NO: 10999 - DNA, 197 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (160)..(191): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagttaaaccggtgtgagccaagttggttnnnnnnnnnnnnnnnnnnnnnnnnnnnnnnnngaaagg

SEQ ID NO: 11000 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11001 - DNA, 80 bp, Diabrotica virgifera
  misc_feature (8)..(27): n is a, c, g, or t
  misc_feature (29)..(48): n is a, c, g, or t
caatttgnnnnnnnnnnnnnnnnnnnngnnnnnnnnnnnnnnnnnnnntgctactagttatttgcatatattatcatttt

SEQ ID NO: 11002 - DNA, 907 bp, Diabrotica virgifera
  misc_feature (2)..(767): n is a, c, g, or t
  misc_feature (771)..(897): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttttt

SEQ ID NO: 11003 - DNA, 863 bp, Diabrotica virgifera
  misc_feature (224)..(253): n is a, c, g, or t
  misc_feature (571)..(587): n is a, c, g, or t
  misc_feature (590)..(621): n is a, c, g, or t
  misc_feature (752)..(772): n is a, c, g, or t
gttgactgctcacattttccatcgttgagaccagaacaactaaaacacttccaacatggcggacgatgaggaaaagaagaggaaacaggccgaaattgaacgcaaaagggccgaggtcagggctcgtatggaagaggcctcaaaagccaagaaggccaagaaaggtttcatgacccctgagagaaagaagaaacttaggttactgttgagaaagaaagccgccnnnnnnnnnnnnnnnnnnnnnnnnnnnnnngcagccgaaaggaggcgtatcattgaagaaaggtgcggtaaacccaaacttgtcgatgacgcaaatgaagggacacttaagaagatttgcaaagactattatgaccgcatgtatatatgtgaagaacagaagtgggatttggaacgtgaagttagaaaacgggattgggagatctccgaattgaacagccaagtaaacgaccttagaggcaaattcgtcaaaccaaccttgaagaaggtatccaaatacgaaaacaaattcgccaaacttcaaaagaaggcagctgaatttaacttccgtaaccaactcaaagttgtnnnnnnnnnnnnnnnnnccnnnnnnnnnnnnnnnnnnnnnnnnnnnnnnnnctggtcaaagaagggagacgaaaagaaggtacaagaggctgaagcatgatttttctcctttgttaaagcccttttgtcaacatcaagggatatgtcgttatttcgatgatcccatcgtgatttcgatatcnnnnnnnnnnnnnnnnnnnnnctttactttcccagactaaaaagagtggtctgtccgcatgtatattaatttggttattggataacttattaaaaaaaagtggaagaatggt

SEQ ID NO: 11004 - DNA, 57 bp, Diabrotica virgifera
tccctataggtttaataagggaattcgggatccttttttttaccacctgattatcac

SEQ ID NO: 11005 - DNA, 368 bp, Diabrotica virgifera
  misc_feature (32)..(51): n is a, c, g, or t
  misc_feature (153)..(170): n is a, c, g, or t
gtatataggtgattgacatacgacgattagtnnnnnnnnnnnnnnnnnnnnaataagaagctaatataattcaataaaatggtcaaagacgaggctccaagtaatacaagactaacatcatttaagttaccacgagatttaacccttgggccnnnnnnnnnnnnnnnnnntatttgtgtcaaattaaaatgctgttagaaagaaagaaacaccgaaagaatttaacaagaggtaggagagaatttctattgcgtgttgttattatttcatttgatgctagagtcaataatccgcaagccagaagcgacgttgctgcagtagcaaaacccttaacaggtattattagctgattactgattggaacttgc

SEQ ID NO: 11006 - DNA, 898 bp, Diabrotica virgifera
  misc_feature (414)..(446): n is a, c, g, or t
  misc_feature (690)..(690): n is a, c, g, or t
  misc_feature (779)..(780): n is a, c, g, or t
  misc_feature (819)..(819): n is a, c, g, or t
  misc_feature (857)..(857): n is a, c, g, or t
attcattcatctattcatttcattttcatttttcatttcattatcaattcatacttttctcataaacaacttaaaaacgactaaaaatgaataatacagaagtacatgatacagtgcaagcggccaatatataccttagccgattaaaatggttaaatagtgaactagaccatgcaatgaaacaaattctaagtacatttgaagaaacagaggccaatgttagcaaaactttttgtaattttaaggaagcctttatcgaagcccttaataaaagagaaaagatactattggacaaagccaaaaagacaaaaattgaagccctggctcctctaagagaatgccgcagcatgattttagataaaattgaatctacagttaaattaattaatactgggtcagcaataattagctccnnnnnnnnnnnnnnnnnnnnnnnnnnnnnnnnngcaagcttattgggaactcttccggaagttccagagctcaaagaagtgccttatataagttttagttatgaaccatctctagaaattgaaatagtggataaattgtctgagttaggagatatttataagattcctccagtacaggtagctgaattaacagaaaaacctggagcagttttagtagaatggaaagttgtggttgataatgaagaaaaggtaactgatatagaagaatttaggcttncaaaggcactaggaaatgtacacgaagataaacatttagttgtcaattttcatgatgcttacaaaggtctagattgccagttcctccannaagatcttagagtcaacgaacagtattcctttagagttntgtgtaaattcgaaggtacaaccgaatggtctccatgntctttgccctcagtaggttctaccagtcttaaacccttttc

SEQ ID NO: 11007 - DNA, 1196 bp, Diabrotica virgifera
  misc_feature (99)..(118): n is a, c, g, or t
  misc_feature (984)..(1012): n is a, c, g, or t
  misc_feature (1056)..(1076): n is a, c, g, or t
  misc_feature (1107)..(1146): n is a, c, g, or t
  misc_feature (1178)..(1194): n is a, c, g, or t
cccacgcgtccgcttttcgggacaccctgtatatcttcgagtataattcactacaatgtgtttttccaatttttttacgaggaatcattttctttgatnnnnnnnnnnnnnnnnnnnncttgaaaaactcctttcaacatcaacagaagtaattgggacgtatttaaaataacttgttaaagccgaaaattctgcaccaaaatcaatttcaaaatttccattaaaaatttcgcatgtcctccaaagttttaaagccattatttttttctagaaccaattctaatttcttttttactgaattaccgatttcaccaggaactttcgaaatgtttgctttaaaatttctaactatttcgacggactctgttaaagacattttccgcttttctaaattatttatggtttttgtttttactataaaactataatgcgtattgattcttgataaaagttagctgctttgccaatgaagttgttttaacaatatgttgtgcttttataatagcagcactgtcttcggcgttaaattctaaaagcagttccttaattgcgacaaaatgttcagcataagaaattgcagcttccaaccaagttccccacctagtcagtactggttcgggaggtaaaggtacattaggtaatttgtttctgtacaactggacccgcaaaggacttttgacgaatactttttttacgctacttattagtacatttacatcagggaattcacccctagtatgctccgttaataatttccgttagaaaatcgtaaaactatggttaaaggtgtaaattctcttaacaataggggatttaaaagaatcaccagaattataggtacctactaaatataataaaagtaaataaaatttcggatttcccggaaaacaatccttcttcatttttaccatcctaccatcatttttataaccggcggacttataagcaactataattaattacttttgggtaaagaatcgggtnnnnnnnnnnnnnnnnnnnnnnnnnnnnngaagggaaatggaagccggaattcccgtccggggtaaattcctnnnnnnnnnnnnnnnnnnnnntgggggcgggggaaaaaattttttgggggtnnnnnnnnnnnnnnnnnnnnnnnnnnnnnnnnnnnnnnnncttttaaaatggtttttttataaaggggggcnnnnnnnnnnnnnnnnntc

SEQ ID NO: 11008 - DNA, 186 bp, Diabrotica virgifera
  misc_feature (2)..(63): n is a, c, g, or t
  misc_feature (69)..(97): n is a, c, g, or t
  misc_feature (114)..(133): n is a, c, g, or t
  misc_feature (145)..(162): n is a, c, g, or t
gnnnnnnnnnnnnnnnnnnnnnnnnnnnnnnnnnnnnnnnnnnnnnnnnnnnnnnnnnnnnnncccacnnnnnnnnnnnnnnnnnnnnnnnnnnnnnctaagggataaaaggcnnnnnnnnnnnnnnnnnnnngttccaaactcnnnnnnnnnnnnnnnnnncgcccccccatggtggggattaaa

SEQ ID NO: 11009 - DNA, 462 bp, Diabrotica virgifera
  misc_feature (10)..(10): n is a, c, g, or t
  misc_feature (17)..(17): n is a, c, g, or t
  misc_feature (113)..(144): n is a, c, g, or t
  misc_feature (336)..(368): n is a, c, g, or t
ttgcggccgngcagagngcaaaaaaacgaaaagacgagccctttaccacttcaaagatgattaagtggtggttactcaggattggcgagagaacattctattttgataaaagnnnnnnnnnnnnnnnnnnnnnnnnnnnnnnnnaattattagtcactaataatctatttattattgtcgaatttataagacctagagagttaaaacttttattgtgaaataaagattttacacactgtttttgtatggaaatgtgtttcgaggggaaatatatctcatttgtgaagagataaatgacatctatttattaacactatattcataagtagccattcnnnnnnnnnnnnnnnnnnnnnnnnnnnnnnnnncccttagtgctaaaactttattaatatttaactcttaaatacaaactaggattagctgattttcgtattttattatatgttatcatttatttct

SEQ ID NO: 11010 - DNA, 192 bp, Diabrotica virgifera
accccctttacgggcgaatactgatgaaaaagagcagaaggtcctcctttttatcatccaagaatttcaattttatgtttttaacgacttgagagaagaatgtgtgtagtgcatttaatatatttcgccttgagatctttcttccacaacactgaccatatacaaaggatagtgcaatgggtcttcccgaat

SEQ ID NO: 11011 - DNA, 378 bp, Diabrotica virgifera
  misc_feature (69)..(91): n is a, c, g, or t
  misc_feature (259)..(283): n is a, c, g, or t
ggtagttgaaattttattttttatgtaaatccttttttcatcgactatagtatacaagacaagcagctnnnnnnnnnnnnnnnnnnnnnnncaagctatggaaatagttgccgcgaagagtccttgtacaagtgctgtaactgtaacattaatacgcccgcccgcttgccgggggcctccattccagagaacacacgacaatccacaacatcctcactatcgtccaacccacctcctgataaagttcccaaaagaaagnnnnnnnnnnnnnnnnnnnnnnnnngtattggaaaatttagccaatacggacatgaatcgtgtatagaggagcgcaacgtcagattccctcgtgcccgcccaaatgcaacgaccaccttt

SEQ ID NO: 11012 - DNA, 963 bp, Diabrotica virgifera
  misc_feature (33)..(57): n is a, c, g, or t
  misc_feature (120)..(139): n is a, c, g, or t
  misc_feature (168)..(190): n is a, c, g, or t
  misc_feature (295)..(334): n is a, c, g, or t
  misc_feature (435)..(458): n is a, c, g, or t
  misc_feature (674)..(697): n is a, c, g, or t
  misc_feature (710)..(727): n is a, c, g, or t
  misc_feature (768)..(790): n is a, c, g, or t
cccacgcgtccgaatcataaagatattggaacnnnnnnnnnnnnnnnnnnnnnnnnngcaggaatggtaggaacttcattaagaattttagtacgagcagaattaggaaggcccggatcnnnnnnnnnnnnnnnnnnnntttataatgttattgttacagctcatgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnnggcatcctgaagnnnnnnnnnnnnnnnnnnccaggatttggatttaattttctcttatttgtaaggcaagnnnnnnnnnnnnnnnnnnnnnnntttggtactttaggaaataatttattggtataaaaagcaattgggttaattaggtttaattggttgagcttctcctaaaatttacagtaggaatggatgttgataccccgaagcttatttacctcccccaccaattacttttggtggccccacctggaaatttaaggcattta

SEQ ID NO: 11013 - DNA, 526 bp, Diabrotica virgifera
  misc_feature (285)..(305): n is a, c, g, or t
taacagcgtaattttattatcgatttgaactctccaaaaaaattacgctgttatctttaagagaacttgattgtaaaggtcaaaactgacacaggcaaagggttcgaagatggaagggagagaaagcgcaactgccagtctccgggatgcaggtcttaaagtgaaagatgtcggggaactggtaatagccccatagatctctcggtggaagagaggacacgctactccctggtgggcagggaggaaagctaacaatattgataacatcgaaccagaaaaatctcnnnnnnnnnnnnnnnnnnnnnattagagtagtactgccgcaactaaaaacccatacgtacacactggatcaaacccgaaaggaacgctataggatgctgcagagaaaatccacattgcggcggggacactattgagagcagcttgccaaaagaccattaaggagatacggttatttacgactcccgggattaaacgaaagaaatttagggatttaaaaattccccaagaaagaaccctcatt

SEQ ID NO: 11014 - DNA, 393 bp, Diabrotica virgifera
  misc_feature (2)..(292): n is a, c, g, or t
  misc_feature (296)..(391): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 11015 - DNA, 233 bp, Diabrotica virgifera
  misc_feature (5)..(232): n is a, c, g, or t
gttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 11016 - DNA, 153 bp, Diabrotica virgifera
  misc_feature (132)..(151): n is a, c, g, or t
tttaagggataaacagggtaatttttttggaaaaggttcaattccataaaaaaaaaatgcgaacccccatgtttggatttaaactttttaatttgggggccagcagctttattattataatctttgttctannnnnnnnnnnnnnnnnnnnct

SEQ ID NO: 11017 - DNA, 714 bp, Diabrotica virgifera
cccactgttccgtggggtgattggcggttttatctgtttttaactttataactatgcaatttctttgtttggcggtcgctttccaaataacaccaaatattatatctattttaccttttttcatttccatttgtttttaattggtttaattattgtttaaaaaactgctcgataaaacaccataatatttatttactctaaactttgttttagcaagaatgtatgacttcatgtactccatcacttgcaacaaaccctggacatactctctgccatatatgcagcactctatttacaactcggccttctctaaatcgtcttatcaaaataatacatacgatagatgagacgactaacaatatgaatctttgtcacattatttgtcccttatgtgagcatgatactaatgttaatagacatgagaatctacaaaaacatctccaggagcttcaccaagtgagtattgaacttataacatttgaattttctaacgaaccataatatgatacgtggaaagatatgccgagaattgagactcgttatgtatctcatagaacgattcgtagaatggagcattatataatgtactatgattgtctccgaagagatctacacggatataaacccaactatgagattacgacagagacagctggtgtatcaattaagagtacatcgagtgtgtacttccaggcttatatgccaactgagaga

SEQ ID NO: 11018 - DNA, 804 bp, Diabrotica virgifera
  misc_feature (636)..(636): n is a, c, g, or t
gacctacaaaaatattgacctattgtatataaaaaatatagataagtgataataagaataattaacaggtaaaacatggttgatttaaagaaagacttggacgaatatttgctattacatagtgaccaaaaaaagtcttttaatttgcaaatgccgtcaattgaagcaccaagtataactaggtggtttaagaaagaatctttacaacaggaagaccatacttggtgtcaaaggattaccaatcagtgttttcccactttgatttcaacgaatagttttctttgcagtgtgcattggacttggatttttatgttttttgatgtcctcaatatatattcctgtacttgtgtttaaagctagaaaatttgcattgttatttaccctagggagcatattttttgttttaggattctttttcctatggggtccgcttgcatttataagatacatgtttgcaagagaaagactactagtaaccgtaacttatggaggaagtttagccgccactttattctgcgctctacatcttcagaatttaccatttacaattctttttgctgtgttacaaatagtttcacttctttggagtttaatagcgattatacctggtggaacaagtggactttcttttactanaaaagtattatgtcgttcatctatgagcagcttgccaatttaaatatacaatgagtgcggtaataaccggcaaggtagcggaagagacggaaagcataatgcgctgtggaatgaggggagatggaactggtagagatgggaaattatcagtgggaacctataaacttg

SEQ ID NO: 11019 - DNA, 386 bp, Diabrotica virgifera
  misc_feature (15)..(15): n is a, c, g, or t
  misc_feature (28)..(28): n is a, c, g, or t
  misc_feature (39)..(39): n is a, c, g, or t
  misc_feature (41)..(41): n is a, c, g, or t
  misc_feature (55)..(55): n is a, c, g, or t
  misc_feature (58)..(58): n is a, c, g, or t
  misc_feature (67)..(68): n is a, c, g, or t
  misc_feature (75)..(75): n is a, c, g, or t
  misc_feature (91)..(116): n is a, c, g, or t
  misc_feature (168)..(186): n is a, c, g, or t
  misc_feature (189)..(251): n is a, c, g, or t
  misc_feature (254)..(308): n is a, c, g, or t
  misc_feature (334)..(357): n is a, c, g, or t
tcataaagggcgaanaattctaaaaaanaaagaattatnangccttttgagcatnaantagaggaannggagganaaaaggaaattagggnnnnnnnnnnnnnnnnnnnnnnnnnnatccctaatattgtttgaatattggatagtatattaatttataagataattnnnnnnnnnnnnnnnnnnntgnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnngtgatattattaggaggattagaatnnnnnnnnnnnnnnnnnnnnnnnngattgggaatgaattatttagttgataat

SEQ ID NO: 11020 - DNA, 401 bp, Diabrotica virgifera
  misc_feature (6)..(26): n is a, c, g, or t
  misc_feature (77)..(105): n is a, c, g, or t
ttatgnnnnnnnnnnnnnnnnnnnnntggaaactaatagtacaagtaaaaattttaccaaaaggcagttaaggaatnnnnnnnnnnnnnnnnnnnnnnnnnnnnntccctataatggaagatttaggccagaagatgattatgcgtttaaaaaacattattatcgacaagaaagagggtccaaaaaatataaatggaaaagaaagtcaaggccttcatcccccatggaaggtagtgaagagtatatgtctcagaaaatacaaaaaaactagtgccatcataatgcgtcatttattaagtccagacgaaaacattatttccacttaaaaaggatgtaaatatgcctagagaaagctcccatttaatgacatcccaaaatatcccatgaaagaaaaagatcta

SEQ ID NO: 11021 - DNA, 954 bp, Diabrotica virgifera
  misc_feature (10)..(43): n is a, c, g, or t
  misc_feature (474)..(495): n is a, c, g, or t
  misc_feature (779)..(779): n is a, c, g, or t
atttagaatnnnnnnnnnnnnnnnnnnnnnnnnnnnnnnnnnncaataccattaactcgcgaagttaaaaaatgtggtgttatcatgccataattgatggaattaatatggactcataactgacaagaataataaaatggataattctcaaaagtacataacaatatctgtagcagcatttatttgttactgcaatactctcggaggatcgtttgtttttgatgacaatgaagctattataaaaaataaagatgtgatgccacatactcccattttgaatatattcaaaaatgatttttggggaacagatattactttgaacagcagtcataagtcttacaggccacttacaattttatcttacagattaaatgtactttattctaagaataaactggatgcgtttcaattccatgcaacaaacataatcctctatggacttctatgcctactaacagtacctgtttttgaacnnnnnnnnnnnnnnnnnnnnnntgctactaatatccacgacgttgccttcctgtctggcttactgtttactgtacaccctgtacatacagaagcagtagctggtttggtaggcagagccgatattttgagctcagtattattttttgtggtcattttactgtttcataaatttagaaatagttttggagaaagtgtaattttttggtatattctggtagctatattaacgtgttgtgctgtcctttgtaaagaaactgccatagctgtagtgggtgtgctgattctctatgatgtatacagagaanagcgaaaatcagtctcatgggcagaaatgtaaagattttggttgatagtaaaatgcatgttagttctgataatgggatcagtataatgtattttcgtttagaatatgaaaatttgaaggtccctatttactataaggatatccggcagctatgctcaactggttttacaagggtt

SEQ ID NO: 11022 - DNA, 362 bp, Diabrotica virgifera
gagattatatttaataatctcacatattatgtactagctttatcgtacagatgccaccaccaattacagggaagcatccttgtagacagtgcagtagaaatccatgtaaaacaaactgatttgattgtcaaaagcatcaatgtaaacctcctagatggcatcgcgctaaacctccaccgcgacttacctgctctattcttttccattcagtacaatgtgtttattttacatggatgtcgacatgaccgtgacctccaccaccactgcgacctacttgttctgttcatacacttacactattgtattattattcttgaatatacactgcggtgcaaaaaaatcgatccgctaaaactttggcc

SEQ ID NO: 11023 - DNA, 467 bp, Diabrotica virgifera
  misc_feature (7)..(26): n is a, c, g, or t
tcctttnnnnnnnnnnnnnnnnnnnngaggatacggtgagatccttttttcatccaatataggaaagtgagacatgcagcttaaggttttaggcgtggatcacatcaagagagcaatattgtcttttcaaagaggcccacagacaattattttcctagtaacattaggacacgagcttgatatgcgagagcctctaatgcaatgaacataccaacaaccataaatattcacaagcggttatgaaagggttatatatagttccctacaacaacaaatatttctgcttatgcaaagcgttgttagggaagtatttaagccgaagttgccatgtatctcttcgacacaaccgcaatcttagattaccacgtgagtgagtaatggaacgattaagtttttatagagggatccaaaatatgaaaatgtcaatctattattctcaaaagcatgaatactaagccagtgttcct

SEQ ID NO: 11024 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11025 - DNA, 925 bp, Diabrotica virgifera
  misc_feature (76)..(96): n is a, c, g, or t
  misc_feature (102)..(121): n is a, c, g, or t
  misc_feature (781)..(799): n is a, c, g, or t
  misc_feature (868)..(909): n is a, c, g, or t
tttttgattatgtttaaagttttatctaatggcacatttgtaaataaactgtttatgtcaaaacttactaaaatannnnnnnnnnnnnnnnnnnnntttgannnnnnnnnnnnnnnnnnnngtgtattttttataaatgtgtcattattatttgcaaatggttttccctcgtgatttactatggagtctctggcgcgagagtttcggtgccgccgttgcatttggttgtctttttgaggacggatcacatgctatggttttttgtggcggatgttcttgagttgggattgatttcgtgtggtcgagtgaactatcttttggtggggtcgtcccgggaacgcggctcatcaatgttggcaatgtcattttaaagttgtctactttaaagtgtataatgcgtgtctgaattgccgatatgagtgagtcagattgggtggattattggaagaattttttactaagcaacaacgtttttgtttatttggtattgttttgtattttgacagcgacacccgacttgggcgtcgaaacgttgataaggtcgtttttaggtggaattgtggcttgtttcccatttgaatatacttgattataaaaataccataagaaaatagcttcagaacaacatttttaaaaatgttgttcagttggtgactagtcgtggtaagtgaagggggagctgggagccgacaaatgcatgagttcaaaaactaaaaaaggcaacttaaaactacatactatcattttctatatctcgggatctactgaatatatcttgatnnnnnnnnnnnnnnnnnnnatgtaatttttctgtacattgcaaacatgtaatttgtgtatttgaaatttgacatttattaattggtgnnnnnnnnnnnnnnnnnnnnnnnnnnnnnnnnnnnnnnnnnnccaaaaatcctgtttt

SEQ ID NO: 11026 - DNA, 942 bp, Diabrotica virgifera
  misc_feature (779)..(779): n is a, c, g, or t
  misc_feature (837)..(837): n is a, c, g, or t
  misc_feature (882)..(882): n is a, c, g, or t
ctttcattttacatcatgctgacgttctggttactagcggttattatagctctcttttactactatgctatacgaccaatgagttattggagacgaaaaggagttatatcagaggatggttattggctttttggaagtcaattaagggtactttttaatttagaaagttcttacgagatgttgcaacgagtctatcaactagctccaaatgcaaggtatataggaatgtacgaacttacaacaccagttctaatgataaaaaatccaaagcttttgaaacaaatcactgtgaaggaatttgaccattttgccaatcataaagccgttatacccgaaggagctgattcactttggtcaaataatctgctgtcacttaaagatgagcgatggaaagaaattagagcagtacttagtccttctttcactagcagcaagatgaagatgatgttcgaccttatgagtgaattctcgaaaaaccttgtacaacatttttcaaaaataaatgaagatatcattgaaattaatacaaaagatgcaacttccagatttgccaatgatataattgcttccactgcttttggtgtcagtacagattctctaaacaaccccaatgacgagttttactcgatggctggcaatcttaccaattttacattatgggccaatctgaaggtgattggatttgtatttatgccaaaattattgaagctactaaaagccaacgttttttatagtcctgcacgaagattctttattgatattatagaaagtaccattanagcaagggaagaaagaaacataaaacgtccagatatgttaaatcttctactccaagcntagaacggcgacaagaacaaagatgaaaataaatcaaaacacganagtaaaaatgtaagcatcaccaatgaagacataatttcccatgctctcgtctcttccttg

SEQ ID NO: 11027 - DNA, 201 bp, Diabrotica virgifera
  misc_feature (7)..(44): n is a, c, g, or t
  misc_feature (66)..(66): n is a, c, g, or t
  misc_feature (80)..(97): n is a, c, g, or t
  misc_feature (111)..(133): n is a, c, g, or t
  misc_feature (167)..(197): n is a, c, g, or t
taacagnnnnnnnnnnnnnnnnnnnnnnnnnnnnnnnnnnnnnntgcgacctcgatgttggattanagtttataattggnnnnnnnnnnnnnnnnnntaagtctgttcgannnnnnnnnnnnnnnnnnnnnnnagtttaaaccggtgtgagccaagttggtttctannnnnnnnnnnnnnnnnnnnnnnnnnnnnnnaagg

SEQ ID NO: 11028 - DNA, 293 bp, Diabrotica virgifera
  misc_feature (2)..(94): n is a, c, g, or t
  misc_feature (101)..(138): n is a, c, g, or t
  misc_feature (158)..(171): n is a, c, g, or t
  misc_feature (174)..(196): n is a, c, g, or t
  misc_feature (204)..(226): n is a, c, g, or t
  misc_feature (256)..(287): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11029 - DNA, 178 bp, Diabrotica virgifera
  misc_feature (13)..(78): n is a, c, g, or t
  misc_feature (91)..(91): n is a, c, g, or t
  misc_feature (93)..(177): n is a, c, g, or t
aagacgagaagannnnnnnnnnnnnnnnnnnnnnnnnnnnnnnnnnnnnnnnnnnnnnnnnnnnnnnnnnnnnnnnnnaatttatttaatngnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 11030 - DNA, 594 bp, Diabrotica virgifera
  misc_feature (266)..(284): n is a, c, g, or t
atcctttgatacatgttgctgacgttgatgttgctccttgtaataactgctcccttaaagtaccatacaatgctacctcttcctgatcccagaagatgagcaaacatgtcacatcatgcaacatacagttactctaaagcgattaactcattcttatttcttcagatgggaacttggaccagcaacgacattacaatctgactgcttcgatgctagaacttttgcaaaggacattgcatggatgccgtttccttggaaacacctcnnnnnnnnnnnnnnnnnnnacacaggatagctatatgcaatgttcgccacatctggacttctgataacgatgcaactttgctggttgcgaacgaactcatctacagccaccaaatatcaacaggatgaatctgtacaggatctgttgctactattgtacctaccactcaaataaataccgacgatcgaagttatactgaagtctctggacaactacaaccgcactatacagaaacggcacaaggtaacgatgaatcctgcccatccaacttaaataacttctacgacgatgatatcatatgttacgatgctgcttgtcaccacactaaa

SEQ ID NO: 11031 - DNA, 425 bp, Diabrotica virgifera
  misc_feature (53)..(67): n is a, c, g, or t
ggattattacctatgaaattcttcgttcgcctttcttctttttgttctttgcnnnnnnnnnnnnnnncatcataagcaaaacaaatatgatgaatcaatagagcgctgttcaaggaaattatccttacaacaccttttgaaagacatatagccaacagggttaaggaaaacaactgtggatccagctgcgctcaacatgggcaagacaatccagctgataattactggagacaatacgcacaaggaataaactaagttgttggagctactgcaccatggatctaaccattactggtataaccaccattactaaaatttgaagtcttgtagctcgagtctcacttcgtcgtacttatatgaaaaaaccaccattcattggaactctattgtaactctttatgtgcagccctgaacatttatttgca

SEQ ID NO: 11032 - DNA, 237 bp, Diabrotica virgifera
  misc_feature (6)..(6): n is a, c, g, or t
  misc_feature (72)..(72): n is a, c, g, or t
  misc_feature (192)..(226): n is a, c, g, or t
accttnagggataacagcgtaatttttattggaagagtcaaatcgattataaaagatgccgacctcgatggntgggataaaagtttataatttggtgtagcagcttattattattaagtcttgttcgacttttaaaattttaacatgatctgagagttaaacggggggggggggcccgggtggggttttcannnnnnnnnnnnnnnnnnnnnnnnnnnnnnnnnnncaaagggagcc

SEQ ID NO: 11033 - DNA, 447 bp, Diabrotica virgifera
  misc_feature (57)..(75): n is a, c, g, or t
  misc_feature (343)..(399): n is a, c, g, or t
cggacgcgtgggtgaaattatattatgacctgctgtcacagccatccagatcactcnnnnnnnnnnnnnnnnnnncacaggtaccttttgaagcctgtctggtaaacttgggaaaaggagaacatttgaagaaggaatatctagaaaatgtttcacggattccaaaagtgcctgtagtacatgatggagacttcagactgaatgaaagcgttggtatagtgaggtacatctccaggcagtatccagttgcagacaacttgtatccaaaagacagcaaaaaacaagcactagtagatgaattttggaatggcaccacttaaatgttagagtaaattgttctacnnnnnnnnnnnnnnnnnnnnnnnnnnnnnnnnnnnnnnnnnnnnnnnnnnnnnnnnnaaagacgaaagcaagaggaaaagagacagaaacaagaagagaagagac

SEQ ID NO: 11034 - DNA, 307 bp, Diabrotica virgifera
ggaatttgataaatatttgattctcattttcttttttttacagcaattttattggagaaatcgtataattacaccagatgttctgggctcagactcgatattattttttaattcacagacataacacagaacaagatactgagatagaacgatatgacactggagctggactacaaagattctatgctctacgttcttggtcctacattatgttaattgctcgagtactatgacttaggaagagaaacacttgccgatgccagatacttgccagagatatacgtcaccgaggtagtggaaaatataa

SEQ ID NO: 11035 - DNA, 711 bp, Diabrotica virgifera
  misc_feature (397)..(414): n is a, c, g, or t
  misc_feature (420)..(437): n is a, c, g, or t
gacccacgcgtccgcattaacgtgtgtgcctaattgtaggtaaacgtagatacattttatctatccctcctggtcccgccaggtgtaatcataaaattcgttatcaggaaatgctcaaattgtattttctaatctaatacaagttcaacgcagacgttttggagtaaatacctatgaaattcttgaatcataacttagtcgctgtatatctttgatctcggatagagaagtatgcctgacataaatttcacgaaacaagatacaacaatttacgtcgtcattcttgttgtgatgtataaaacgccgaaggcattgaacaaagacaattgatattaaaactaatcaagtcttacgatcgcgcctttaccgcataagtactatctataataatgactcnnnnnnnnnnnnnnnnnngaatcnnnnnnnnnnnnnnnnnnattccattcgtttttgtataagaacatatctggcgaaaatttaataatatacgagataattcaataattatgctcaaactgttattttcctccaaaactcggataatatcgacggcacgaaaataacttgcagtaaattgaatttatagataatctaattttgcaccatttctgttccctaaattctgtcaaaatttttaaattgttcgagataatgagccaataatggctctcatcaaaaatcaagatgactgctactgcatagcggtattca

SEQ ID NO: 11036 - DNA, 918 bp, Diabrotica virgifera
  misc_feature (420)..(437): n is a, c, g, or t
  misc_feature (751)..(751): n is a, c, g, or t
  misc_feature (868)..(868): n is a, c, g, or t
ggctgatgacgtcgtcgtctagggttcgttaatcgcttatgtctcgttatggttgtcaaagacgtaggtccttaaatgttgattgtaacacaaacatcgaagaaattaaaattgcatacaacttcattctctctatttttattattcacttaagtagcaaagttaataaaaaataagataattcaataatcacacttagtcactgtttttcgtttaactcggaaaaaatcggctgcatgaaaaaattttcaagaaacaaattgcaacaatttaagtcgtcacacttgttgtgatgttgaaaatggcgaaggtattgaacaaaaacaattgctataaaactaatcaagtcttacgctcgcgcctttaccgcataagtactaccttaaatattgactctagcaaaaaaaattaaaggaatcnnnnnnnnnnnnnnnnnnattctattcgtttttgtatatgtacatttctggcgaaaaaccaataataaacgagataattcaataattatgctcaaactgttattttcctccagaactcggaaaatatcgaccgcacgaaaaaaaattgcaataaaatgaattatagaaaatctaattttcaaccatttcagttctcatactttttgtcaaaaagttgaaaatgtccgagatattgagcaaaaatggctctcatcaaaaatcaagatgacggctaacgcaatagcggaattcagtcgcgattctaagtttaaactaatactgacctcccctanagagtagaaaaatacaatttggggtagctcggcatgcaaggtcaaatgctatcacgactagactatgtgtttataaaaataattgctagaaatcgatcttttttaagaacacagcangctttgacgagatcctgttatccacaatgaaaaggtaactgatcctgact

SEQ ID NO: 11037 - DNA, 280 bp, Diabrotica virgifera
  misc_feature (13)..(40): n is a, c, g, or t
tcttcgcccgcgnnnnnnnnnnnnnnnnnnnnnnnnnnnnctgtaagacaagaaacaattaaattgatgaaaggtaaagatgggagagatggaaattcatattttattttgacaaaagcaaaatagtattgtctgtgacttgtagctgagcaataatcgatgatataataatgattttgatataaacgaattgaatagagattaaaatttttggattaaaatgtaaaagagatatattcattgctggtagtgatgtgatacggattttaattttatctta

SEQ ID NO: 11038 - DNA, 737 bp, Diabrotica virgifera
tttcgtccggtttatgtaatatgttccaatcactaaaatgacaccactcaacatttttatctttttattttcattttggacttgtgggttggctactgttatatacttgcccgaacacaaaatgtctaacaaatacgaatttattcctataagtgatcctttggattgcggaactcgaatccattatgacgaatgtacaaatagcgcctttttcgtggatgtcccgaacggcaatgcttatagatatgatttgggatctggcaacgttacaaaaactaaagttggaaatgagccgatcgcctttatgttcccagtagtgggatccaacaacaaatttatagcgggtcttaacaacaaatttgtatcagttgaatgggatggtgttagtcctcaagtctccaaagtaaaaaccattaaagaaattgaaaccgatccccaattaaagggtaacagattaaatggtggcaaggttgatccttgggggagactatgggcaggtactatgggtccagctggcgctgatggagaaactataccccagaagggagccctgtatagtgttgaaaagggatctgtcaaaaaacatctttccaatatccgaatttcaaatggactggcttggaatactaagaagatgaaaatgtactacctagacacactaccaccccaagtttttccatacgatatttccaaggacggcgatttaagtaaccaaaaagttatttttgaatttgggc

SEQ ID NO: 11039 - DNA, 239 bp, Diabrotica virgifera
  misc_feature (28)..(47): n is a, c, g, or t
gggggggccgggccggaatccccggggnnnnnnnnnnnnnnnnnnnnaggagagatggaaagattgtcttgtatatctatacataaacgttattgttctcacacgcctagtagttactgaaggcactccacccaatagacaacccgatcataaatattttactatatttgatattagactattctaattcagaattaaattcgaataaaaaatctattaattaacattcgagagatgcc

SEQ ID NO: 11040 - DNA, 1069 bp, Diabrotica virgifera
  misc_feature (475)..(496): n is a, c, g, or t
caaagcctcactcaagctgaattcaacgccaaatagcctaaaatgagtaaaaatgttaatttcacagatttgaaggaggaagtacaatttcgcctgtgaaatgagtgtttccattcatttctgcggtttgctaatgtaacctttattattatctgggtagttgccaccacgaaataatcatgagtaaattttcgtcgtttatcgaacttttagttaaacaaacgtgtcggcgagcctcgcacgaatttgaattggaatcaaaacaacagtcggctccccaagttgtcagagcagtccaagatgatgtcggtatctattccctcgaattccttaaggctcttcatgataacaccagagacagtctttacaaactaataaggactaaggatccaaatgacccaaatagtgtggaagttcctgtaggcttaaattggctgaacaacaaagacttcactgctccagaaagaaaagcacnnnnnnnnnnnnnnnnnnnnnncaaagatatggcccccagtaactccaaaaattggattgatctacatcacttcacgcattatgtctatagaaacttcgctagtgtgagtcccgaccctaccgctgaatatttgacgccttatttcttggatgagatgcgaggattagtacgcagtttgatccaagaagacaagagccaactatatttaagagtattggctttattaagggaatattgcatttttgccccatggaattacactaagcaagaaagagaagaccatctttattactaaactgttttattactatgaagccctgttgacagcccccaaaaattttagcgacgtatttgctgatattgaaataattctccataacaatatttctatttggtggaaagaatttaacaccttgggatttcttagaaaatttttttggagaacgactttggcccacaaaaaaaataaaccaagttttttaaaaacaccaaataaagccccgggggaatactccctgcccccggtttgttttttttcaaaaaactttacaccaaaattctttggacttcgcgcacccacaaccccccattttt

SEQ ID NO: 11041 - DNA, 287 bp, Diabrotica virgifera
  misc_feature (2)..(103): n is a, c, g, or t
  misc_feature (105)..(161): n is a, c, g, or t
  misc_feature (173)..(190): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnacattttttggnnnnnnnnnnnnnnnnnnctaagggataacggggtaattttttttgggaagttcaaatcgaaaaaaaaattgccaccccccaggtgggatttaagattcttaattggggggaaaa

SEQ ID NO: 11042 - DNA, 229 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (165)..(192): n is a, c, g, or t
  misc_feature (201)..(228): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntggtcgannnnnnnnnnnnnnnnnnnnnnagtttaaaccggtgtgagccaggttggtttctannnnnnnnnnnnnnnnnnnnnnnnnnnngaaagaccnnnnnnnnnnnnnnnnnnnnnnnnnnnnt

SEQ ID NO: 11043 - DNA, 471 bp, Diabrotica virgifera
  misc_feature (56)..(73): n is a, c, g, or t
cgaacacgagttagtattatcttatgatctgttagttcatgcatccagatatgtcnnnnnnnnnnnnnnnnnngtactagtacctttagaattctgactggtaatcttgactaaaaggaaaattttgaataaatgaatatatataatatgtttctcgcatccctaaagagttcagtataacagtgataggatactttacagagctgaaatgattagacgaagcgatattgtggtacttctccaggtattagccatttgcatactactagtatccattagaccgaataaaacttagcactataatatgaatgataggatggaaccacttatacgtattagtaaattgttctacatattttatattaaaagaataagggataagatattaactggtttatctaggaagaataaagactgaagcattagggatagatatagaatcgaataatagaagagacaaaaggagaaaga

SEQ ID NO: 11044 - DNA, 182 bp, Diabrotica virgifera
  misc_feature (2)..(69): n is a, c, g, or t
  misc_feature (73)..(175): n is a, c, g, or t
gnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggg

SEQ ID NO: 11045 - DNA, 864 bp, Diabrotica virgifera
  misc_feature (572)..(591): n is a, c, g, or t
  misc_feature (704)..(734): n is a, c, g, or t
  misc_feature (818)..(849): n is a, c, g, or t
cggccatctatagagaatacctcagataacaggatccctaaccagatttttacgtggactcaacaagggagaaggaaaagaggaaggccgagaagaagctggagagagggaattgaaaaagaactagaggaaaaggaaatccctccaggtttatggttaaacagagaagaatggcaattaggagtcggaaagcgtcgaagtacactgtaaaccaatagtactaaaaaccaatagtactaaaaaaaaccaatagtagtaagccaggcggcttgtgaattgtattttcccaagcactgtattgtggacagcataaaaatttcatcaaaaatgaatggaaacaatcctatctgaatacccatatcatcaaggactgtagaaaatacaaagcaagtcaagaataaggaggaaatctgttgaagatgaggattctgtgaatattagaatattaaatttgagaaacagattaggaaagtcaaatagaggtatatgaccgctgatgatgatggagcaataacttctattgctccgtattaggtatcaacagatttttatttattctcattattaaaccnnnnnnnnnnnnnnnnnnnnaaaaggctttaattattaatgttccttctgtactatctttggagttacattgtttcttcacaaattgttatttttatcctctatgtgtttcttatagattttatagtatggcnnnnnnnnnnnnnnnnnnnnnnnnnnnnnnntttggatatttattttatttacaatatttttccagatattgtactgcatatcattatagtatcttgttaataatagttatttgnnnnnnnnnnnnnnnnnnnnnnnnnnnnnnnncactcaatcaaaata

SEQ ID NO: 11046 - DNA, 932 bp, Diabrotica virgifera
  misc_feature (9)..(824): n is a, c, g, or t
  misc_feature (832)..(931): n is a, c, g, or t
tttcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11047 - DNA, 55 bp, Diabrotica virgifera
cagcaatgatgataatattaggattagagaagtgtatatttatgtagcctatata

SEQ ID NO: 11048 - DNA, 103 bp, Diabrotica virgifera
  misc_feature (63)..(83): n is a, c, g, or t
cccctgccccctgattaattttgaatggccgccgtatttttgccgggggtaggaagcttaacnnnnnnnnnnnnnnnnnnnnngttgggaagaagggttgtac

SEQ ID NO: 11049 - DNA, 89 bp, Diabrotica virgifera
cgaagacgagtcatgaaatttttgattgttgcctcattggtgtttgtaccctgaatgttctttacacagatgctgtccacttctctttt

SEQ ID NO: 11050 - DNA, 828 bp, Diabrotica virgifera
  misc_feature (142)..(159): n is a, c, g, or t
  misc_feature (482)..(502): n is a, c, g, or t
  misc_feature (522)..(545): n is a, c, g, or t
cttccatttaaccaggtgctgagatggcgctgaaatacgtgacatattttttaaagagtaagatcgcattctaccaaatcacacaacacttttttctatggccgtgggtgggtcgttgtttgtattatttttgtgctttttnnnnnnnnnnnnnnnnnncggatacttttataatagctttaatagtattattaacatagtgaataaaatggtgtcctgtttttaacgcagttggagtagcagaaacaaatgtagataaaaaaatctgcaggaataacgtttcaattatgacagaagctccaaacaaatgactgtgaatgaaaagccctattaaaaggttagtatgcaaatatgtaaacgaaggcatgccctgtatttcagaaaataaattaatactattaataccctaataatactattcataaaaaatcttttaagtaacctagatataacaaagtgaatagaaggcataaatcagaagnnnnnnnnnnnnnnnnnnnnngttaataattggtcatatcnnnnnnnnnnnnnnnnnnnnnnnntgaataagccacaaacttcgcttattcctaactaaaatagtaaatagagataataacaataggatttgtaaaactaaagtaattctttttgcgtttttgctaatgtatgcctttataaaggtttgttcccaccatgaactttttggacgggccagaaaccgcccggaaatacttggaccgtttgtttgtgcgcgtgttcgaaaatggtttcgcccacttatttgtcccctggaaaaaaatttgaaaaacatgggtggaagttctaccctgtcataaaacattt

SEQ ID NO: 11051 - DNA, 422 bp, Diabrotica virgifera
ctgaattgaaattcagcagataaaatgaagctgttccacttaggattaattttgctcattgcgtagcaactccgagcagcggcagaacaaccgaacgcactcgctgttcttaaggaagtacttgccagtacggtaacaggcacagggaggatggctgaacggcagaagcgaagtatggagtgatcagcagaaatgataccaaagaagacgtcattgtgcaccaatcatccacaacaaaaaataccccgcctaaactttgttttttctctgttttacggggagaacgaacactttagcgcaggcggacgagaaaagggcaacgaggcgcgcaatgtaaacggccctaatggggacccaaaaaaaggttcgcctcatgctgccgaccgccgaagatgataccgccagtggaattaccctgacag

SEQ ID NO: 11052 - DNA, 897 bp, Diabrotica virgifera
  misc_feature (82)..(99): n is a, c, g, or t
  misc_feature (199)..(217): n is a, c, g, or t
  misc_feature (221)..(238): n is a, c, g, or t
  misc_feature (274)..(299): n is a, c, g, or t
tgatgaggcaaacacaatggccgaaagagacttagggtctacatttatgcttccacacactcatctgtataaaccagatagnnnnnnnnnnnnnnnnnnattcgaatcgctttagcaaaaaccacacaacaaattttgctacggtgatcgattcactcaaaaaaatgtgccttaaaagtttcgtgtcagtgcctgtggnnnnnnnnnnnnnnnnnnnctgnnnnnnnnnnnnnnnnnnatacaattgtttttaaactatcccctattgtataannnnnnnnnnnnnnnnnnnnnnnnnnctttagccataacatgttttgactgtacaaatgtgtggggatttttgaacaaaaaaaactattggaattttagatttgaatgttgagagaggtataagtgtaaatatgccttgcaaagatgtaaaaatactttcaaagacgatttttaagttttacaataatttatctccttgttaaaacaaattcaattttacgatcatctgcagaaattttattaaatttggcaacgtctaaggtttttcaaatatcccatattattcgtatttatttgtaggttgtttattatattaaacgacgaaaaacttactaatgaagtgattttattctaagttttaagtaaaatgtatcaaaatctcgttcttacttttttgaagtcttaaaacttcttaaagattgataaaataaatcaaatcataaggcaggggctggcctgggttgtcaatacatccagaatcacctctagaaataactcagtcatttcctgatcctttgtagttgctcaagttgctttgtagctgcatttctttcctcttactttacagctacttagaataatcgctaatcccaacaattgtaatcctctcctaaccccagcttt

SEQ ID NO: 11053 - DNA, 590 bp, Diabrotica virgifera
  misc_feature (254)..(273): n is a, c, g, or t
cgacttacttcgtgtgctttaaatgataacgcacgggtaaaggattcagggactcaacattttgtttaaatcccgtgcgtcatcatttaaagcatacgaaataactctgaaatttactgaacgcaacggcaagtggatattattccgatcacgggttatagtataaaatttgacgttatcaaataaatagaatgtcaaatgtaagttttgctttaaaattttggtgcataattacagctacctttgaagtagcnnnnnnnnnnnnnnnnnnnncactgattaatatataaataaacaatttataaaagaattcaataacatattttctttttgttattttattcactttggcggaaccttaaacacaagcagacttggagaactagtatgtcatgcattatcatcataagctaaagatgtgcttcgtgtgacggatgttgagattgcttctaagagattttagattcagatgaaaaataacagacagtaaatgtactggataacttttctttcagcccataaactactgactctgattctagcaaaaatagggaaggtagccagcgaacaacaacatatttacatatgta

SEQ ID NO: 11054 - DNA, 76 bp, Diabrotica virgifera
gcctgtgaggtacttttaaccggtagtgtacttttaacatattcttgcaatatggtgaaaattgaaattatcggtt

SEQ ID NO: 11055 - DNA, 877 bp, Diabrotica virgifera
  misc_feature (23)..(57): n is a, c, g, or t
  misc_feature (94)..(112): n is a, c, g, or t
  misc_feature (677)..(677): n is a, c, g, or t
agaaatacagaaaaaattcctannnnnnnnnnnnnnnnnnnnnnnnnnnnnnnnnnngtctggctaattggctcagccaaagccatcaagttcnnnnnnnnnnnnnnnnnnnagctttattgggacaaaagacaatacttttatcgacttccgatatgctttcttaactgcatcatataaatcttgatacttatttggttttgatttcaatactatttcttttatcaagtataaatacaatgtactaactaaataaaatagaatattttatttctattcattcttgtagaattgtttcacacatagtcttcagtaaataaatgagcagtttaatatttactgcttccagacgttgttctgtatagaagcgtttgtataaatacatagaacaatgttttattgttttttattctgtacaaaattgctagcaatattattaaggctgtgagtgataaaaacgaaacgtattttctaaaaaaacatcaaaattatattaatcacaacaattcaattgacagatgtacaataattaggtacttatctagactctgtaatctcgtctgctttttgttcctgcgcaactaatgttattttttgaatttaactgcaaaagtaaggaaattaaaatgtgaccacaaaataaaaagaaaagcattcttagaggtattaaaaactanaaagaaaacaaatacataaaaaattaatcaaggttgtctacagtccgcacttataatttttgtttttatggtatattacaaatcgctacacaatcgttgtatctacatgatattatacatgtacaacgtacgagaatgaattttgttcagggaaaatgggagacaaagtataagccatataacattccctttcgtatatc

SEQ ID NO: 11056 - DNA, 837 bp, Diabrotica virgifera
gcgaaaacattcttaattccaaacgatgtttgtaagaaatctggcattgctgggacatgggtaccattagatcacatctcgatttttggttatgagaagcgaaatattaaacaaaaggatgaacccagtcattttgcatcgactactccagtctccgtatttcatctcagacaggatgtagtattgtttcactcaatattaagaaaattagtgaatgaatcaaatggggtatttctttccatacaagccttagttgggaataaaacacctgatatacgttcagagttgttcaaaataagtaggcagtatcgttcaataagagcttgtctagaaaatctacaagacgaactcaccaagtccaaacccgaagataaaatcgagctacaaaattatatcacagtgttctattcaatcgaatgcatctggcacttatgtgaaatcctcttcatagacacagttcctggaaacgtagtgttatctcaggttttagagtgggtcaggttccatttcccagaacatgagagaaatgctgcagatatgcttgcggaaaataagatcggcttagaatcgaatccagaatattggaataccgttttgggggcattgttgcagggacgtattccacttgtgagggcactgttaaggcaacattctgcatctgacaatagtactttccgaatgggtgatcagattctgagagctatgcctatatttaatggtgcaagtgggactcctataaacgaattcaacatgcagtggaggcattggaccatggatgtacactcaaaaatcgaagccaaacttttcagttctgaacaaatttagatcttatgacta

SEQ ID NO: 11057 - DNA, 353 bp, Diabrotica virgifera
  misc_feature (15)..(16): n is a, c, g, or t
  misc_feature (24)..(24): n is a, c, g, or t
  misc_feature (28)..(28): n is a, c, g, or t
  misc_feature (31)..(31): n is a, c, g, or t
  misc_feature (36)..(36): n is a, c, g, or t
  misc_feature (38)..(38): n is a, c, g, or t
  misc_feature (50)..(50): n is a, c, g, or t
  misc_feature (54)..(54): n is a, c, g, or t
  misc_feature (56)..(56): n is a, c, g, or t
  misc_feature (68)..(68): n is a, c, g, or t
  misc_feature (74)..(74): n is a, c, g, or t
  misc_feature (80)..(80): n is a, c, g, or t
  misc_feature (86)..(86): n is a, c, g, or t
  misc_feature (89)..(89): n is a, c, g, or t
  misc_feature (107)..(107): n is a, c, g, or t
  misc_feature (152)..(152): n is a, c, g, or t
  misc_feature (170)..(170): n is a, c, g, or t
  misc_feature (186)..(186): n is a, c, g, or t
  misc_feature (205)..(205): n is a, c, g, or t
  misc_feature (214)..(214): n is a, c, g, or t
  misc_feature (219)..(219): n is a, c, g, or t
  misc_feature (239)..(239): n is a, c, g, or t
  misc_feature (241)..(241): n is a, c, g, or t
  misc_feature (248)..(248): n is a, c, g, or t
  misc_feature (253)..(253): n is a, c, g, or t
  misc_feature (257)..(257): n is a, c, g, or t
tcttgcggccgcatnnaaagaagnaganagnaaagngncagacctttagngagncnccaaaagaccgnagaggncgcgancgagancgnccccggaagaaccgaganaaccggaacaacaaaggcgagaacagcagagagaggagcaaaganagagggccccgggaaccnagaagcaggaggcccncccaaaacagagggaacgnaaccaacancccanaagaagaccgcgggcagganancaaagancgganccgnagcaaaagcggagacggaaacaacgaggagcgacccgaagaagacaacgacaagccgaggggcagcggcacagacgaaccaaacgacactgatctt

SEQ ID NO: 11058 - DNA, 959 bp, Diabrotica virgifera
  misc_feature (714)..(714): n is a, c, g, or t
cgaaaatgactctatttaataaaatgttttctgagtgataaaaatgactttaatgatttttttaaatacattgaaaacatggctattcttctttcatgttgttttcacagaattgctgtatcattattattttctgaacaataatgttgcgaaaaaaaagctctttgggataaacaaattgaataaaatttaaactaattgacgcatcgtcttaaaaatttttatgcattgtatggactgtttaactccagatatgactctattttagtaaaatgttttctgagtgataaaaatgactttttaatgatttttttaaatgcgttgaaaacatgactattcttctttcatgttgttttcgcggagttgctgtgtcattgttattttctggacaataatattgcgaaaaaagctctttgggataaacaaattgaataaaatttagactagttgacgcatcgtcttaaaaatttttatgcattgtagggactgtttaactccaaaaatgactctattttagtaaaatgttttctgagtgataaaaatgactttttaatgatttttttaaatgcgttgaaaacatgactattcttctttcatgttgttttcacagaattgctttatcattaatattttctgaacaataatattgcgaaaaaaagctccttgggataaacaaattgaataaaatttaaactaattgacgcatcgtcttanaattttttatgcattgtataactcaacttttcgtgcaacatgaaggtcctaaattcattttcgcaagagttatagggaattttttattttcgaaattttagttttattttgcaatatacgaagcaacaaataatcggaccaaattcaaaaacgctattttggacctggctcatctactagaggaaaatatatagataagacatttaatttttgacatttaaaattaacttatttgtaataactaa

SEQ ID NO: 11059 - DNA, 153 bp, Diabrotica virgifera
  misc_feature (5)..(97): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggtaaacaggggtatttttattggagagtttccaaccaaataataaaaatt

SEQ ID NO: 11060 - DNA, 270 bp, Diabrotica virgifera
acctccggtcgtcctcaggcacagaggcccttgtcttttgatctagccagtaccaaaaaaaacagcgccaccatgtacgcgatcaagaacaaaatgaatatattgacttttgaagaacgatatgcggtggataagggctgatgtccgaaaatattacatctttacttctaagctgttgttgcagaacgagataatggctacaagcatagcaaagtttaaattgtatacagatgtggaattatagaatgaaaaaagcgatcagataggtgc

SEQ ID NO: 11061 - DNA, 872 bp, Diabrotica virgifera
  misc_feature (413)..(441): n is a, c, g, or t
  misc_feature (443)..(471): n is a, c, g, or t
  misc_feature (548)..(572): n is a, c, g, or t
cccacgcgtccgaagattatcctataaatattgtcgtcaatgaatattattacgattgtctgaaccgttcacgatgaagagtttcctcagtattagcttcggacttttcctgtttttaggaatagaatcaaagtctttaaatgacaatattgttaaaaagcgagtatttgcggatctctatggaaaacttaacccaacggtaagaggagatcccggagaacccctcattttaacggacttgattgaagcaggaaaactggatgaagctcaagataaagctcgtgttcaaggattggacacggatattgaaagttactctgggtatttgactgttgataaagaacatgattctaatttgttcttctggttctttccttcacaaggcaatgcaagttttgacccggtagttctgnnnnnnnnnnnnnnnnnnnnnnnnnnnnntnnnnnnnnnnnnnnnnnnnnnnnnnnnnnggttctattaaaagacggcaagcttgatattagagagacaacttggaataagaacaactcacttatatacattgacnnnnnnnnnnnnnnnnnnnnnnnnnttaccactgatggatatgcttccaatcaaactaaagtagctgctgatttatatgaagccttacatcagttttttcaccctattttatcagtaccaacatcaagacttttacgttacaggagaatcttatgcaggaaaatatgttcctgctgtaagttataaaaatcattcagcaaatacggaatcaaagttgaagattaacctcaagggtttagttattgtgaatgggtcatactgatcctatttgaacagattccttatggctgaggtatgcgtatccaattggaggtatttgctttga

SEQ ID NO: 11062 - DNA, 954 bp, Diabrotica virgifera
  misc_feature (13)..(13): n is a, c, g, or t
  misc_feature (416)..(433): n is a, c, g, or t
  misc_feature (636)..(655): n is a, c, g, or t
  misc_feature (672)..(692): n is a, c, g, or t
  misc_feature (863)..(863): n is a, c, g, or t
  misc_feature (918)..(918): n is a, c, g, or t
acaaaacattctnttttatacaaattcaaaattaccttttacctccgaaaattgtatttaaaaaaaaggtctcgtgccatttttttcaaaagtgatggttttcgagttataagcgatttaaaatctgaaaaatgtgaaaatacctacgcattttcaatgtttgaaaactcatgtgtaaattattagttttcaggtcaccaagtgcctaaattgaagtttagaaattcaatttcaagattctgacgagtggtcgggacttacttcaatattgttctgaagctatttccttgtggaatttttatgattaactgtttagatgggagatgggccgcaattacattgaagaaataatttttataacgtttcgacgccgaaatcgggtgtcgtcaaaattcaaaatactactgtcgaaacgnnnnnnnnnnnnnnnnnncgatttaattgtggcttgtttcccatataaatggttaattattttaatatagaccgttgttttttaattgttaattattcgagtccactcgacttttaagtcgccgcacatcgcaatttatggtgcgtctctgtcgcacttattatacatattatacgtacttatgaaaaaaatgtccaacaaatacttcacatttattaagnnnnnnnnnnnnnnnnnnnncatatttttttcctaannnnnnnnnnnnnnnnnnnnncaattaattattgccaatgtgctaattaaaacgccaataaaaacaaacggtcgaaattgaagtaaaccccgatgactcgtcggaatcttcaaattgaatgtttaacttcaatattgaaggcagttgacaaccgcaaaaataataatgtacacatgaaattttcagcatcgnaaatgcttattttcgcatttttcagtatataaatcgcttaaaacttgaatctatncagttttgagaaaagtgacagaaatttttttttttt

SEQ ID NO: 11063 - DNA, 169 bp, Diabrotica virgifera
  misc_feature (46)..(67): n is a, c, g, or t
cgatagtaaattaataatgagaaaatataaatatctagcatagaannnnnnnnnnnnnnnnnnnnnnacgacacgttttttcttcgtttcagggcacctgggttataaatatttggcaaagagagcaaagggaattcactactctgaacacagatagcggacaactggt

SEQ ID NO: 11064 - DNA, 177 bp, Diabrotica virgifera
  misc_feature (2)..(63): n is a, c, g, or t
  misc_feature (67)..(91): n is a, c, g, or t
  misc_feature (104)..(124): n is a, c, g, or t
  misc_feature (127)..(171): n is a, c, g, or t
gnnnnnnnnnnnnnnnnnnnnnnnnnnnnnnnnnnnnnnnnnnnnnnnnnnnnnnnnnnnnnnagcnnnnnnnnnnnnnnnnnnnnnnnnnaacccaatagaannnnnnnnnnnnnnnnnnnnnggnnnnnnnnnnnnnnnnnnnnnnnnnnnnnnnnnnnnnnnnnnnnngggggg

SEQ ID NO: 11065 - DNA, 433 bp, Diabrotica virgifera
  misc_feature (71)..(90): n is a, c, g, or t
aaacgaggcgagatatcttcagaggtacatatactatcctatccaaccttcccggccttagcaaggctttnnnnnnnnnnnnnnnnnnnntaatggctgccctgaatgccaataggagaagtggaggtggtactgttgctgattttgaatatgctttgaagaggggtaggcctagtgcaaagagagaagctcagatagaggtttctaatgtcaaatgaacagacattggtggtcaagaaaatctgagtactatattaaaacaagcgattgaatggcctttaaagaatcctcaaagtttcattataccacgagttaccccaccaaaaggagtgccattgttcggaccacccggctgtactgaaacattgattgatacagctctggcctgagaaagtggtctaaccttttctgctataaaggtccggaaatgttt

SEQ ID NO: 11066 - DNA, 839 bp, Diabrotica virgifera
  misc_feature (664)..(680): n is a, c, g, or t
  misc_feature (750)..(750): n is a, c, g, or t
  misc_feature (792)..(792): n is a, c, g, or t
catcgttgcaggaatgattggttggttgcagaaacgcgggttttgtgatgtgcgaatgacggggtttagttttttaatgtgaggttgatatttttgatggcatcatttattattatggttaaaacttgcccggaatttatattacctattatctaattcaactgagtacttatttagtgtcataaatattgtgtattgttgatgagataaaacgatagaccatacagtgcgctaaaatgtcaacctccgcgtctcaacaaaactctccagtgtctttaaaccaagatatggcaacagatgttgccaccgaacgttctcaagttaccaaacgaccatcaaacctggacttaacaaaaaaatctcctagtcttgacttgccagactcttcagaacctcccacaccagttgcagactccaacattgcattgttacaagattttgaagactcagataatcaaataaaacctaaaaatgaaggtaatgtgatcaaaccaaaagtacaaatacatttagatgccaatcaaaactcaagccagtctctatcactagatacatctaattgctgtgcaaagtacaaatcccattctacccgtgtaacttctccttcgggatcttcgaagaatcccaaaagtttgatggagagtctgttggtcgcaaagatggnnnnnnnnnnnnnnnnncatcctggtcggcagttggtgagaacggacagtgctgattctagtagttcctttggatccatcaattctncaaccgccagtgacgtgtgtaggtgcgacgattgtttgctgngtataggagactcgtggcacaagatggaggtacgaccgaggagaaaa

SEQ ID NO: 11067 - DNA, 881 bp, Diabrotica virgifera
tcgacgtttctggagcttcacctattgtaactgtgcctgttgctatatcttccttttcgtcagacttttcaataacccgctgagcatctatgaagaacataagatctcgaacttgttcttttaaatcagtaatttctctttctttgtgcgatctgagttcgttaaagttctcttccagcttattaatttttgtctgccattgttgctgattgtttcttaaagctttgcccaattgtcgctcttcacttagatcgtttaaggtagaagttaactttgaatgctgttgttgtaactttttctccaaggcttgtttttcttttgtaacattcgccagtttagttctcagctgtttattttcttcagacacagctgccatattttctcttaatatttttgtttcttcggataattgactttccaataatgacattttatcttcaaaatacattcgttgttcttctaattgtgaagtaagaagataggtgaattcaagttgtacggaatcaactttttcctgagctccttcagcttcggaaggaggaccttctgatggtacaagctttccatcagctttattctgaagaagtcggtgtacaaaattatcacctttgtaatcccatacacgatgagagcctaattgtagagcatagcagtgaccagtttctctataatgtgaagctgcgtgtcctccttggtatcttccacatcctacatgaccacagatcaaacatatccaaagagaatcaggagaaggtacagaactgccgcattcttcacattctgaactttcagccgtttctggactttggacacatctacaaactggggcatgtggaatcgccccactgttccaaacaactagcgtgggaatgcgtggttac

SEQ ID NO: 11068 - DNA, 814 bp, Diabrotica virgifera
  misc_feature (44)..(72): n is a, c, g, or t
acaaaattaacggcttttctagaaacaaattattttcaattcgnnnnnnnnnnnnnnnnnnnnnnnnnnnnngcatataacttttagttgcaatttttacatacaatagttttttcttcttttctgtgcacctggcatataaattttttgcaaaaagagcaaacggtattcacttttctgtcacagtttcgcggacactggtaacaacgagcacgtttcttagctgaatggacggattgagttgcaacttcggtagttgggtttaccattggtatgccacaatcttttagagcagattttacataggctttatgttttatatatttcgctcttttttccatgttgtttcgagcaagctcagcccctaattgtaacaggaaaatacgtcttcgtgaaaaattatttttcttccaatcaggatttttttcaatgtataaaatataggcatttagtgcacatatgtctataatattcataaagagcctgaatggccaacgagcagttcttcttttacaggaatattccctaatcagtttgtcggcattatcaacaccacccttggtattattatagtctaaaatcatcaagggtttgttttgagagtcttgacaaattatatcactatcgtgttgacttgaaagaagatgtaccatcctgtgtattttaggtatgtaccgaaaccatagctaaattctttaggtaaaagcaaatatttgacgacttccgcaggtctttttgtcaaacttaattggtggggggggatcaggggtattttttgcggaccgggccccagaaaagaaagggttttacataa

SEQ ID NO: 11069 - DNA, 643 bp, Diabrotica virgifera
tttggcagtatactagtttgacatgttcgccccaaaatgcggaggttgcaaccgtgccatcatggaaaattatatttcagcgcttaacgcccaatggcaccctgattgcttcgtatgcagggattgcagacaaccatttattggaggatctttcttcgaccatgaaggtcaaccttactgcgaaactcactaccatcttaaaagaggttctctttgtgcaggatgccataaacccatttctggtcgctgcgttacagctatgtttaggaagttccatcctgaacacttcgtgtgtgctttctgtttaaagcaactgaacaaaggcacattcaaagagcagaacgataagccttattgccatacttgctttgaaaagttgttcggctaaagatgtgatttgcaaaggtgtactaagagaaatggtatcaatatttggcagtatactagtttcaatattgtctaagtttaaaagtggaataagggtgcaataagattattattggtatctagtatacataacagaatgctttctatatatatttatacgtttaaagttactaatttcgtaaataagtgtaataaaagttactaaaacaaaaaacaattaaaacaaacatttcaacttatatttctattatccccc

SEQ ID NO: 11070 - DNA, 88 bp, Diabrotica virgifera
  misc_feature (6)..(80): n is a, c, g, or t
aaaatnnnnnnnnnnnnnnnnnnnnnnnnnnnnnnnnnnnnnnnnnnnnnnnnnnnnnnnnnnnnnnnnnnnnnnnnnnnaccttagg

SEQ ID NO: 11071 - DNA, 437 bp, Diabrotica virgifera
  misc_feature (106)..(126): n is a, c, g, or t
gaataaaactatactaatagccctaaacgaccccttatgctagatgtattttgtgataggcaattaagattgtgtgagcaaatgaaattttcatatcagacacacnnnnnnnnnnnnnnnnnnnnngcgtgtattattacttagatcattacatatttattatactctgatctatatgagctaaccatggcaaaggactatcgaaaaatatatatttaaactaatttgattgtgatgttttgtatacgatagtaatatctctgatgtatatctatttggatgaaatttatatataacccaagatatccataattacatatatgtatagaaatagaattaaatatccttagcggacgagcttaacaccaaaactttattcccatccactcttcacgcaacaattacggatcaacattttccctattctaaactatgac

SEQ ID NO: 11072 - DNA, 1187 bp, Diabrotica virgifera
  misc_feature (13)..(858): n is a, c, g, or t
  misc_feature (860)..(941): n is a, c, g, or t
  misc_feature (1081)..(1098): n is a, c, g, or t
  misc_feature (1142)..(1178): n is a, c, g, or t
cgggtcgaccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnaaaagaataaattaccttaagggaaaacagcgtaattttattggagagttccaatccgataataaagattgcgacccccgagtgttgaattaaaggttattaattgggggagcagctattattattaagtcctggtccannnnnnnnnnnnnnnnnngaattgggggttaaacccggggggggggccgggtgggtttttcnnnnnnnnnnnnnnnnnnnnnnnnnnnnnnnnnnnnnaagggggcc

SEQ ID NO: 11073 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11074 - DNA, 632 bp, Diabrotica virgifera
cctcaaataataatggtaatatgccatgtgaataactttaatatttgtgataaaaaaaattccaataatacccataaagataattaaaaataaatagataaaaatactagaaatataccttacattactgctatactattcatttgttatgaaatatcgtggaaataccataagaacaaaatatagactcaccacttttaaacgtcaatgttcgctgtagatctcgccaatcctcgatgaatgttcctcttgaggttcctgcgatgtgtcttccatagtgaccatgccagtctcatgatcagaaccgtcgtgatgatataaagaagtacctgtacctctgtgtctagcttaatgtccttgttgttgacgatgaagttgctgttcaccactccattctcttggacttcgtctttggatgactttcctcccatccttgatccatcagctctcgtctggtctagatcgccatataatagtccagggttactaggaccatcttctcccggtaagggtggttaacgaagggtttaaccacccctttattccctttatccgaggggtgggaaatgaataaatagcccgtaccactgctttaatttgtttcattctacttgttgaattaatctggtaag

SEQ ID NO: 11075 - DNA, 634 bp, Diabrotica virgifera
  misc_feature (493)..(513): n is a, c, g, or t
caagtccgccatattgacattcgacaacttttttgggaggacaggtgaatgctatatacgttttgaccaagggaaagccgtaaaactttacctagcacaagatgaaacgaacgaatagatgctagagaacactgactttatttagtttatcagagaagtatactttgaaagaatcaaggtcaaattcactcaaaagaccagatcagcctataaagttttatacgaatacgaacaaaggtctgtagtattatggttagccagataatagttttatttaattagatagagcaaatgaaaaagttggctatgtctagttgatcatattaaatagtatttttttgatacaatgtgtttgagtatatcaaaagaaaaccttacagatatcagcgaaattttactgtttggcccatctcgagactatatattagagcctcaatgtcggatgaaagatcataagcggtgaacgtgctgtattactatgtctgatccaacnnnnnnnnnnnnnnnnnnnnnacaaaaaagcgctgtgagccaggatgactacgatctttaatatattagtaaccatcagacacgaaaggaccagacctagaagataatgtctagatctagtcgaatactggatctacatccc

SEQ ID NO: 11076 - DNA, 626 bp, Diabrotica virgifera
  misc_feature (56)..(79): n is a, c, g, or t
  misc_feature (92)..(109): n is a, c, g, or t
  misc_feature (143)..(165): n is a, c, g, or t
  misc_feature (391)..(411): n is a, c, g, or t
  misc_feature (490)..(509): n is a, c, g, or t
  misc_feature (574)..(622): n is a, c, g, or t
cgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgt

SEQ ID NO: 11077 - DNA, 118 bp, Diabrotica virgifera
  misc_feature (2)..(42): n is a, c, g, or t
  misc_feature (48)..(102): n is a, c, g, or t
gnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnngacccaattttttgat

SEQ ID NO: 11078 - DNA, 874 bp, Diabrotica virgifera
  misc_feature (2)..(840): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaaattttatttggagagtcaatcga

SEQ ID NO: 11079 - DNA, 210 bp, Diabrotica virgifera
tttcgtccgggaaggtatttgttatttattatgaagacctttttgcggcgtggccagtcacgaactatgttctaaacgaactattgaggaattaaattgaagtactaagcgttgtttttttactgggcatttttacttacaacatttttttcttccgttgaagggcatctggcctatgactttttggcaaagagagccaaacgaaattct

SEQ ID NO: 11080 - DNA, 607 bp, Diabrotica virgifera
gaattatttaatttaatgatgtagtgatagtgagttcagttgtgctcgttcaaaaaaagataaacaatgcctccccgagttcttctacattcacatcatgaccacctcgaacatcaggattctgaaggaaatgccaccttacctaaggctacagctatgtgcgtcctcttcacagcctcattcatcataggaaacataccaatcaagttaaaccaatggctcaattggagctcagatgccaaaagtaactcctacgtcaaacttttactcggtttgggcggaggtgtcctcctgtgtaccactttcattcatttactgccggaagtaagtgaacactttgaggagttggacctaactccaaacatcgaaatacactatgcagaagtattgatgtgtattgggttcttcataatgtatctcgttgaagaatgtgtccatgtttatttggaatacaaggagaaacctccagatatgaagatacctctagaaccagttgatgtggatttgggtttggctttaaaacgaagtatttccatcagaaggggagagatccctgacataaagaaaattcccccagagttggctgtacaagctgaacaccaccgaa

SEQ ID NO: 11081 - DNA, 144 bp, Diabrotica virgifera
  misc_feature (5)..(95): n is a, c, g, or t
  misc_feature (99)..(143): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnna

SEQ ID NO: 11082 - DNA, 63 bp, Diabrotica virgifera
ggccgcggcgcggttcccgcggcgccccccgcgcgcgcgcccatgcaaaagatgtcatatatt

SEQ ID NO: 11083 - DNA, 670 bp, Diabrotica virgifera
  misc_feature (3)..(58): n is a, c, g, or t
  misc_feature (76)..(241): n is a, c, g, or t
  misc_feature (243)..(308): n is a, c, g, or t
  misc_feature (311)..(349): n is a, c, g, or t
  misc_feature (358)..(398): n is a, c, g, or t
  misc_feature (419)..(512): n is a, c, g, or t
  misc_feature (550)..(588): n is a, c, g, or t
  misc_feature (590)..(612): n is a, c, g, or t
  misc_feature (649)..(666): n is a, c, g, or t
ctnnnnnnnnnnnnnnnnnnnnnnnnnnnnnnnnnnnnnnnnnnnnnnnnnnnnnnnngggggaaccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnntannnnnnnnnnnnnnnnnnnnnnnnnnnnnnnnnnnnnnnccaccaccnnnnnnnnnnnnnnnnnnnnnnnnnnnnnnnnnnnnnnnnncgggaggggggggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccacacaaaccaaggggagggaggggagggaggggnnnnnnnnnnnnnnnnnnnnnnnnnnnnnnnnnnnnnnntnnnnnnnnnnnnnnnnnnnnnnnaagggggaggagagaaaaaaaaagggtgtgagaagtnnnnnnnnnnnnnnnnnnaagg

SEQ ID NO: 11084 - DNA, 750 bp, Diabrotica virgifera
  misc_feature (3)..(710): n is a, c, g, or t
  misc_feature (716)..(717): n is a, c, g, or t
  misc_feature (726)..(726): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttnnattatatantaatttatttaaattgggggtgat

SEQ ID NO: 11085 - DNA, 111 bp, Diabrotica virgifera
  misc_feature (9)..(28): n is a, c, g, or t
  misc_feature (30)..(31): n is a, c, g, or t
  misc_feature (44)..(44): n is a, c, g, or t
  misc_feature (57)..(57): n is a, c, g, or t
  misc_feature (61)..(109): n is a, c, g, or t
attattaannnnnnnnnnnnnnnnnnnnannatttattatatantaaatttatttanttgnnnnnnnnnnnnnnnnnnnnnnnnnnnnnnnnnnnnnnnnnnnnnnnnnaa

SEQ ID NO: 11086 - DNA, 174 bp, Diabrotica virgifera
  misc_feature (3)..(86): n is a, c, g, or t
  misc_feature (90)..(168): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnnnnnnnnnnnnnnnnnnnnnnnnnnnnnnnnnnnnnnnnnnnnnnnnnnnnnnnngggggg

SEQ ID NO: 11087 - DNA, 129 bp, Diabrotica virgifera
  misc_feature (9)..(94): n is a, c, g, or t
  misc_feature (96)..(97): n is a, c, g, or t
  misc_feature (107)..(107): n is a, c, g, or t
  misc_feature (118)..(118): n is a, c, g, or t
  misc_feature (128)..(128): n is a, c, g, or t
aaagcttannnnnnnnnnnnnnnnnnnnnnnnnnnnnnnnnnnnnnnnnnnnnnnnnnnnnnnnnnnnnnnnnnnnnnnnnnnnnnnnnnnnnnannttatttattnggggtgattanaaaataaatnt

SEQ ID NO: 11088 - DNA, 935 bp, Diabrotica virgifera
  misc_feature (544)..(575): n is a, c, g, or t
  misc_feature (770)..(793): n is a, c, g, or t
  misc_feature (797)..(797): n is a, c, g, or t
  misc_feature (817)..(851): n is a, c, g, or t
  misc_feature (905)..(924): n is a, c, g, or t
gttaaacgaagaagcatgtgacgtaaaagaatttcttggctgctaaatcttcgtaaatggttcggaatgacaggggtcgaattattccgtgcagcagtttcgaaaatgaaaatatgtagtcttgttgatcagcaacctccacaggagaagctgaatgcaagaggcaagaagatgtaaggaagcaactctttttatagttgttctattggttagtcacaaaattgtgatcacaatataatttgcacgtatttttacgtctttaagagagttcgctacttacataaaatattggacaattttctctagcttcttcttcatttcgtaaaccctatagtcatgaccttcgatgacttgtttttaaatagtagttcttgtttgcttattcaacatgtataaaaatatgattttcttcgaaaacaacttgtaaaaggcgtattaaccattataaattttgtttgcgctagacaatggtatctaatacctcctttctggttcaatttttgtagatgttggaagcaaacaagaattactgaaataatcaaannnnnnnnnnnnnnnnnnnnnnnnnnnnnnnntttgttcaaaattatgtatttttttaactaaattattttaaagaggttctagatataatgaaaatgatgataacgaaagtctttcaaacgaaaatattgaaaggagcagttaacgagagcaaataaaagaatggtgcaactacttatttaagaataagtatagacctgtgatatgtaacaaagtttgaagacaannnnnnnnnnnnnnnnnnnnnnnntganaacattaattcatcattacnnnnnnnnnnnnnnnnnnnnnnnnnnnnnnnnnnngcagctttaagctacttacgatgaagattgtgtaacattaaaatatcagtgccnnnnnnnnnnnnnnnnnnnnctttatgcttt

SEQ ID NO: 11089 - DNA, 201 bp, Diabrotica virgifera
  misc_feature (30)..(30): n is a, c, g, or t
  misc_feature (109)..(130): n is a, c, g, or t
  misc_feature (159)..(184): n is a, c, g, or t
taacagcgtaattttattgggagagttcanatcgataataaagattgggacctcgatgttggattaagtttataattggtgtagcagctatattataagtctgttcgannnnnnnnnnnnnnnnnnnnnnagttaaaccggtggaagcccgggtgggtnnnnnnnnnnnnnnnnnnnnnnnnnnagaacaaaagaccaaaa

SEQ ID NO: 11090 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11091 - DNA, 613 bp, Diabrotica virgifera
  misc_feature (18)..(18): n is a, c, g, or t
  misc_feature (377)..(396): n is a, c, g, or t
  misc_feature (466)..(484): n is a, c, g, or t
  misc_feature (581)..(603): n is a, c, g, or t
gagaaaacaatttatttntggggaaataaaatgtatatgatataatttaaagttttgatgttaagccgaatttaaacttgttttgttaaaagagttcatacgatacgaagtgaaaatggttattcattttttacgatacgaagtgttgatgagctatctgattttgttcaaaagatgtttttctgaggcaattcagattttcgaacgtaatttatgttgtaggaaagaatctactcttaaattgaaactttgattatgtgtaattcatacccaaattagattaatatatacaaaatgttatatttcttaaatatgcatgtataccttatggagttagataaaattattattaagttgttttagcattaaatttatgnnnnnnnnnnnnnnnnnnnngttggggggattaagaaagaaattaacctttattgatataattaatttactaactaatattttgatccgnnnnnnnnnnnnnnnnnnngaaattaccttagggatatgagcgtaatataatagtgataagacaaaactatattaaagattgcgacctcgatgtaggaagaaagattataattgtnnnnnnnnnnnnnnnnnnnnnnntgtaatactt

SEQ ID NO: 11092 - DNA, 799 bp, Diabrotica virgifera
  misc_feature (461)..(479): n is a, c, g, or t
aatgaccaaaggtacctcaagttttggtaaccttcgcaataagacccacaccctatgcaggaggtgcgacatataaaatgaaaaatcttattgtctttgtgtacgcgattctggtgcccagattaaacgctatccccgtacatgtcatccagaaaaatatttcagcggaagtgaggtatgatcagatctctcccatgttttgtatctttgtagcaagttctaatgcacggaagaaggaacttagatgcaaaggtgcaattatcttcagacgaactgcctcaggtattgaaacatttaccgattccacttgaatctgatctcgttcctgaaattgttagcgaggaaaaagctcaggtggcatcagaagtcgaaaacaatgcagttaaatctttaattcaacctgaagatcaagaaagagttgaagttcttcccgaaaaacctattgatttaccaatagaggnnnnnnnnnnnnnnnnnnngaaatctttattagccccagaaccacttagcgattcgaacactgttctgcaaaaagtagctccaaaacctgcccagaccttagacagtgtcttacaagaaactcagaacatcatcagagttggtcttaagaatttgagagactctttcaaaccatacaaaggcgaattgggtcccactgctgaactatgggctacgttggagaaacaagttgaagaatacttctcagaagaaaagacaaactcgctattaaacatctcatccattagaaggtggatctacagtagcttcagtatctccaccagcctccaaaataactggg

SEQ ID NO: 11093 - DNA, 485 bp, Diabrotica virgifera
  misc_feature (11)..(30): n is a, c, g, or t
  misc_feature (36)..(71): n is a, c, g, or t
aaatttcagtnnnnnnnnnnnnnnnnnnnnctgttnnnnnnnnnnnnnnnnnnnnnnnnnnnnnnnnnnnngaatattacgtgtaaaagcaaaaatcggataagactgtgcatctcaagtattcaaccatgcctacattgggagagtagacctggagcagaaggaatactagagcgaatatgtggaaaaggtagtaaactgtgtttaatcaaagaactgacaacagactcaaagtatataccgcttagtaatcgagacaaatattggcatacagctactcgccgccgctaaggattatagaagatctatacgacactatcatcttatcgatcagaacgattcaatagagacactatctctcagatgtcgagcacatccttgacttgacgaaccaacaaaatacactctcattcaccatcgataggaatgaactaactacgaacgtgaatgtagatattactacatttgaagatacgatttacttt

SEQ ID NO: 11094 - DNA, 905 bp, Diabrotica virgifera
  misc_feature (225)..(244): n is a, c, g, or t
  misc_feature (725)..(725): n is a, c, g, or t
gaaaatattcaaactaaaagaatatgattaataccaaaaaagaaagatgtttaaaagaagttgaaaacattttgtctttggcaaagctctctaaagatgatattaaacctttatcccaagcaatatattttactgaacaaaatttatacaatcataactttcgtttattacagttggatccacgtttattacaagaaataacagaaggctctgaactgtgttttnnnnnnnnnnnnnnnnnnnnacttgtaatctgttctgaaacacagacatttcaagtagttgaagcagagacttctaacagtttattattagtaaatgatatgaaatttcccaaagatattgatgatagtttgagttcaacagttcatggagtaaaggtaaaagggatattctatgagtatctagaagcatcagtaggcaaaccacatttaaagaagttagacgatttacttaaatccttcccttacaaaggtccagaacacgagtttgaggtaaacaaagaaaatctttacagttttgatgatttgtgtgataaaattcaggcctctaaaagtgaattaaaggaagcattaagcacgatgactgttgtagaaattagtggtaaaataagaactttggatattgaatatcattttcgaatattgtcctatatgttaaaattactagaagaaaactcatgggagttagacgaagttgacttcaaagaaacagttgattctttnaaagaattagctcccaaagaagttgtttcacatttatttgataaatatacagaggaatcaaaggaaattgatggtatagctttgtataagtataaggaagatgaagtttgcaaattttttgcaaaagttttactacatgaaactggcaagttcaatttaaatgaatttttacaagcttgg

SEQ ID NO: 11095 - DNA, 959 bp, Diabrotica virgifera
  misc_feature (801)..(827): n is a, c, g, or t
  misc_feature (877)..(877): n is a, c, g, or t
gtacaacgcatatgtatgaaatatacagggtgttttacgacgagcttatactatctatatatcagaaactacttacatgatatttgtgaaaagtggtttgtggggatttcaaattatgacgaacttaaagaagatattcctacagacatgacacatccagtcataccggaacagcaactttttaattttacacacatggaacaccctgtatattattgcatttttagattctgcgtaagattatagactaaattttgtgtaaggtatcataggtcaaaactttatattttttgagttattcatcttttttcaaaaattttgacaaataaagacaaacttttaaaagtttgtatagctgatccatttacaaacataataatgtcttgaaaacttttgcacacaaagcgtaggtaacgttcttttagaaatttgcatctaaatagaatttctaaatacagtaacattctatgtctacatacaataggtttgttttaactcgatacaaaatctttcttgaatcgttacgcgcatgcgcaataacgaataattatgcgcagtaacacatttttcgttactgcgcatactcgtaaccgttcaagaacggttttcgtgacgggttggaacaagtctattagcaaatacagtatacaaatgcaaggtccctataccatgaaccttgatacaaatgtagccttcggcttcgatcctgcgcatgcccgtgtgcccgcatgcacaggagacagtttatctgaggagatcatggcgttcacattgcaaaattcgacgattgaggagcagtgnnnnnnnnnnnnnnnnnnnnnnnnnnnaggtgttaagccggccgttattcatcgctggatgcagaagaaggtccatncagagtaaaagaccgtggctgctcacggaagtgtggtgggtctgctccacgataacgcgctgctacacgtctcaaggatttc

SEQ ID NO: 11096 - DNA, 981 bp, Diabrotica virgifera
  misc_feature (818)..(818): n is a, c, g, or t
  misc_feature (937)..(937): n is a, c, g, or t
gaggaaggtctcgattaacaaacattggtcactgttttcatttacccaggttcccagatatttttagttaatcactctttgtacttgttttccctcgattctagccttccttctgaatattgcttagaaataatcatgaactttgttttcttatagttcatttgtagtctatattttatactgacttagtaatctatttactaagcgttgtagtgcttttaatatgtctgcaaaaatagcgatgtcgtctgtgaatcttatgttgttccagatttttccctttcttgatataccctgtttttcccctgatattgcttccttaaaaacagctttactgtacagattgaataacaatgtggacaacacgcaaccctgtctaacacctcttttgatttctttagtttctgtttctacattttcgattctaacctttgctttttgaatccagtacacattgacaataacccgtttatctcgactgtccacattcttttgttttaacagtttacgagtttctgatgtcgcactctatcaaaagccttttgataatctataaagaaggcatagagaccctggttcatatctagtcgtctttgcgcaagaacgttaaaacgaacagagcctcaccctcctaggaacgagagaagctctgttcgcttcaaataatcagaaatatttctcaccaaaatattagaaattcagcgacttaaaaatacagatttaattctcaataaacaaacatatagtgagaggtctccgttactctgtctgacgggaatgtggttaggtagaaaagaaagaggaaggttaggaagaanaaaagagtaataatgcccggtttacattatttcagtccagtaatccagtacagtccacactgttttagtcattcaaaagctgtaagatcggtaacactatagagacatttgctttacgncataaatcaagcactggatgacgttcacactggtcaaatgacgc

SEQ ID NO: 11097 - DNA, 513 bp, Diabrotica virgifera
  misc_feature (366)..(383): n is a, c, g, or t
atatgattattttgactacttttttctcctaatatataggggataatgacgtagcttcttaggggttattctaatataccgccccagccaatgctccataggatgtcgaatcacaacaacgaataatgcctcgccttcttatttttcttttcggatttcgaccccctagggatacaacagttactaccttctgtctctttttgaccgctcttatgatcataggaagaggtatacgtatgaggtatatttcagtactaccaatacatcatagtattatttattcggtttgaaggtagggttcatatttcttaattaatgaatttaatagtgcatatgacggtacagaagtatatgatactgatgcgnnnnnnnnnnnnnnnnnnctaacatataattactgtgaaatgtggaactatgacgatactgtcttcatgtatattttctcagattatttctaataaattttctagattatcaactatgattattacgaatatatcgacgtgcctgatt

SEQ ID NO: 11098 - DNA, 133 bp, Diabrotica virgifera
  misc_feature (21)..(53): n is a, c, g, or t
gtcgtattttataatatgtcnnnnnnnnnnnnnnnnnnnnnnnnnnnnnnnnncttgatatatttagattaacagggcgactgagaatcatgtaagatctagcactgactgataatattggcattgagaactt

SEQ ID NO: 11099 - DNA, 278 bp, Diabrotica virgifera
  misc_feature (7)..(39): n is a, c, g, or t
  misc_feature (42)..(100): n is a, c, g, or t
  misc_feature (103)..(270): n is a, c, g, or t
taatcannnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 11100 - DNA, 728 bp, Diabrotica virgifera
tttttgaaaacaaaacaaaacacaaatttatttacaattcataagttacaaagaacaggattttataggaaagtatcacaatataaagaatcgtggtccaatgaaattaccacaatacggaaaacttgtaggaggtgtcacgatatcaccagtatctcccagttggagagatatgtccaaacctccagacgcaaccctgtccaggtagatcgctaagaagctcggaagaaggagttatatatgtaaaggtgttattagcttaaaactaactgtcgcaggaatagaaaattttaccgattccacttgaatctgatctcggtcctgaagtagttaccgaggaatttgctcaggtggcatcagaagtccaaaacaatggaattaaatctttaattcatcctgaagatcaagaaagagatgaattacttcccgaataacctattgattaaccaatagaagttccagaaaccccttgcgtgagatcaggattagccccagaaccacgtagcgattcgaacactgttctgcttacagtatatcctaaatctgaccataccttacacagagacttactaaacactcagaatatcatcagaactggacttagaaattttatagagtctttcaaaacatacaagaggagaatcgattcccactgctatactacggtctacgatgtacaagcgagttgacgtatacttctcagaataaagcacaatctctttattaga

SEQ ID NO: 11101 - DNA, 863 bp, Diabrotica virgifera
  misc_feature (13)..(32): n is a, c, g, or t
  misc_feature (635)..(647): n is a, c, g, or t
  misc_feature (649)..(663): n is a, c, g, or t
  misc_feature (708)..(726): n is a, c, g, or t
  misc_feature (796)..(796): n is a, c, g, or t
ggtcataattgcnnnnnnnnnnnnnnnnnnnnctggacctggatttttcttgtcattggtaattgggtcgttccaatgtggtaaaaataagtattgattgtttttataatgagtgtttattcattaaatttaataatgtgtgactaaaagttggtaatacctgctttttaatgttagagttcttaaagaattcaatgtaatttcaagattgaagtcgtaaggttgtccggccgaaaaatttatgcaaaccattaaacttgattttttgtggtcttttcaaatatgcaagcggattttcggagttttgatatacagggtgttgttttaggctcacaattgctttataattgtttgttagtccggacctggatttttcttgtggttggtatgtcggtcgtttgggttttgattgagatatatgtgtgccaaatgtggaaaggatatacagggtggttctagggttgtggcttgggaaagaagtgggcaggatcgatgaagcaccctgtagctcggttctagaggtcggtggggcgggaaatgtagtatatctagagccggctcggtgacctctgtgcaccattaaagtatttccgtttcccaatgaaacacccattattaaatgtatagtaaatgcnnnnnnnnnnnnngnnnnnnnnnnnnnnntatttttcaaactttattttactattttaaattgagaattcaagnnnnnnnnnnnnnnnnnnnctttagttgtcatattaacaagaatatgcaaaaatatgtgtgaaatatattaataaagaagtgatcttanaaaaagtaccttaaaatggtgtttttgtataaattcagtaatcctaaatttgctaaaaaaattaatg

SEQ ID NO: 11102 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11103 - DNA, 753 bp, Diabrotica virgifera
agctgctgcaagtgcacaatttaaatgtccaccaaaagatggccaatacccagaccccattcaatgtgataaattttatgaatgtgaggatggaatagccaaaacaaaattatgtccagatggtttagtgttcgatccagaaattagaaaacggaataaatgtgatcaacctttcaatgttgactgcggagatagggatcaattacaaccccctcaaccaaaaggtgtttgccccaggttaaacggtttctttgcacatgaagaccctactgtttgtaacaaattctacaactgtatccaaggtgacaatactgaacagacctgtacggcaggtctagtattcgatgaatacaatggactctgtgtctggcctgaaacaattgacaggaaaggctgtaacatgcaaggaaacacccttaaggatggtttcacttgccccaaagaaactcagaaggacgccaatggaaatctagtagttcatcctaaattcccccataccacagactgccaaagattctacgtgtgccttaatggtgtagagcctagagatttaggatgccaagtaggtgaagtatacaatgacgttactcagaggtgtgatgctccagaaaatgttcctggatgtgaagactggtaccaaagtgaagaaactccttcatcaggtaattcaaaacctgcgaagcctaaatctaaataattttaagttcgttgttttagaatgtaataattttcctacgaattaaatttttatat

SEQ ID NO: 11104 - DNA, 553 bp, Diabrotica virgifera
  misc_feature (2)..(15): n is a, c, g, or t
  misc_feature (24)..(123): n is a, c, g, or t
  misc_feature (125)..(137): n is a, c, g, or t
  misc_feature (139)..(159): n is a, c, g, or t
cnnnnnnnnnnnnnnttactaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnncnnnnnnnnnnnnnnnnnnnnnactgacatgaacgccccatctagtactccgtctgaccgctcttacatacttaggaataggaatcacaggaggcaaaattctgtacgaccagaacatcagaggaacacataaacggattgaaggatgagctcatattccaataaaaaatgaattgaggagtgcatatgacggtacagaagtatatgatactaatgcgtttttagataaaatattaccaacataaaattacaatgaaatgaggaacgatgacgatactgacttcaagtatattttcacggattatttccaataaaacttctagattagcaacgacgataatatacgaagaaatcgacgtgcctgatcatcatagatgatcgcctgcgtacttatcatccctgtccattttgtacta

SEQ ID NO: 11105 - DNA, 905 bp, Diabrotica virgifera
  misc_feature (541)..(562): n is a, c, g, or t
  misc_feature (884)..(901): n is a, c, g, or t
cggacgcgtgggttaatctggaaattgtagatactgttttttttaagtataaagttctgttaataaaagaaatagcatatcaaatatatacacgtaaagaaatttcttgatttcttcgtttatttgtagcactttttcagcaatcaataacgccaaaaactatatttatagtatttcgtataaatgttaataaaacataagggtaaagaacaatgaatatggaggaagaacaaaatttttcatttgccatcctagaagacaaattttctatttaacatctactaatcatacattttgaagaagaatattagcatgtttgtgttattttggaaacaaatcatgtttaccagggccaaacaaaatgttacaacgttttttataattaccatatgacatacctgacaaaagtctaaagttccaagtaaaaaacccaggaaaaatgcatagattatagaagattcataggtaaatacgatcaaatcaaaattatgtaaattctggattcttttgtatatactgttactgtcatttcttctacaannnnnnnnnnnnnnnnnnnnnngtgaaaatttgattcttgccaaatatttatagcaatattatgattgcaatggagtagcaaacatcagatttattttaattcaaaaggatcaagctcatacttgtgaaaaacatacatattcataagtgcataaatcaggttgtggtgaatctgttaaaattgataataaattgtatatatctgagattttgtgtgttatgtatactgtattatgttagtaataagaagaggtttataactctaaatcaaaaatggtccaaacttgtgaatatgaaaagatgtctagcaccaaagaaagcaaataaatcatacaagctgcagnnnnnnnnnnnnnnnnnncagg

SEQ ID NO: 11106 - DNA, 234 bp, Diabrotica virgifera
  misc_feature (2)..(45): n is a, c, g, or t
  misc_feature (50)..(209): n is a, c, g, or t
annnnnnnnnnnnnnnnnnnnnnnnnnnnnnnnnnnnnnnnnnnncaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaggatacaagggaaattttttgg

SEQ ID NO: 11107 - DNA, 203 bp, Diabrotica virgifera
  misc_feature (10)..(29): n is a, c, g, or t
  misc_feature (31)..(55): n is a, c, g, or t
  misc_feature (57)..(71): n is a, c, g, or t
catgagctgnnnnnnnnnnnnnnnnnnnngnnnnnnnnnnnnnnnnnnnnnnnnncnnnnnnnnnnnnnnnattagaacagagttttattcatagctatccggaatgagttctatcttttatgtattaggacaagttagaacgaaaggaccgattacatacgatcctttttatatttcgtttgttattcgactctgaaatgcg

SEQ ID NO: 11108 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (116)..(116): n is a, c, g, or t
  misc_feature (162)..(193): n is a, c, g, or t
  misc_feature (196)..(196): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttanaattttacatgatctgagtttaaaccggtgtgagccaggttggttnnnnnnnnnnnnnnnnnnnnnnnnnnnnnnnnganagg

SEQ ID NO: 11109 - DNA, 905 bp, Diabrotica virgifera
  misc_feature (741)..(760): n is a, c, g, or t
  misc_feature (845)..(845): n is a, c, g, or t
  misc_feature (855)..(856): n is a, c, g, or t
attgcaccaaaaactcatactcgaacagaagcttcaactaacctaggttagcgcagttgccataattatctaaatgtatattcccaatgtccagctgaacgatttatgtattgtattcgaaaaagcttcgacggttagtacaatcaaactttctaagattaagattattagaaaacatcagccttactgtctttctggggccgaccgtatctcatttgcctcttcgagttttctacacccactctggagtgttcatcagaactttggggttctcagtctcccgagtctgctgtagccattcatctagagtcacactctatctctggagtgttcatcaatactttcgaagtctccatcttgcgtcagaagcgtttgactggatgccagctcgttgtctttagaatatcgatattggctcagtcacaataaagcaaaccccactttccaccaatcgagcttgctaccacccaaataacatcaccatgacaactcaggactattcggaagtcatgctgaagactccaccgaggtggtagagagcttattgtagcaaaatcatatgcaatacaactcgaggactgagtaagtttgatatttttgtaataatattagttttattcgtaagtttgatatctatatgaaaatagtgtcattaatttagccttagaaagaaaacatgatttttgttagttcttttcctttcttttttaattatttgtccaatacatttgataagatgcnnnnnnnnnnnnnnnnnnnnccttccgttgtttacttttcctcgagctccacaaaatggtgcaaaatgcacactatgacatcatcgttcatcccaaagatccttntttattaagnnttggcaacttctatcaaaattataacaggggcatggtcacttgggtgct

SEQ ID NO: 11110 - DNA, 1216 bp, Diabrotica virgifera
  misc_feature (21)..(21): n is a, c, g, or t
  misc_feature (23)..(175): n is a, c, g, or t
  misc_feature (179)..(206): n is a, c, g, or t
  misc_feature (214)..(374): n is a, c, g, or t
  misc_feature (379)..(494): n is a, c, g, or t
  misc_feature (503)..(529): n is a, c, g, or t
  misc_feature (536)..(559): n is a, c, g, or t
  misc_feature (562)..(639): n is a, c, g, or t
  misc_feature (662)..(772): n is a, c, g, or t
  misc_feature (806)..(822): n is a, c, g, or t
  misc_feature (825)..(891): n is a, c, g, or t
  misc_feature (896)..(960): n is a, c, g, or t
  misc_feature (962)..(1066): n is a, c, g, or t
  misc_feature (1069)..(1100): n is a, c, g, or t
  misc_feature (1105)..(1185): n is a, c, g, or t
ctgttctagatcgcgagcgcncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtannnnnnnnnnnnnnnnnnnnnnnnnnnngaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagggggnnnnnnnnnnnnnnnnnnnnnnnnnnnaaagagnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnngggggggaaggggggagggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgggggggagaaagggggagactgcgggtggnnnnnnnnnnnnnnnnngannnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncannnnnnnnnnnnnnnnnnnnnnnnnnnnnnnnagagnnnnnnnnnnnnnnnnnnnnnnnnnnnnnnnnnnnnnnnnnnnnnnnnnnnnnnnnnnnnnnnnnnnnnnnnnnnnnnnnntgtgtttgtttatgagaagagaaggaaaggg

SEQ ID NO: 11111 - DNA, 94 bp, Diabrotica virgifera
  misc_feature (4)..(4): n is a, c, g, or t
  misc_feature (13)..(13): n is a, c, g, or t
  misc_feature (20)..(77): n is a, c, g, or t
ttgnggtgattanaaaatannnnnnnnnnnnnnnnnnnnnnnnnnnnnnnnnnnnnnnnnnnnnnnnnnnnnnnnnnggcctcccttttttttt

SEQ ID NO: 11112 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11113 - DNA, 1251 bp, Diabrotica virgifera
  misc_feature (2)..(2): n is a, c, g, or t
  misc_feature (4)..(4): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (12)..(12): n is a, c, g, or t
  misc_feature (14)..(14): n is a, c, g, or t
  misc_feature (17)..(17): n is a, c, g, or t
  misc_feature (19)..(19): n is a, c, g, or t
  misc_feature (21)..(64): n is a, c, g, or t
  misc_feature (117)..(199): n is a, c, g, or t
  misc_feature (208)..(229): n is a, c, g, or t
  misc_feature (231)..(285): n is a, c, g, or t
  misc_feature (321)..(432): n is a, c, g, or t
  misc_feature (444)..(463): n is a, c, g, or t
  misc_feature (470)..(491): n is a, c, g, or t
  misc_feature (495)..(516): n is a, c, g, or t
  misc_feature (523)..(723): n is a, c, g, or t
  misc_feature (757)..(783): n is a, c, g, or t
  misc_feature (791)..(809): n is a, c, g, or t
  misc_feature (829)..(871): n is a, c, g, or t
  misc_feature (874)..(887): n is a, c, g, or t
  misc_feature (893)..(920): n is a, c, g, or t
  misc_feature (944)..(956): n is a, c, g, or t
  misc_feature (959)..(989): n is a, c, g, or t
  misc_feature (999)..(1062): n is a, c, g, or t
  misc_feature (1068)..(1117): n is a, c, g, or t
  misc_feature (1123)..(1138): n is a, c, g, or t
  misc_feature (1141)..(1245): n is a, c, g, or t
tntntntntntntnttntntnnnnnnnnnnnnnnnnnnnnnnnnnnnnnnnnnnnnnnnnnnnnccacctttaaaaagcccccaaaaatcaaaccacactgttacaaaaggaattcnnnnnnnnnnnnnnnnnnnnnnnnnnnnnnnnnnnnnnnnnnnnnnnnnnnnnnnnnnnnnnnnnnnnnnnnnnnnnnnnnnnaaaaaccgnnnnnnnnnnnnnnnnnnnnnncnnnnnnnnnnnnnnnnnnnnnnnnnnnnnnnnnnnnnnnnnnnnnnnnnnnnnnngccccggaaaggggaaggggaaaaaacccggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggaaaannnnnnnnnnnnnnnnnnnnccccccnnnnnnnnnnnnnnnnnnnnnnccannnnnnnnnnnnnnnnnnnnnngggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggaccccaccgcgggggaaccccccccccgnnnnnnnnnnnnnnnnnnnnnnnnnnnccccggcnnnnnnnnnnnnnnnnnnncacgccccccccggaggagnnnnnnnnnnnnnnnnnnnnnnnnnnnnnnnnnnnnnnnnnnncgnnnnnnnnnnnnnncacccnnnnnnnnnnnnnnnnnnnnnnnnnnnnggaatccccccccaaaaacccccnnnnnnnnnnnnnggnnnnnnnnnnnnnnnnnnnnnnnnnnnnnnngaccccgacnnnnnnnnnnnnnnnnnnnnnnnnnnnnnnnnnnnnnnnnnnnnnnnnnnnnnnnnnnnnnnnngccacnnnnnnnnnnnnnnnnnnnnnnnnnnnnnnnnnnnnnnnnnnnnnnnnnngggcgnnnnnnnnnnnnnnnngannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacca

SEQ ID NO: 11114 - DNA, 973 bp, Diabrotica virgifera
  misc_feature (33)..(54): n is a, c, g, or t
  misc_feature (61)..(79): n is a, c, g, or t
  misc_feature (112)..(180): n is a, c, g, or t
  misc_feature (183)..(220): n is a, c, g, or t
  misc_feature (262)..(274): n is a, c, g, or t
  misc_feature (276)..(300): n is a, c, g, or t
  misc_feature (308)..(335): n is a, c, g, or t
  misc_feature (627)..(645): n is a, c, g, or t
  misc_feature (783)..(783): n is a, c, g, or t
  misc_feature (905)..(905): n is a, c, g, or t
aaattttatttgagaatagattgcagtagatannnnnnnnnnnnnnnnnnnnnnggaattnnnnnnnnnnnnnnnnnnngacttaatttgtgccagcagttgcggttatacnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnngaagttaagaaatttaaattttaaactaggattagatactcnnnnnnnnnnnnngnnnnnnnnnnnnnnnnnnnnnnnnngttatggnnnnnnnnnnnnnnnnnnnnnnnnnnnnaaaggactgagtcagccaatcgaacacaaaaaatcggtttccggttatttgaacttggtagctaacaccatggacaacttcacccacggtctgtcattgggtggcgccttcttggtatcccttagactaggactgctgaccaccttcgccattttagtccacgaaatcccccacgaagtcggagacttcgccatcttgcttaagtccggcttcacgaggtggcacgccggcgttttccaacttttgaccgcaggtggcggtctcatcggcgccatggcggccatcttgttcnnnnnnnnnnnnnnnnnnnttgaagcgaggagctcctggatattaccatttacagccggcacattccttcacatagctttagtaaccgttcttcccgatttactcaaagaagaagatcccaaagaatcattcaagcaactgttagccttgatcctgnggataacagtcatggcgttcgtcaccaacgctttcgagtgatggcgaccacaaaacattatcacaaatgtacttgaaaagcatagttatttgaaataatcagaaatttccataattagtggntagtattatttagtgcggtttatttagtgtcactgtcatttgtcaaatgtcaactgtcatttgtcaaa

SEQ ID NO: 11115 - DNA, 59 bp, Diabrotica virgifera
gagattgtaaatatttattgaacaggttgttacaataattaaatacactggtacaagtt

SEQ ID NO: 11116 - DNA, 282 bp, Diabrotica virgifera
  misc_feature (17)..(51): n is a, c, g, or t
attaaattgaattactnnnnnnnnnnnnnnnnnnnnnnnnnnnnnnnnnnntaataagttaaactattttaacttgaattatatgcctatatattttaggggctagtaaaacgaactgtatgatgtgcaatgtgaaaaggatagtgcatagtagtcatctcgtgttataggtacgagttcaatgtgtagtttacactagcgcggaggggtcaataatgattggcgggtacgagacattgctcgaaaaagaatgatcataggtcgagatgtgtttatacatcg

SEQ ID NO: 11117 - DNA, 213 bp, Diabrotica virgifera
  misc_feature (11)..(23): n is a, c, g, or t
  misc_feature (26)..(50): n is a, c, g, or t
  misc_feature (94)..(123): n is a, c, g, or t
  misc_feature (168)..(189): n is a, c, g, or t
aataaattggnnnnnnnnnnnnnccnnnnnnnnnnnnnnnnnnnnnnnnncatattattctaaaaaataatactctagaaatattatttaaccnnnnnnnnnnnnnnnnnnnnnnnnnnnnnnctaactcataacctaatcaaactccaactataataaaaatcaaannnnnnnnnnnnnnnnnnnnnngaagacaaataaaaataggagtag

SEQ ID NO: 11118 - DNA, 686 bp, Diabrotica virgifera; identical to SEQ ID NO: 9752
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t

SEQ ID NO: 11119 - DNA, 444 bp, Diabrotica virgifera
  misc_feature (124)..(187): n is a, c, g, or t
  misc_feature (314)..(336): n is a, c, g, or t
ggcatgagaagtgcttctgttgttgagtatgttagtaaccgatcggatcccaaagtttcatgcctctataggtagaaaatgaaagattatatagacgttgtgtaaaagaagcgcggcagcacannnnnnnnnnnnnnnnnnnnnnnnnnnnnnnnnnnnnnnnnnnnnnnnnnnnnnnnnnnnnnnnattctctcatgatttttatttagggagacagttacaatccacggatgaaaaagcacaaatgcaaagtgtctattagcaccgcacaccctatcggaggaagagaaaattgtaccgcttgcacttgaannnnnnnnnnnnnnnnnnnnnnngacagaggacgttcctaacgtggcatcagcattctaaggagaggaattaaatttatatttcatcttgttgatcaagaaggagatgaactactaccggaataacgaatt

SEQ ID NO: 11120 - DNA, 396 bp, Diabrotica virgifera
  misc_feature (11)..(199): n is a, c, g, or t
  misc_feature (206)..(243): n is a, c, g, or t
  misc_feature (262)..(275): n is a, c, g, or t
  misc_feature (278)..(300): n is a, c, g, or t
  misc_feature (308)..(329): n is a, c, g, or t
  misc_feature (371)..(371): n is a, c, g, or t
  misc_feature (376)..(376): n is a, c, g, or t
catttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggannnnnnnnnnnnnnggnnnnnnnnnnnnnnnnnnnnnnntgttcgannnnnnnnnnnnnnnnnnnnnnagtttaaccggtgtgagccaggttggtttctatctttaattnattantatattttagtacgaaagga

SEQ ID NO: 11121 - DNA, 789 bp, Diabrotica virgifera
  misc_feature (603)..(603): n is a, c, g, or t
cccgagtacaatttatcagtacccggcccagctctgactacaggtgcctgttgtttccgataacacgacaatgaacgtcgtgtgccatgagtcatttttactatcgtatatatgtagttcaaataatatgtagttcaaattacacaaatacccattatctctcaaatattatattacatacatttttattgttgaaatgtttgtctgataaaaatcggtccgggttagccggacttccgggttatcgggggccgacttatcggggttccactgtacatagttttaactattatttctgacgatgtaaaattgacacaacccttttggagattggttcctgcacttcgtctttggtctttattaaacttactttttaaaattgtgtgacaaattgcatttggatgagtaaagaacacagataaagcaaagtcactcaaattagcaaaataaatagagggttaccgccaaaatgttttatttggcctactttaaaatgtaacatccagatgtcaattctattggaatatattggtactgttgaagttttccccatttgttaaggatcttttgcatcgtttgtaggtgtagaggattaaaactcanggcagtttgacattagtggtaaagtactatatgatttcacagaactcagttatccactaagtagtaataaataatgttattagtgtctattgtacgtcggtagtggataacaattatattttttaatgtaatttttttctttaaaggaaaaatgtgatattataaaaataaagacttttatttccc

SEQ ID NO: 11122 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11123 - DNA, 621 bp, Diabrotica virgifera
  misc_feature (65)..(89): n is a, c, g, or t
cccccgcggggccggcccggaattccccgggcgcccccccccccccgacgcgtggggtagattgnnnnnnnnnnnnnnnnnnnnnnnnnaatagcgatattttttagaaacaagcaacgacacatcctattccctgatagttaataagtattgtgagcacctatttcattttgagaaacgcaacatctattatttgtaccttgcgcatgcaggtatcattacgtaataattatatctattattcttttctcacctaagagagctgaactcctcaacctttttttgcccagtaaatccattaactaccctttttgtacggaaatgaaatcccttcccccacatatctaacctcttaagaaagcagacgagtctccttactagcaggacatgtccaatgacatccttcatagactaccaagattaaatctttctacccatgaacttacaccctacgtttacttaaacaacaacgtcataaccaaaaatactcccgaaaatttgtctactcaacgataggttgacactgacgtttacacagcattatatatatttcttcctagctgtactctactagtgtaagtccaacgctccccccttcgggacgatgataaaactcaccat

SEQ ID NO: 11124 - DNA, 1095 bp, Diabrotica virgifera
  misc_feature (575)..(590): n is a, c, g, or t
  misc_feature (592)..(605): n is a, c, g, or t
  misc_feature (921)..(921): n is a, c, g, or t
  misc_feature (926)..(982): n is a, c, g, or t
  misc_feature (992)..(1015): n is a, c, g, or t
  misc_feature (1035)..(1053): n is a, c, g, or t
  misc_feature (1058)..(1078): n is a, c, g, or t
cttattttaattgaataaatacttaccccacataacaatttcatgttcttagtagattcatagaacatacttttcagaaaaagtatatactgagaatgtgcgtaattaccattgcgaatgtgcagagcagatactgagtatatactacattacagtacttaaacgttctatgtatatacttagaatgtactaccgcacttcttttcagtatataccaagaatgttctttttagaacattccaaggacgtgctataaaccttctatgtgtatacttagaacatactaccgcacatatttttagtttataccaagaaggtactttttagaatattccaaggaagtgctataaaccttctatttatatactaggaacgtactaccgcacatctttgtatgggaagaatattatatttttaagaatattctaagaaagtgctattaagtgctatattgcttagaagtatgttttcagcatcacctaatctcatcttaggttctactggttctaccaaatatctatttacatattttaattgcaaatgagactaaaaatattacttaaaaagtaagtacnnnnnnnnnnnnnnnngnnnnnnnnnnnnnncattatataatatttagctaaactaaactatgcataataagtaactaaaatttatataatacttatatgtacttacctatttaagtaatattgagtaatatagattatatgtattttgaagcaccgcaaacaaaataaacagattatgtatgttctttagtcctagtcctactactacatcattcgccttcatccttaacactgcatctgcatagatccatagatgatacaaataatgaaataatgcctgttttctttttcatattttacggttttttcctatccctgatccattcaggtaatagaatagaatgcngaatnnnnnnnnnnnnnnnnnnnnnnnnnnnnnnnnnnnnnnnnnnnnnnnnnnnnnnnnncaattttttnnnnnnnnnnnnnnnnnnnnnnnncttttcgcgtttaccggggnnnnnnnnnnnnnnnnnnngagtnnnnnnnnnnnnnnnnnnnnntttgcccccccccgggg

SEQ ID NO: 11125 - DNA, 913 bp, Diabrotica virgifera
  misc_feature (906)..(906): n is a, c, g, or t
cggcttgtggcatcggcattctccattctcggcaagcaaagcaagtagcaataggcgactttttaaacaagcatcggccaaaattttgaggatattaataatttgttgaagaaatgccttgggttgttttgagatttccagaaagtgaaacaattgaggcagtaccagctaagtggtatgacaaagcaaacaaactttgtaaatttcctcccgtggacgatcatactgagaaggagttatccaactttattattgaagaatatgaccccttagaggaatggccaatacatgaggcagtgttagaaagccagacagaatttgtactgtttaacaaagctcacattagagctagtaaagcgtgcaatagccagaattacaaatcagataaagaaactgtgttaccacaaaagagacctcctaaaccaaggaaaatagcgagcagtagtagtgagcaggactcagatgggtcagatctggtttttgaacattcatttcctagatataccaagaacatactttttagaagattctaaggaggtgctataaaccttctatttatatacttagaatgtactatcgcacatatttttagtatatgggaagaatattccaaggaagtgctatataccttctatgtatatacttagaatgtactatcgcacatatttttagtatatgggaagaatattccaaggatgtgctgtatttctcaaaagaatgttttcaacatcacccaatctcatcctaggttctactaatattatttacatattctaattgcatatgagaatttagttatttacattctacaatattacgtaaaaagaactcatccaaatattggattagaaaacaaacaggaagtaaaaaccgtgcaagaaacttccaaaccacaccaacaatgcncatgctc

SEQ ID NO: 11126 - DNA, 915 bp, Diabrotica virgifera
  misc_feature (723)..(743): n is a, c, g, or t
  misc_feature (768)..(768): n is a, c, g, or t
  misc_feature (878)..(878): n is a, c, g, or t
aatgaaaatgcgaagtaaagaagataagtgattttttgaaatattgtgttatacttataaattcataaagtcttaatatgtattcgaaataagctttaatatgtacaatgctacagtttctaaaaaaagcaaacaagagtggtcaacaaaaatactcatctaacaatccgcctcatggtagtaaagaaaaggatcatcctataattcctcacgaaaatgtgtcggattcattcaaagcgaattgtggaaaaaccactccattaccattatcatcatttgatgatgagggactgtttgatattggcgaattggaagctacaaaagaccaatcaagactaacaagaacactgcaagaaacaatatcggacaaaaatgcgctggcttatttcacccactacatggaatccagaggtgcttgcgactacatccattgttggtcagagatacaaaccttcaaatctttcctaaaagacaaccaaaatcttcaaaccatgaaaaatttcccccattctcccgtgccacatagtaatttcgatcatgacagtttatcagttagtactgattgtgattcctatacagccgattcaaatagtctgtatgactattcggcaacaacgttatcagagggtaaaacaccccaggataacacatgtgataaagaaagtgatgaatctaattttagtgaaaagagaaggtacaaagtatagtagataaagccttacnnnnnnnnnnnnnnnnnnnnncacaagaggcgctgtgtaatattanatgtacagaggaaatgaggaaagaaattatggagaatatttgcaatactgataaagttttatccattaattgttttgataccgtagagaattatgtttataatatcatgncagatgagtatttcgcatcatttttagctttctgata

SEQ ID NO: 11127 - DNA, 1043 bp, Diabrotica virgifera
  misc_feature (261)..(282): n is a, c, g, or t
  misc_feature (445)..(474): n is a, c, g, or t
catgtaaatatacaactgaaattggtacgtaaaattaaatgtaataacatggaaataaaacaagaaactagtgagaaaacttgtaaaatggaagtctgtgctggtcttttggatacattcaaaattgagatcaaggaggaacccaagacagaagctgtatacgacacatttgttgattcagagttaaatgaattccccctaaaaactgaagtagaacaagatgaatataaattttcacaatttgaagaaaagccaacaacnnnnnnnnnnnnnnnnnnnnnnaatagatctcaaagacgaagaaagtatggtgcgaaaaggtataacaaacaagctgacagatgcagaaaaaaggacaaaatacgatctttccacaataaccgatgaacaaatctacgagatcatgaactctaatcttgattcagatgacgagatagtttacgannnnnnnnnnnnnnnnnnnnnnnnnnnnnncaatgcacctaatcttaagactaaccagcattttacatttaacttaatcgactactgtactgtcctaggtattcccaacggttcaccttagaatttaataattatcgttgcacacatcactgttgtggctaggttcactgtccgaatttaaactgacactgacatttttatagatttatcactatcacacaagttcaaaaggtttggtgcgtttgagcctgcggactaggttttgattatctaaaagttttaacacttccctgtttgtatggttgtggagtcttttttcgtgacccttggcaatcttctttatttcttctttgattgttgctatacgaagttcccgatgtaggtctttgttgcggatataccatggaagcggtgactaatgttccttatcaattcagttttgaactccttgaaagcgaataaaaattaatccccactaatacaaccccccataaatttcaaaatcataagggcccataccgggtcggaaaccttttccttttggacattttagtactattggcttttgatatgcggatttggggaaaaaattctaacct

SEQ ID NO: 11128 - DNA, 240 bp, Diabrotica virgifera
aatgaaaagttattcgtttttagatgtatctaattctttaataaataaatgcattttatttattctcctcatattgataaagaaaaatattcattctcgacgaataatgtattccaaggtggcatgactcttgttatctttttacagccgtaaatcttacagaactttatgaaaaagcagccttcacctattctaagaaggtccaagaattgctatttaaagtctctaccatttttaata

SEQ ID NO: 11129 - DNA, 765 bp, Diabrotica virgifera
cccacgcgtccgaaaaattgaatcgcttattgatattcatgattacgctgacaacatgccaagtatcatgaaaactttcattgtactatctttcctttgcgtctccgcttaggtctcctaacattattgctatcccgactgagataccgctggtgatccaactgctgccaagtatgatgacaagttcaattgtacagccatatttgcagctatctatgcactagaatctgacctacacaatctcataatccaacatttcatcaaatccttccaatatctactcctagccacctattttgccacataagaaagaaacagaacacgattccaagaactgttccacggcttgtgtgatgacaagagtgatgaaagtattgaatttattacgcatgttacctctctggacgtacacgtgatcttcaatgatatttccagagacaacgaaggagaacaggcataagatcggagctttgacttgggtgtagttactgctattgatatagatctgaacatagataataagtttgaccctgaacctcactccatccatcgagaagctaccaaaaaccacaaacaggtccacgatcctgatatttccaattatttggagaacgaagatgtgcaccatgacagagatcttatcaggaacataactgactacagtactgacttgactggactccataacgcatcagatctgtcattggctctggatatgttagatgactatttactatagatgtatatatttatgattaagtatga

SEQ ID NO: 11130 - DNA, 1123 bp, Diabrotica virgifera
  misc_feature (6)..(28): n is a, c, g, or t
  misc_feature (219)..(272): n is a, c, g, or t
  misc_feature (274)..(292): n is a, c, g, or t
  misc_feature (297)..(361): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(461): n is a, c, g, or t
  misc_feature (635)..(684): n is a, c, g, or t
  misc_feature (689)..(799): n is a, c, g, or t
  misc_feature (802)..(849): n is a, c, g, or t
  misc_feature (857)..(968): n is a, c, g, or t
  misc_feature (977)..(1044): n is a, c, g, or t
  misc_feature (1054)..(1101): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnngnnnnnnnnnnnnnnnnnnnccccnnnnnnnnnnnnnnnnnnnnnnnnnnnnnnnnnnnnnnnnnnnnnnnnnnnnnnnnnnnnnnnnnctctatagggtcttctcgnnnnnnnnnnnnnnnnnnnctttttaannnnnnnnnnnnnnncnnnnnnnnnnnnnnnnngannnnnnnnnnnnnnnnnnnncccttcattccagctttcaataaaaatactaatgattatgctaccttagcacggtcaaaataccgcggccattcaaattaatcagtgggcaggcgagactttatatttaatacaaaaagacatgtttttaataaacaggtgaaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttcannnnnnnnnnnnnnnnnnnnnnnnnnnnnnnnnnnnnnnnnnnnnnnnnnnnnnnnnnnnnnnnnnnncctttttaannnnnnnnnnnnnnnnnnnnnnnnnnnnnnnnnnnnnnnnnnnnnnnnccccctgggaaacccacagggg

SEQ ID NO: 11131 - DNA, 868 bp, Diabrotica virgifera
agaatcatagccacagaaacggcacatatacagcgttgcagaattcaaagggaaaccactgcactattttcccaagagaatttcttcccatgacgatgacaatttcagtaagtgaagatggaatgtgtagcgatccgactcacgccatctcggttccgggtcggatggtgtgaaatttgctaccggctgccaaggtgtgagggaccaggcacctggcagaaattgtgagactgaatccaaattttcatttaatttaagaaaatgtcagcgaattggtacatggaacgtccagggattgatccaaaacccaggaaagttacacataattgaaaaagaaatggcagaccacaatctttcggtactgggactctctgaaactcactggagaggtaaagagcattttaaaacaactgctggcaacgtcgtctatttttcaggcccagataacaaaagtacaaatgaagtcgcaataattgtaccctctaaacttaacgactgcgtaattggatataatactattgatggcagaatatcccttaaaatgagaatatccaccaataccctacaccttgtctaggtatacgctcctacaacagctgcacaagaagaagacatcaacaggttctatggtcgtctagaagaaactgttcgcgctattccgaaacgtgaactcatcataatttttggagattttaacgccaaagtggggtcatctaatgaataatattgaaggagtgctgggcaaaaatggactgggacagagaaatgagaatggcgacgttctagtgggaggtctgtgtagaacacatcctgtagatcacatcatagactagaatgtagaaacagcaggatcaatagatgctcctat

SEQ ID NO: 11132 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (185)..(185): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctttatttattaatatatnttagtacgaaaggac

SEQ ID NO: 11133 - DNA, 818 bp, Diabrotica virgifera
  misc_feature (154)..(178): n is a, c, g, or t
  misc_feature (278)..(297): n is a, c, g, or t
  misc_feature (357)..(379): n is a, c, g, or t
  misc_feature (699)..(699): n is a, c, g, or t
cgtgcgcgagggacctgttatttttatattatttctaatattataaatttaacaaaagagagatcgaatatgtcaaatgtacccattattgtactctcccaggttctggacataatcagcctataatgaaaaaataattcaatataaatatacnnnnnnnnnnnnnnnnnnnnnnnnnctatcgtgttactgattaacatgatctttttatcatccacatcttcacacatattatgctattgaataaactaatcttagatatctaataactcggaaannnnnnnnnnnnnnnnnnnncttgaaataacaaatttgacttctaatttgtgcctctatccatctgtgagggtatttttnnnnnnnnnnnnnnnnnnnnnnncaaggttcggtatacacacccacttgcgagagagcaagtgggaccgaacatatttggttcttgatgtatgatctgactagtcaccgattttcatgcgaatctatgaaagcataacttcagatagaagcgcaatcctttgatgactgcactacccttcctctttcttcccttatttctgctgcctgtatccactgatgagcccatctgagatagatatttaattgttaccataccttggacacatttcacactagaaactccatgtcacttatgacgatgagttttcggctctagctctccgtctattatactatgcctangaaatactactggaccacacatatatctctgacagtatgtatgtcttcctgcaccgatagttgcatggtgactttgcctatcaagcataccatacccgttgtattcacatgaattatga

SEQ ID NO: 11134 - DNA, 912 bp, Diabrotica virgifera
  misc_feature (570)..(590): n is a, c, g, or t
  misc_feature (668)..(684): n is a, c, g, or t
  misc_feature (758)..(758): n is a, c, g, or t
  misc_feature (788)..(833): n is a, c, g, or t
cttttctcattttgacgtcagtggtgtattgctgtggaaataaacaaaagattcttaaacaacacttcccaagaatcctaatagcaacgtttttctggtggctatggacaacagttttcaatgtaatcgaagcatcccttggtagatgtgcaactccaggtttcaatagcaaagtggtatgtttacatgaaggacatgtttggaatggttttgatctgtctggccattcatttattttaatttatggtagtttgttactcatagaagagacaaggtgtatcgtgaactgggacacaataaaagactacatacgactagaggagcatcaacgtttagcgagagatgcaaacgaaaaaccaaatcctttacgcaacctatcggacctggagctaaaagaaatgaagacaaactatgagaagtttacaccgtatataagactgttgtttatagtaattgctgttattcaaattttgtgggatattatgttgatcagcaccatgttgtattaccatatcatgatagaaaaattccttggaggggttgttgctattgttacgtggttttttactnnnnnnnnnnnnnnnnnnnnnccatctctcttgccaaggcttcctggtgaagggaagttcaaatacatgaaaaaacaatcggctcaaactccacccatnnnnnnnnnnnnnnnnngggaaagtttaacaacagatcaagtaccaaggtttatgggcaggcccatttataccaatctaagaccagaaganagcgctacagctagcgtttcaagatagcannnnnnnnnnnnnnnnnnnnnnnnnnnnnnnnnnnnnnnnnnnnnngaaagtggtttggttttggtgataacaaaatggaaaaatggataaatggattgttatttaaatatatacttggtttttc

SEQ ID NO: 11135 - DNA, 635 bp, Diabrotica virgifera
  misc_feature (18)..(50): n is a, c, g, or t
  misc_feature (171)..(185): n is a, c, g, or t
acctctattccttttagnnnnnnnnnnnnnnnnnnnnnnnnnnnnnnnnntcattgtatttagtgatatctgattagcgcgggctagtactcatccatgtctcggtacaagttattccaaatttagcaattatatacccatctgtctactagcgcgatccattaaagtatnnnnnnnnnnnnnnnactcaatatttcgtcgcgattgcacatatgcttaagaacttacatattaatttgtaaatggatacccatatttattaatcagcatatttttgatgatcggcacagggcgatttcaaacaggtttgttagaatataaggaatatgtattagaaagcatcttatttttctgggtcagatacaaatcattgaaagactgatgattgatccataaatccgatagtattttaagacaccttgtaatcaaataatagcgtaaaagaacacgaactcaaaatagctagtactaccttcaataataaggaggactagagaaaactactatcaagtttctcgaatcacgccacttgcattgaatggtaaccatacaattattaagctggggtcctacgtaaagtttgagcggaacgccacgacaaatataggatacgtaagacgaaataaaagaaacac

SEQ ID NO: 11136 - DNA, 855 bp, Diabrotica virgifera
  misc_feature (557)..(575): n is a, c, g, or t
  misc_feature (702)..(702): n is a, c, g, or t
gaaaactttgtgttggaatggccttgtgtggaaattcgaaggttgttatgttggacgaacctactgctggaatggatccatcagcgagacgagtgttgtgggaattattacagaaacaaaaagagggtcgaacaatattgctcagtacacattttatggacgaagctgatcttttaggagatagaatagcaatcatggctggtggagaattacaatgctgtggatccagcttcttcttgaagaagaagtacggtgcgggatacagtcttattatggataaagcgaaaacttgcaatccacataaagttacagaactgctgaagaagtttataccagagatagagatccatagcaatgttggaagtgaactaacttacttgttatctgaaaataatgctcctgtattcgaagcaatgttaaaacaaatagaacaagaatcaaatgaacttggaatcaggagctatggtatttctttaaccactatggaagaagttttcatgaaagttggtgcagaccatggacaagaagaaatttacaatgaaaaacagaaaaaggannnnnnnnnnnnnnnnnnntatactcacttctgctgatttaggtccagaatctttatctccctcgtacactggtggtttacatttgattgtcaatcagttcgtcgcaatgcttatgaagaagattataggaacctttagatcatgngttttgttggcgattcagatatttttgcctatgataaacgttattatagttatgagtgtaccttcaggaagtgttccctctgttttgccggcaatgcctttaaatttagcaagattcactgaccctattactttattgagcgatttgacgatc

SEQ ID NO: 11137 - DNA, 394 bp, Diabrotica virgifera
  misc_feature (2)..(69): n is a, c, g, or t
  misc_feature (79)..(79): n is a, c, g, or t
  misc_feature (83)..(106): n is a, c, g, or t
  misc_feature (124)..(124): n is a, c, g, or t
  misc_feature (136)..(136): n is a, c, g, or t
  misc_feature (283)..(304): n is a, c, g, or t
  misc_feature (314)..(335): n is a, c, g, or t
  misc_feature (346)..(388): n is a, c, g, or t
gnnnnnnnnnnnnnnnnnnnnnnnnnnnnnnnnnnnnnnnnnnnnnnnnnnnnnnnnnnnnnnnnnnnnttttatattnattnnnnnnnnnnnnnnnnnnnnnnnngattccaaattttttttngagtataagaantaaattaccccttagggaataacagccgtaatttttttattgggaaagagtcaaatcgaataataagatggggcgaccccgagggtggggataaaagggtttttatattgtggtagcagcataattatatataaattttgttcgacnnnnnnnnnnnnnnnnnnnnnngggttttaannnnnnnnnnnnnnnnnnnnnntgggtgttttnnnnnnnnnnnnnnnnnnnnnnnnnnnnnnnnnnnnnnnnnnnccgcgc

SEQ ID NO: 11138 - DNA, 840 bp, Diabrotica virgifera
  misc_feature (389)..(402): n is a, c, g, or t
  misc_feature (404)..(416): n is a, c, g, or t
ctaactaccataaccaaataagcaaaggatacttacacagacttgaggactttcctactatttaaagaaatttggacgccgtttgaaaaatcctcaaattcacatatcgagtacttactggacatattccgtacttatgggaaccaatttagggacattcatcttagattcctcattgggtcaaactgggctattatttaccatcctatggcttctatgccatttctttttctttactctaaaacttatttcgtttgtattagacatctgattaataattctccaaaaaaggttacagaaataaaaataggtacattttataatgtttatttaaacctttagactttatttttactctgagaataaacatgttctcaaacaggaaatgnnnnnnnnnnnnnncnnnnnnnnnnnnncaagactttaccattgacaataaagattttacaatcttttctatttccaaaaatacacaaagtttatttattatttcacattatttttacatacataataactctttagagcagtgtatcaaaacaaagtttgacttatgctgtcaagtcaaacgtcactgccattttatctaatttacataaaactttccgagagtccatgttgaaaacaaactattaaaatatttaaaacctttaccaaattgatatccacttgtgaatttaattaaaacaaatattatttcataccttttttaaaacaaaatccatcgtcacacgtcaaacttggcacttaaccaaaattttccatccaagattaaggaagcattcaattctaaccaaacaggaaacaggaccaaagttgagacaaaatcagaaatcgcat

SEQ ID NO: 11139 - DNA, 845 bp, Diabrotica virgifera
  misc_feature (414)..(428): n is a, c, g, or t
  misc_feature (734)..(734): n is a, c, g, or t
  misc_feature (771)..(771): n is a, c, g, or t
  misc_feature (801)..(801): n is a, c, g, or t
  misc_feature (832)..(832): n is a, c, g, or t
gaaccatcagttaataaacttcatccgccggcaacagttatggtaatacaaaagttattagtcggtttgtttgcactcttttgtttgtgtcaagccaaataccaaccgacagccaaataccaaccgacatgggaaagtatagattctagaccattgccttcttggtatgatgaagacaaaatcggaatctttctccattggggagtgttttccgttcctagtgtaaaatcagagtggttttgggcagattggaaagcgggagattcagaggttgtgaattacttaaaaaattattattctcccaactggaagtatcaaaactttgcaaaggactttacagctgaattttatgatcctaatgagtgggcagaaattttcgctaattctggagcaaaatacattgtcttaaccagnnnnnnnnnnnnnnngtattgtctatggccatcaaaatactcatatagttggaatgctcaagatgttggtccaggaagagatattcttggtgaacttgcaacagcagtaagggctaagaatctcaaattcggtttataccactcatattatgaatggttcaatcaactatatctagctgacaaagccaatgggtataaaacacaagattttgtagaccgtaagacagatcccgaattacgggagcttgtgaacacatataaaccttccgttatatggtctgacggtgactgggatgctccagacacttactggaaatctanagaattcttggcatggctgtacaacgaaagcccagtncaagatgaagtagtagtaaacgatagatgnggatctggaattccttgtactcatggagganttttctcatgcca

SEQ ID NO: 11140 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11141 - DNA, 658 bp, Diabrotica virgifera
  misc_feature (311)..(325): n is a, c, g, or t
  misc_feature (327)..(355): n is a, c, g, or t
  misc_feature (443)..(499): n is a, c, g, or t
  misc_feature (540)..(561): n is a, c, g, or t
  misc_feature (563)..(576): n is a, c, g, or t
  misc_feature (612)..(630): n is a, c, g, or t
aacacaaccacatcccaactcggtttcgttttggagtataactttattttgatttaatgtaacacaaattatcatggagtgatgattatattataattattcaataatatcatatttttgtcaacgtgcaatacatatagtaaaccatgtgtatccattcatcattaaattactaattgtatatttatgatttactaattaacatcatatgagtactatgccttttcattgtcaaacaactattctcatttcttttgcagtactgatatgatatttgctcttcaatataatctaactgttttagaaatagnnnnnnnnnnnnnnncnnnnnnnnnnnnnnnnnnnnnnnnnnnnncattataaacattgagtatttttaggaatgggcttagaaatacaatattattctaatataatactttaccaaagattaagatgaactnnnnnnnnnnnnnnnnnnnnnnnnnnnnnnnnnnnnnnnnnnnnnnnnnnnnnnnnnctatatatttcttatttaaatataagtttaacttatatagnnnnnnnnnnnnnnnnnnnnnncnnnnnnnnnnnnnntatatctactaaacatatatctcgttagtaaaggtnnnnnnnnnnnnnnnnnnncccatgtttattaaaaaactgccttttt

SEQ ID NO: 11142 - DNA, 727 bp, Diabrotica virgifera
atcactcaatcctatgtcggcgtttacacctcaatgcattgagtggcatatgactagcccggtctatccttaccatgtctctggccagattagcccaagtctagcaattaggtacccatctgtctactagcgtgacacttactgtatatctgtaataaaacaactaaaatttttgcggttgcagattgccttagggacttaaacattaattgataaacagatacctatatcaaataattaacatatttttgatgaacagtacagggtgtttcataaaaggtttgttagaatataaggaatattattaaaaatcatcttatttttctgggtcaaatacaaatcaaagaaagactgatattgatacatagatcagatagtattttaaaacaccttgtacgcaaatagtagcgtagttgagcaagaatcacaaaatagcaggaagtacctacaggaataaggatgaatagagaaaactaataacaagtttttctaattacgccactgtttgaatggttacaagaacgtattaagctggggtccaacggaacgttgagcggcacgccacgagaaatataaaatatgtaataggaataagataaaaactaaagacgggagtcaatgtaacgtgaaatagcgtaatttccctcaaaattttgtggtttacggcccttaagctaggaccgaacctatattttatggtcggcatagatccgggggtgaagtctct

SEQ ID NO: 11143 - DNA, 437 bp, Diabrotica virgifera
tgagaagtagtcgtgtatgtgtagctgctattaaaaaaataagatgactgaaactttgcgagaataaggtacccttttgcgtgacagatggaaggttcataaataaccagatacatccacatgatcgcgagatcatgaccccataattacaaaagaaagccaagaaaacgagatgagagtattcgtaccaaacacttaaagagatatatggaaaagactaagctacaaagtaccaccctcagaagaaaaggatcctacgtctagaacataacgaagctaatctgcatataaacatccgaatttattttcaagacacccccgatagaataaaaccctgtaagaattatgatatacgggaaagcgcgagcgaaaaaaatgactgtttgttcactgtttaattttaagaatttgcatatattacagatactacatattca

SEQ ID NO: 11144 - DNA, 363 bp, Diabrotica virgifera
  misc_feature (6)..(98): n is a, c, g, or t
  misc_feature (101)..(120): n is a, c, g, or t
  misc_feature (122)..(154): n is a, c, g, or t
  misc_feature (165)..(187): n is a, c, g, or t
  misc_feature (221)..(275): n is a, c, g, or t
  misc_feature (287)..(307): n is a, c, g, or t
  misc_feature (323)..(347): n is a, c, g, or t
gtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnnnncnnnnnnnnnnnnnnnnnnnnnnnnnnnnnnnnncgaaaaaagcnnnnnnnnnnnnnnnnnnnnnnnagaagaccttatagaagttttataaagattatannnnnnnnnnnnnnnnnnnnnnnnnnnnnnnnnnnnnnnnnnnnnnnnnnnnnnnaattgggggcgnnnnnnnnnnnnnnnnnnnnnctttttttatgataannnnnnnnnnnnnnnnnnnnnnnnngcaacccaattttttt

SEQ ID NO: 11145 - DNA, 410 bp, Diabrotica virgifera
  misc_feature (195)..(212): n is a, c, g, or t
ctcttacgtagcgagatgaattccaatgtgtattgtgtatctctctcgttgtaatacgccgttaagcacggtattgtcatctcgtgttaaatatatctgaattttgacatcacaccttctacaatgagctccgtgtctatacatatgaacacctattcctcttcaatgaagctccactcatgcctaaggttgagnnnnnnnnnnnnnnnnnnagtttgaattttcaacaagactcaatagttgtagacatccaagccgtacactacgtgaatgcttatgttccctatcactggtatcccgacgttctacggatatgattgtcaccacacatccgacccaatctacgtaagttacggtcttgcccgacactatccatccattatggagattggccagagtttatgacttag

SEQ ID NO: 11146 - DNA, 863 bp, Diabrotica virgifera
  misc_feature (7)..(61): n is a, c, g, or t
  misc_feature (687)..(687): n is a, c, g, or t
  misc_feature (764)..(764): n is a, c, g, or t
  misc_feature (797)..(797): n is a, c, g, or t
  misc_feature (807)..(807): n is a, c, g, or t
cttgagnnnnnnnnnnnnnnnnnnnnnnnnnnnnnnnnnnnnnnnnnnnnnnnnnnnnnnnattgttgtattcagtttgtgtgtcagtggagtttaaatgcggtatgttgccgtgactttattaatcaataatataatgcggtacacaatagcagacactttcttgttttatgtgaattaatttgactcatatacagaggaataaaacaacatggaggtagaagatataatgtgcgatcaaagcattttacaccctgaagtaaatgttcagtttgatagtaaatcaccatatccagttattccagcaagcaaattatggatttttatagacttagtggccagatctatcgttccaccaatttcaacaatttgttacacagtctttaaaaatcctcaagtggttattcagaatgtaagataccaaattttcccagcagttgtagcatttttagttaataatatatctggatcattagcgtccgtccaaaatataacattaccagtaactttaagaataacgcggggtccagatggacgcgacagagctgtgattagcgacactaatgaagatactgattctgaaacgccagaaaaatcggttgattgtttggttttatttgaaccagaagatatcgatattgacgttatatttttgcatgggcttcacggagcaatcaataaaacatnggaaacaaggagtttggagaacaagctcccacaagctcaacaaacaatcgccctgtaagaaggctatcgacaggcgnatatgtacgtcccaaccaaagaccatacattanaaagaaccantttcaagtatttattccaaaatacccaacaaagtggcgagacgagaagaaatgaac

SEQ ID NO: 11147 - DNA, 195 bp, Diabrotica virgifera
aattacgattagaaattttcctattttaaaacatgctataattgatatttgtctagcattatggctactgggttataaatttcttatctccacctacaaccgaaccgtctacatcttataggcgctggtaccattcggatactcgacatgtttaattgtgaaacttctagacgtaacactcggaagttactggac

SEQ ID NO: 11148 - DNA, 177 bp, Diabrotica virgifera
ggtggccctggatttggaggtggcgctgctctttggtagtcctgcaattatgatattgtttcagagatagtaaagtagggcgccagtggaagtgatgcatatggagattaacactagccctattgctcaagttcgtataaaattgataatgaattcttaactgattattacatatat

SEQ ID NO: 11149 - DNA, 517 bp, Diabrotica virgifera
  misc_feature (240)..(258): n is a, c, g, or t
acgtgttgatcgctactgtttgctcttaaatacattgcaaatcagtatcatcatttctgtatcataaatatatttatttcagcgtaaacgcagacatgaagaagacggactcaagcattcagccaggtataattcagaaataaacttgcgcaaaggaatacatgaggaagccgcggaaaaggtaattaactttctttaattaatgaatcaaaaacagcttcaaaattattaatgtttagnnnnnnnnnnnnnnnnnnnaatgtaatgacgtttcttaagacgcgaggcgatttattttagctatttttcgctaaagtaaagctcaattgatacatttgtttttattttctgagtttttgtagttcattgtttacttatgttttatgggatgggtatcttctttgttgacaccttcgtcttagattacttctttctaagaatttagtatcgcttatgttttttgtgtaattatacctgttatataagctagggagatgtgaaggagcaagcaaatgag

SEQ ID NO: 11150 - DNA, 535 bp, Diabrotica virgifera
  misc_feature (2)..(164): n is a, c, g, or t
  misc_feature (171)..(190): n is a, c, g, or t
  misc_feature (192)..(268): n is a, c, g, or t
  misc_feature (288)..(305): n is a, c, g, or t
  misc_feature (309)..(328): n is a, c, g, or t
  misc_feature (480)..(512): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggtgnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncccttagggaaaaaccaggnnnnnnnnnnnnnnnnnngttnnnnnnnnnnnnnnnnnnnngccacccccccaggggggaattaaagtttattaaattgggggggaacacccaatatttaatttaagcctgtctcccttttttaaaatttttccctgcactcggggttctcaaaccgcgggggggaccccggggggggctcttatattctctnnnnnnnnnnnnnnnnnnnnnnnnnnnnnnnnncacacacgagggagcccacaaaa

SEQ ID NO: 11151 - DNA, 342 bp, Diabrotica virgifera
  misc_feature (4)..(52): n is a, c, g, or t
  misc_feature (58)..(84): n is a, c, g, or t
  misc_feature (249)..(272): n is a, c, g, or t
  misc_feature (281)..(305): n is a, c, g, or t
gggnnnnnnnnnnnnnnnnnnnnnnnnnnnnnnnnnnnnnnnnnnnnnnnnngtcccnnnnnnnnnnnnnnnnnnnnnnnnnnncttgggaaaaaggggaaatttttttgaaaagttcaatcccaaaataaaaatagccacccccgctggtgtattaaattttttatatggggggggagcgcccgttatttttaaaactttttccccctttttaaaaaattttctcagtctctcgaggttaaacccgcnnnnnnnnnnnnnnnnnnnnnnnncttccttcnnnnnnnnnnnnnnnnnnnnnnnnntttttgtttttctagccaaagagggccccccctaaac

SEQ ID NO: 11152 - DNA, 776 bp, Diabrotica virgifera
  misc_feature (23)..(55): n is a, c, g, or t
  misc_feature (93)..(121): n is a, c, g, or t
  misc_feature (149)..(179): n is a, c, g, or t
  misc_feature (181)..(238): n is a, c, g, or t
  misc_feature (246)..(263): n is a, c, g, or t
  misc_feature (314)..(327): n is a, c, g, or t
  misc_feature (329)..(371): n is a, c, g, or t
  misc_feature (402)..(428): n is a, c, g, or t
  misc_feature (464)..(498): n is a, c, g, or t
  misc_feature (530)..(556): n is a, c, g, or t
  misc_feature (658)..(678): n is a, c, g, or t
catcagggattatgaattagtannnnnnnnnnnnnnnnnnnnnnnnnnnnnnnnnggtataggttgaaaattatgattgttattgtgagatannnnnnnnnnnnnnnnnnnnnnnnnnnnngatagtaatatctactatacacatatcnnnnnnnnnnnnnnnnnnnnnnnnnnnnnnncnnnnnnnnnnnnnnnnnnnnnnnnnnnnnnnnnnnnnnnnnnnnnnnnnnnnnnnnnngatgaacnnnnnnnnnnnnnnnnnntacgattgaatttttgaataaacaataagagtgaagaagtttacatatcannnnnnnnnnnnnngnnnnnnnnnnnnnnnnnnnnnnnnnnnnnnnnnnnnnnnnnnncagtaaaatattaatgtaaagtatttaaagnnnnnnnnnnnnnnnnnnnnnnnnnnntgaagttgtagatttattaatgatatatcggtatcnnnnnnnnnnnnnnnnnnnnnnnnnnnnnnnnnnngtattaaaaccatggtctttgagtatgaagannnnnnnnnnnnnnnnnnnnnnnnnnngatgaagggccgcggtaatatgaccgtgctaaggcagtataatcatttagtttttttaattgaacgccagtcatgccaaaaagtaggatggggggaaaccgnnnnnnnnnnnnnnnnnnnnnccgattgtctgtttttagggaaaaagggtaaaattttttgttgagacgacaacacccctatttcagctgtttttcctcccttcagaaaaatctttttt

SEQ ID NO: 11153 - DNA, 1121 bp, Diabrotica virgifera
  misc_feature (384)..(402): n is a, c, g, or t
  misc_feature (728)..(728): n is a, c, g, or t
  misc_feature (940)..(956): n is a, c, g, or t
  misc_feature (1000)..(1035): n is a, c, g, or t
ttaaaatgtgattttccatattttaaatcccttcgtaagaaatcatcaatattttgaaatctgttattagtgatttcttacgaagggatttaaaatgtgattttccatatttcgtacctgaaaactataaagtttttagtgatagacaagaatttttgaggtatgccgaggcatgtgagctcagacaaactttagaaacgaccaaaaatcatgaaactttacaagaaattggcaagaaagttcatgagactttaaagactttgaaacgaactaatgacgaaatgtatttcaacgcaccacatctaaaacgttttactgccgaatcagtatattgtggaattttaaccagtatttgtgaaacattaaaaacaaaatacgccgacnnnnnnnnnnnnnnnnnnncaatttagaatgtgtgtactgattttcagccttagtaaatggatttaattacctccacagataagcaacttttgacaagctgtcagtaccacctgttctacgtttcgcttgaccgaccgcagtatgtttctctacacagtcacggtaatgaactgtgaaaaaactagctttagtaaattcagagagatttttcggcgctgcctctccgtctatcaagtattgggatattttgcggttcttaagtatccaactaagtttacataatcttgctctcctagtaatttccgcactttggttctctttgcaagtttcaggatttggcctanatagatttatattcctcgactttttctatcccactgccatttatatatttacggctggggtcgtctgtgtttgtcatcatttttgttttcctcattcatttttagaccgacgcattatgagatgcctgcgagttcctccatcattatgatgtaaaatcgccctaactaagcttttaatcccgaaatatgcattgctctttcgaaaaaaccgnnnnnnnnnnnnnnnnncctcaatttcccaatactggttattaatggtaccaaatattggnnnnnnnnnnnnnnnnnnnnnnnnnnnnnnnnnnnncacgtattttttcaatttttttcaattttgaggttcaattttccccaaaattttttcgcctttttggtttgggaaaaatttttggg

SEQ ID NO: 11154 - DNA, 889 bp, Diabrotica virgifera
  misc_feature (139)..(179): n is a, c, g, or t
  misc_feature (187)..(210): n is a, c, g, or t
gagccttctaaaccacctgagaacgaatacgaaaataaattgagggccttcctggatcaaaccaagggcgactccgactatgaggacaaactgagaaaattcctggaagagacaaaatggaagaaaggcaaaggcgagnnnnnnnnnnnnnnnnnnnnnnnnnnnnnnnnnnnnnnnnnagagagcnnnnnnnnnnnnnnnnnnnnnnnnatcaagagaaaacagagcttcgatttgagcgaattggacgaccacaagaagctaagggacgccattaagaaggaattgagcaaagaaaagaaatcgaagaggcacagtttggcgtctgaagacgacgagtacatcctgcagaagtcgggttatagtaagaacattaaagaacgaagcgcgagccctcccaagcgcattatagactccccgtctcccacaagggagcagaaggcgcgacaggcagtagccgaagctacggcctctgcgggggcccagaagtggaaaatgcaaattgccggcagttcgggcaattccaggttcaaaaagaagcccgaaagagcgcctcctgcttctgattggcagtctgatagagacaaacgagagcgggagcgagaacgcgatagagagagggaaagagagagagaacgtgctaagagctcttctgcctctgacgattctccaccaccgaaaaaaatgtctttgcctccacttcctccagctgagaaggccgttagtgtgcgcaaggccatggcattgaaagaaccgccactcaaaagcctgagtctccaaaaagttaaaactgactccagctccacccttgccgaaaataccgcagggacaagttgtgcttgataaatttggaaacttcaggctgatttctccgcctgaattgaaaaag

SEQ ID NO: 11155 - DNA, 605 bp, Diabrotica virgifera
ctaaatacagatgttggtgtactgaaatggagattacaaagtactgaggaagctctaattccactcttaataaattgctggccttcagaagcgggagatggtagttgcgatgttaatatagaatatgagcttgcccacactaatttggaactagttgatgtcaatattgttattcccttgccaattggatgttcaccaatagttggtgaatgtgatggtatgtacacacacgaagccaagcgtaatcaactggtatggaatttgcctctgattgatgccagtaataaaactggttctttagaatttaacgctcctagggccatacccgctgatttcttcccgctttccgttggattcaattcgaagtcatcctatgcgagtattaagattaccgaagttgtcctagttgatgatgattctcctataaaatattcagtggagaccgcactatatccagataaatatgaagtagtataatggggcagaagtaaagaatcacttgtaaaaattatataactaatattatatcttatatgcaacattgctttttgtacaaaagttaagtaacttgtctttattttatctatattaataaaataagtaag

SEQ ID NO: 11156 - DNA, 283 bp, Diabrotica virgifera
cagatagataacctcagataacctacaataatataatttgtctagttcatagttcattgagttcattccttcttattattttgtgatcagaattttctattaagagaacgtaaaatttcaacgacgggaaagggagaaacacgcagtaacacaacataatcgtatggctataaatcccccttttaaaagttgttgaattattgaatagttacggatcgatagaccttcccgatatgtgagcagaaagaatgtgagatgcgatgagacctgtaacgacgcatta

SEQ ID NO: 11157 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (164)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccccaggttggttnnnnnnnnnnnnnnnnnnnnnnnnnnnnnnnngaaagg

SEQ ID NO: 11158 - DNA, 967 bp, Diabrotica virgifera
  misc_feature (914)..(914): n is a, c, g, or t
cggacgcgtgggtgaacatctctcaaataatttatcaacaaattatgttctcagtaaacagatttcttaaagtaattgtagttaatacaagtatgttagacactaactcaatatgaaactcatatcgcaagacgtcgataaaaatggtgagggcactgttgctctcatcccagaagagccagaagatatgtggcatgcttacaatcttatttctgaaggagattccgtaaaaagcactacaatcagaaaagttcaatctgagtcttcaactggttcctccacatctagtagagttcgaacaacattaacaatatcagtggaaaatatagattttgatactcaggcatgtatgttaagattaaaaggaagaaacatcgaagaaaatcaatatgttaagggtttggctaaattttatgacactgtgatgcaagccattctaagagacattaacttcgatattgttaaatgtatactagttgcatctcctggatttgttaaagatcagttttatgagtacatgtttcaaactgcagttaaaacagacaataaaattttgctagaaaataagtcaaaatttatgctaattcattcttcttcgggttttaaacattctctacaagaaatactacaagatccatctgttataaacaaaatatctgacacaaaagctgctggtgaggtaaaaatcttggaaaacttttacacgatgcttcaatgtgaaccagccaaggcgttttatggtaaaaaacatgtcgaaaaagcaaattcggaacaggctattgaaactttgcttatatcagacaatttgtttagatgtcaaaatgttaaactgcgaaaggaatatgttaatttggtggattctgtcagagaatcaggtggggatgtcaaaatattttccagtcttcatatttcangagaacagctagagcagttaactggtgtcgcggctattttgcgatttccaatg

SEQ ID NO: 11159 - DNA, 415 bp, Diabrotica virgifera
  misc_feature (66)..(149): n is a, c, g, or t
acttttagttattttgaatcactaacacagtttttcgtaccagtaaaccaaaaacttttattgacnnnnnnnnnnnnnnnnnnnnnnnnnnnnnnnnnnnnnnnnnnnnnnnnnnnnnnnnnnnnnnnnnnnnnnnnnnnnnnnnnnnngaatcaaacaactacataactattacatttcattttatcgcctataacgttgatccttttttatggctcagcagcgtaatagatatatcttatggacaaagctcaggcaggacacgatatgtgaatgctctgcccttctcgttgctgaagaacacctctacattcactccgaagctccagattgctccgtagatagctctaacccatacacgtacataatcatcgaggacgggcgtctgaaacgagacttaaacatgtctaaatat

SEQ ID NO: 11160 - DNA, 758 bp, Diabrotica virgifera
  misc_feature (158)..(175): n is a, c, g, or t
  misc_feature (297)..(318): n is a, c, g, or t
  misc_feature (560)..(581): n is a, c, g, or t
  misc_feature (655)..(678): n is a, c, g, or t
cgttatttatttgaaaataagataatatttgtgactaaacgtaacgaaaaattttatcgactgatagttaattccccatgggtgaggaataatgtattctcatacacgaccaatttatctgttcgtacttggtgtatctcggattattaactaatcannnnnnnnnnnnnnnnnncgattctaaacgagctagaccatcgaactttttatagacaaatcaatatattaaatagtgtttttgacatgaaatgtgattcgcttattcaatagtatctcgctgttgaagaacataactcnnnnnnnnnnnnnnnnnnnnnnattataattacctattcttatattattattattagatatgtttcgggatgaccttacgaatatatttctattaaaatcttattcttaactcagaactaggattaccacttttcatatttaagaataggttattatttactcttctatattattatttttatccttcatatattttctattataatatcattgtcaattattttaacttagaagacgtgataagactcacatcattttcttgnnnnnnnnnnnnnnnnnnnnnngcataatagaagaatcctacaacattttattcacctgataattaatatcatgtctttatgtactaactctgacnnnnnnnnnnnnnnnnnnnnnnnnagaatgggcgcggtatacttgaccgtgctattgtatcatgatcattagctttattattgcacgctgaaaagattggctgg

SEQ ID NO: 11161 - DNA, 169 bp, Diabrotica virgifera
  misc_feature (79)..(96): n is a, c, g, or t
  misc_feature (133)..(154): n is a, c, g, or t
ccctaagggaataacagcgtaattttttttgggagaggtccaaatcgaaaaataaaaatggggacccccaagggtgggnnnnnnnnnnnnnnnnnnggggttacccactaatttttttaaagtttggttcccnnnnnnnnnnnnnnnnnnnnnncctgagggttttaaa

SEQ ID NO: 11162 - DNA, 905 bp, Diabrotica virgifera
ttgatctcaaacaatactcagtaataatgttggatgaagctcacgaacgaactatacatacagatgttctctttggattattaaaacaagcagtcatgaaacgagaagaactgaaactgatagtaacctcagctacgttagatgctgtaaaattttcgcagtatttctttaaagcgcccatatttactattcccggtaggactttccccgttgaggttttgtatacaaaagagccagaaactgattatttagatgctagtttgataacggtgatgcagatacatttgagagagccgccaggagatattttactttttttgactggtcaggaagagattgacactgcttgtgaaattttgtatgagagaatgaaatctttaggtccagatgtacctgaacttataattcttcctgtatattccgcgttgccttccgagatgcagacaagaatcttcgaaccagcgccacctgggagcagaaaagttgtgatagctacaaatatagcagaaacgtctttgacgatagatggtatctactacgtagttgatccaggctttgtgaaacaaaaagtctataactccaaaactggaatggattcattggtagttacaccgatttcacaggctcaagcaaaacaacgagcaggtcgtgctggtagaacgggacctggtaaatgttacagactatacacagagagggcatacagggatgaaatgcttccgacgccagtacctgaaattcaacgtaccaaccttgcaacaacagtcctgcagcttaaaactatgggtatcaacgacctgcttcatttcgatttcatggacgctcccgccggtggagtcgttaattatggctttggaaacagtacattccttgtcagctcttgatgatgaaggggtattgacacg

SEQ ID NO: 11163 - DNA, 307 bp, Diabrotica virgifera
  misc_feature (12)..(91): n is a, c, g, or t
  misc_feature (97)..(119): n is a, c, g, or t
acgcgctccccnnnnnnnnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattctt

SEQ ID NO: 11164 - DNA, 584 bp, Diabrotica virgifera
  misc_feature (49)..(74): n is a, c, g, or t
  misc_feature (105)..(135): n is a, c, g, or t
  misc_feature (238)..(257): n is a, c, g, or t
  misc_feature (324)..(344): n is a, c, g, or t
  misc_feature (350)..(371): n is a, c, g, or t
  misc_feature (448)..(470): n is a, c, g, or t
gcccccctttatgcggggttgaatattagggggtggtgttagggagagnnnnnnnnnnnnnnnnnnnnnnnnnnagaattaggattgtgagaggaggttttatcnnnnnnnnnnnnnnnnnnnnnnnnnnnnnnnggagtatcagggattattagttaataggtatacatttatcattcacaaatataaaagagctaaagaattaaaagttttatagaggaccaaataagctaaatgnnnnnnnnnnnnnnnnnnnngtattcaaatatagatatatctaattgtttataaagtcaattgaatttatttattatctagaaactnnnnnnnnnnnnnnnnnnnnngattannnnnnnnnnnnnnnnnnnnnnggcttgatagtaaaaactaatgatgatttgatctctgcataaaatcaggattggaaattgtcatattttaaagtatnnnnnnnnnnnnnnnnnnnnnnnattacttcttattcataatggactgtttattagtagataaaattgaatttgttacaaatttacaatgatgataataatagggattaatcatatgcatatcctgaaaaaatatag

SEQ ID NO: 11165 - DNA, 267 bp, Diabrotica virgifera
ggagcgattaattttattcagtgtatcgaattttaaatccttttttagtaggaataacattacactactttatgagtttagttaattatagtttaaaagtaaaagtggggagtgagttggtatcttcacttcagatgcagctaatctcagtaagaactttgaaactagcgactacagtataatattgatgaccatcattgcggtctccatcatgacaattagagacaaagctgcacagacgcgccaaaatgcaaatagtcattttac

SEQ ID NO: 11166 - DNA, 278 bp, Diabrotica virgifera
ggggagcggggcggaattcgcggggccaccccgccgccggctggtgttggctgtataagaaatgataattgaatacaatgttatcgtcaatctgtacttcctacagttacagtatgctcgagtgctttgatgagaatgttcaataggaaatagaggtatatagttagtcattgtgcgtataagaaaactataattatggtgtataagttgattctgcgccatttatagtggagtccatatcttaagtagtgatgtatgatcgtatgatcccaatgctt

SEQ ID NO: 11167 - DNA, 800 bp, Diabrotica virgifera
  misc_feature (5)..(568): n is a, c, g, or t
  misc_feature (575)..(612): n is a, c, g, or t
  misc_feature (632)..(645): n is a, c, g, or t
  misc_feature (648)..(670): n is a, c, g, or t
  misc_feature (678)..(700): n is a, c, g, or t
  misc_feature (730)..(761): n is a, c, g, or t
  misc_feature (768)..(794): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnttagat

SEQ ID NO: 11168 - DNA, 784 bp, Diabrotica virgifera
ggaggaataactttcgcttcgttccgcttcgcagagatcagaaaaacagtgtaatcttcttctctcgggtggaacgaaatgtcgaaaaataaagaaaacctttcgggcaacagaaaaaccaaaaatttcgggaaaggtaatcaaatcatcgaaaaatcggtttctctcaatctcggaaaggaaataattcttcgcaggatcgtttctaaaagagtcgttttggtaagtacctcggtaacatcggttctcggtaggggatggaaggaaaaaacacttccacttcacaaaggttggttaaagagtttggaactcggaatttaacaactggagaacattcccttctaaccattttggccagccttgggatggattcgaaacgagaagcacagtatcattttttcagaaaacgtcgagtaactggttattatgggatatattttaaagaaacttgggatatagggaaaggttataaggtattgggaactcctagaaattcacgagtacatttcaaagtaattggtggatcaaatggtctagtattttggctagatatagaataaaaggtttcacaatttttttggtcctcttcaattttgttgggtataacatggttcaacaaccattttttcttcaaagaagccaaagatgtgtttatggattttcttcagtcggaggggggtaaagatatggtaataataacagacccaccatttgggggaagaacagagttgatttcagcaacatttaaaagcataaataatcaatatcagaagcttacccaaac

SEQ ID NO: 11169 - DNA, 97 bp, Diabrotica virgifera
  misc_feature (6)..(91): n is a, c, g, or t
gggtgnnnnnnnnnnnnnnnnnnnnnnnnnnnnnnnnnnnnnnnnnnnnnnnnnnnnnnnnnnnnnnnnnnnnnnnnnnnnnnnnnnnnnnacctta

SEQ ID NO: 11170 - DNA, 601 bp, Diabrotica virgifera
  misc_feature (2)..(15): n is a, c, g, or t
  misc_feature (17)..(53): n is a, c, g, or t
  misc_feature (68)..(402): n is a, c, g, or t
  misc_feature (409)..(446): n is a, c, g, or t
  misc_feature (466)..(479): n is a, c, g, or t
  misc_feature (482)..(504): n is a, c, g, or t
  misc_feature (512)..(534): n is a, c, g, or t
  misc_feature (564)..(595): n is a, c, g, or t
cnnnnnnnnnnnnnncnnnnnnnnnnnnnnnnnnnnnnnnnnnnnnnnnnnnncgattaatttgaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11171 - DNA, 130 bp, Diabrotica virgifera
  misc_feature (48)..(78): n is a, c, g, or t
ctcccaaccggctcctgaagctcaacaacgctctgtagttcaacaacnnnnnnnnnnnnnnnnnnnnnnnnnnnnnnntacgttatacgtagtaaatttgtaaagttaatagaacccaatataatttaat

SEQ ID NO: 11172 - DNA, 802 bp, Diabrotica virgifera
  misc_feature (23)..(53): n is a, c, g, or t
  misc_feature (189)..(219): n is a, c, g, or t
  misc_feature (404)..(528): n is a, c, g, or t
  misc_feature (567)..(584): n is a, c, g, or t
  misc_feature (692)..(711): n is a, c, g, or t
ggggaagtcactaagaaagaggnnnnnnnnnnnnnnnnnnnnnnnnnnnnnnncgatcaagaaactagcaaacacagttgccaatgcaggtggcgttggaaagattgttcctgaagatgaggaagatgtgccagatctagtagaaaatttcgatgaggcatcaaaaggggaagtcactaagaaagaggnnnnnnnnnnnnnnnnnnnnnnnnnnnnnnntgatcaagaaacatttacttttagtaaacgaaacttttttgacacattttcttggtctcgattattgtttttaaattgaagacaacattttttgatatgagttgaaatcgtaaaatctaacccaatcattttttgttgatacttgggcatatgtataggatatttcataggaaatacataaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaaggaaccaaatttaaaaaccggggggtgggaannnnnnnnnnnnnnnnnngggccccaaaattcaattcccggggcgggtttttaaaacggggggggggggaaaacccgggggttccccaatttaatccctttggaaaaattccccttttccccagtnnnnnnnnnnnnnnnnnnnnccccccccatcccccttcccaaaattttgcccccctaaaggggaaaggggacccccccttgaacgggcatttaaacggggggggggggggg

SEQ ID NO: 11173 - DNA, 876 bp, Diabrotica virgifera
ccgcagagctcttctgaaagttataaatcacgaagaaggagaagctgtattctctgctcaaggtggtaatgttctaaaagactttgagaaaaactgtacaaaaactagaccacgatgtccaggctgcacaaaaggttgaaaacttccatcttcccgctcattcttcggtgctcgttatgtctcaacttcccaaacagggaacagaagaaagaagagatcacttccaagttacaaataacggaaatgttacaattgatgctgaggtaacgcacgttgaaagaattttgcaccttggaccacgtcatctagtaactcttttgcctggacagagccacacttttgatcttagtggaactcactttaatatggctgtcttaaaggtgagaaatcatgaggatggagaggctttattctctgctgaaggtggaaatgttcttgaagatatggagaaaaacatacaaaaactacctccaagtgagcaggttagacacaaagtcgaaaatgttcgtctccctggccgttcctcaatgcttgttatgagacaacctactagaaatggcgaagagcaaaggcacgatcagttctttgttactaataagggaaatgttaaaattgatgctgaggttactcatatcgaaaggatggtacatcttggaccaagccatctcgtaactattctacctggccagagccatacattcgatcttagtgatctacactaccgtaatactctgctaaaagttataaatcatgaagacggagaagctgtattttccgctgaaggtggagatgttttaaagcctttgaaacgactgtacagaaactcgaaaatgaagttaaggtaccacaaaaagttgaaaacctccatctttcctg

SEQ ID NO: 11174 - DNA, 911 bp, Diabrotica virgifera
aaattttctttaaaatcttcaaataaacaaaaagtttctaaattaatttagtatgcctattaaaaaaggcaacacgctgctttataagggcagcaactacttaagacaaagattaattctctcagttttaagtggaaaacctgttcaaatatctgaaatacgaatacaagaagatgaaccaggcttaagagagttcgaagttagtttaataagattattagataaagttacaaatggtacagtcatcgaattaaatgaaacaggaacatcattatattttcaacctggtctgctttatggaggtgaaatagagcatgactgttgtacagatagagctataggatactacttagaagctttggtgatttttggtatattttgtaaacaacctgtaaaagccaaactaaaaggagttacagccaataatatagatccctcagtagacctcataaaaacgtctatgattcaaacattgaaaagattcgtattggatgatgacgatttagacctgaaaatttccaagaggggctcgaggccactggggggaggtgaagtaacattcagatgcccagttcgaaaacagacgaggcctgttcaattgttgaagaatggaatggttaaaaggataagaggtacagcctatgccttaagagtgtctcctgctatagctaacagaatggtagataaagcgaagggtgttctcttaaattttattccagatgtttatataaatacagatcaatgtagggggaagcaatctggaaatagtcctggatttggatacatttagttgctgaaacaactgagggagttcattattcagcagaacaggtttccaatgttgtagcaaataatgaagatccttccgtaccgaaagactaggaatagctgcagcgcagcgattattatac

SEQ ID NO: 11175 - DNA, 959 bp, Diabrotica virgifera
  misc_feature (217)..(237): n is a, c, g, or t
  misc_feature (505)..(522): n is a, c, g, or t
  misc_feature (589)..(605): n is a, c, g, or t
  misc_feature (607)..(633): n is a, c, g, or t
agaagataactcagtggaactatcagctaaagttaagaaagagatagttgaaagtggtcaaggatatacagaacatcagctatttacatccctagatattaaagacttgaaaaacgaatcagaagataactcagcaatggaactatcagctaaagttaaggaagagatagctgaaagtgaccaaggatatacagaacatcaggtatttacatccgcnnnnnnnnnnnnnnnnnnnnntgaaccagaggaagatgaaggtttttctcagaaccgaatggaaataatgaaaaaacttgcatgttctactgaacaacaaataagtgcaaactctggagaaacaacaacaaattctattagtaaatgtataatttgttgtaagcaatttaaacatgaatggtatttgaaacggcatatgagaatacatactggagaaaaaccttaccagtgtgaaacatgttttaaacagtttattcaagcaaacggtttgaaaacacatttgagagtnnnnnnnnnnnnnnnnnntttccagtgtgaactttgtttcaagcagttctttcagaaaagtaatttgaaagcacatttggcagtnnnnnnnnnnnnnnnnntnnnnnnnnnnnnnnnnnnnnnnnnnnngttttttcagaaaagtaatttgaaatcacatttgagagctcatactggagaaaagccccacaagtgtgaaatttgcttcaagcaattttctcgagtaaacgtattgaaaattcatttgagggtacatacaggagaaaagccacacaaatgtgaaatttgcttaaagcagtttactagagcacacgatttgaaaattcatttgagagtacacaccggcaaaaagccttacaaatgtgaaaattgttttagtcatacagtggcaaaacaactttgaaaactcatttgaagacacataccccagagaaaacccgtacagtgtcaaattt

SEQ ID NO: 11176 - DNA, 681 bp, Diabrotica virgifera
  misc_feature (576)..(593): n is a, c, g, or t
  misc_feature (597)..(636): n is a, c, g, or t
tttcgtccggctacgcaaagcactccttcacaagttcccacggaatcaactgctgcccctggaccatacacaacaccagatctcatatgtacagatgaaaataattattttccttacatttatgattgctcaaaatactacgaatgttccaacggagtaccagttttaatggattgtccaaaaggagaattttggaatattaaactgaataactgcgattggcctcaaaatgttgattgttcatacgttgtaaccacatctggagcatctactgtatctactgaagcacctactaaagcacctacagaagcacctactgatgtacctaccgatgcacctacggaaggacctggaccatactacacgacaccagaaattatatgtaaagaagataatacttatttcccatatatttttgactgctccaaatattacgaatgctcaaacggacagccaattctaatgacatgtcctgctggacagttatggagtaatttactaaaaacatgtgattggcccgcaaacgtcgattgctcatacgtcgtaaccactcctggtccagatacagcaacaacnnnnnnnnnnnnnnnnnngatnnnnnnnnnnnnnnnnnnnnnnnnnnnnnnnnnnnnnnnngtcgaaaaccaaatactctctatcaataaaatacttaatccctgc

SEQ ID NO: 11177 - DNA, 1050 bp, Diabrotica virgifera
  misc_feature (20)..(64): n is a, c, g, or t
  misc_feature (81)..(114): n is a, c, g, or t
  misc_feature (121)..(177): n is a, c, g, or t
  misc_feature (200)..(296): n is a, c, g, or t
  misc_feature (298)..(361): n is a, c, g, or t
  misc_feature (386)..(476): n is a, c, g, or t
  misc_feature (509)..(525): n is a, c, g, or t
  misc_feature (528)..(560): n is a, c, g, or t
  misc_feature (594)..(618): n is a, c, g, or t
  misc_feature (626)..(646): n is a, c, g, or t
  misc_feature (654)..(727): n is a, c, g, or t
  misc_feature (750)..(774): n is a, c, g, or t
  misc_feature (801)..(825): n is a, c, g, or t
  misc_feature (852)..(894): n is a, c, g, or t
  misc_feature (896)..(978): n is a, c, g, or t
  misc_feature (983)..(1017): n is a, c, g, or t
  misc_feature (1020)..(1045): n is a, c, g, or t
gtaaattagtatttgtgagnnnnnnnnnnnnnnnnnnnnnnnnnnnnnnnnnnnnnnnnnnnnncccttggggttccaggnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnggaaggatccctttaaaatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnttctatttttaaaaaagggggaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcggagggggggaggggagagaatttattagnnnnnnnnnnnnnnnnngtnnnnnnnnnnnnnnnnnnnnnnnnnnnnnnnnnggtgtgtgtgtaaaaaaaggagatcttcgccggnnnnnnnnnnnnnnnnnnnnnnnnntctcgtgnnnnnnnnnnnnnnnnnnnnnccctttcnnnnnnnnnnnnnnnnnnnnnnnnnnnnnnnnnnnnnnnnnnnnnnnnnnnnnnnnnnnnnnnnnnnnnnnnnngagggccgcccgcggcccattannnnnnnnnnnnnnnnnnnnnnnnngggagaaaacacacaaaaactcattcnnnnnnnnnnnnnnnnnnnnnnnnntaagaagaaagcggggagaagaaggannnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnaatannnnnnnnnnnnnnnnnnnnnnnnnnnnnnnnnnnacnnnnnnnnnnnnnnnnnnnnnnnnnnggcaa

SEQ ID NO: 11178 - DNA, 1076 bp, Diabrotica virgifera
  misc_feature (5)..(767): n is a, c, g, or t
  misc_feature (774)..(811): n is a, c, g, or t
  misc_feature (831)..(844): n is a, c, g, or t
  misc_feature (847)..(869): n is a, c, g, or t
  misc_feature (878)..(898): n is a, c, g, or t
  misc_feature (903)..(903): n is a, c, g, or t
  misc_feature (932)..(933): n is a, c, g, or t
  misc_feature (940)..(958): n is a, c, g, or t
  misc_feature (974)..(1056): n is a, c, g, or t
acgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntggtcgacnnnnnnnnnnnnnnnnnnnnnagttnaaccggtgtgagccaggtgggtttctatnncttattnnnnnnnnnnnnnnnnnnngaaagggaccaatatnnnnnnnnnnnnnnnnnnnnnnnnnnnnnnnnnnnnnnnnnnnnnnnnnnnnnnnnnnnnnnnnnnnnnnnnnnnnnnnnnnntttacaaataaccagggggg

SEQ ID NO: 11179 - DNA, 901 bp, Diabrotica virgifera
  misc_feature (160)..(182): n is a, c, g, or t
  misc_feature (287)..(326): n is a, c, g, or t
  misc_feature (427)..(450): n is a, c, g, or t
  misc_feature (666)..(689): n is a, c, g, or t
  misc_feature (702)..(719): n is a, c, g, or t
  misc_feature (753)..(775): n is a, c, g, or t
taaagaatatcgggaaactcttatactttatcttttggaatcttcgagcaggaacgggtaggaacttcattaagaattttagtacgagcagaattaggaaggcccggatctttaatcggaaacgaccaaatttataacggttatcgttacagctcacgcnnnnnnnnnnnnnnnnnnnnnnnttatacctattataattggtggttttggaaattgacttgtacccttaataattggtgctcccgatatagcattccctcgaataaataatataagattttgattgnnnnnnnnnnnnnnnnnnnnnnnnnnnnnnnnnnnnnnnntagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagtaggaatggatggtgatactcgagcttattttactcagcactat

SEQ ID NO: 11180 - DNA, 637 bp, Diabrotica virgifera
  misc_feature (33)..(61): n is a, c, g, or t
  misc_feature (97)..(539): n is a, c, g, or t
  misc_feature (546)..(635): n is a, c, g, or t
gaaattaaagagccaaaaatctaaatttcatcnnnnnnnnnnnnnnnnnnnnnnnnnnnnncggtaacgaaaagttatttcgtttttaaatcatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 11181 - DNA, 854 bp, Diabrotica virgifera
gcggacacatcaaagaccagtgcccttaaagcactttctttatacgggtaaaggtggaagtacacgtgacaataggtttatcgattttaaacgctgataagtggatcgttaaacggatttatcaaagctaaagaatccatgaaagtggatcctcataaaaattttaatcaaagattgagccctgcccaagaaaaaaccttatggtcgggattaatttcccatcttaaaaagaacgatcttcttccagtagtggcctttactttttcgcgacaaaaatgtgacaataatgctacgaatttaacaagtttggatcttacgacacagaaagagaaagcacacataaccttatcatttaatagatggatcagctactttttgcaacggaaacttttgccatggggtgtgaatatgccagcaagaacagtggtttttgattcagttcgtaaacatgacggcaaagaattacgtgaccttgaggctgccgaatacactcagatggctggacgtgctggaagacgtggtttggatgcggaagggactgttattattctgtgtaaacaaaccattcctctggaagaaaattttaagaagatgatgctgggcaaacctagttcgttagtgagtcagttcagattaacgtatggaatggttttaagtttgctacgtgtagaaagtataagcgtagaaggtatgatgtcaagaagttttagagaagcagatcatcagaagaatatggttgaaataaggaagaaactagaaaaagtcgatgaagaataaaagaattgtgtagacaaacaattagtacttacttgcagcctttagttaattttacgaaacgctagcgctacttgata

SEQ ID NO: 11182 - DNA, 909 bp, Diabrotica virgifera
  misc_feature (158)..(181): n is a, c, g, or t
  misc_feature (194)..(211): n is a, c, g, or t
  misc_feature (245)..(267): n is a, c, g, or t
  misc_feature (493)..(513): n is a, c, g, or t
  misc_feature (592)..(611): n is a, c, g, or t
  misc_feature (676)..(724): n is a, c, g, or t
  misc_feature (864)..(884): n is a, c, g, or t
atcgaatacccctatttgtttgagccgtcgtaattacagcaatccttcttctattatctttaccagttttagctcggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttcttttattggggtattnnnnnnnnnnnnnnnnnnnnnagaagctttttctttttcacgaaaa

SEQ ID NO: 11183 - DNA, 747 bp, Diabrotica virgifera
  misc_feature (8)..(30): n is a, c, g, or t
  misc_feature (57)..(75): n is a, c, g, or t
  misc_feature (672)..(742): n is a, c, g, or t
ggacatgnnnnnnnnnnnnnnnnnnnnnnngcatcccaaaagaaacgtactttaaannnnnnnnnnnnnnnnnnnccggtacgcacgtgagccagaaaatgctgcaaaatcttgtaaagctaaaggttcaaacttaagagtacactttaagaacacatgtgaaactgcaaatgcaataaggaagatgcccctcaaaagggccgtagcatatttaaagaatgtaattattcagaaggagtgtattccatttagaaggtttaatggtggagtaggtcgttgtgcccaagcaaaacaatttggtaccactcagggaagatggcctaaaaagtcagcagagtttcttttacaactcttgagaaatgctgaaagcaatgcagattacagtggactcgatgtagacagattagtagtagaacatattcaggtaaacagagctgcttgtttgaggcgtcgtacatacagagcccatggtaggattaatccttacatgtcttcaccttgccatatcgaattatggttaactgaaggagaatcctcacaagatgctcccaaaaaagcttcacagaaaaagaaatcaacccttgacaaagtgaagagaccaaaagcacctccagctgtgacccattaaatgttcttactgtcacctgttaataattaaaataatgactttgnnnnnnnnnnnnnnnnnnnnnnnnnnnnnnnnnnnnnnnnnnnnnnnnnnnnnnnnnnnnnnnnnnnnnnntaatg

SEQ ID NO: 11184 - DNA, 851 bp, Diabrotica virgifera
  misc_feature (7)..(23): n is a, c, g, or t
  misc_feature (26)..(41): n is a, c, g, or t
tcccggnnnnnnnnnnnnnnnnnacnnnnnnnnnnnnnnnnatctaactgcaaatcaacaaccaaaaacattttacttaataaacttcttaatccacatgtaactagtggcaccgcacaaactaaaccatgtcaatatatatgacatgtgctcattcctcagagatattctagtttgtccaccgattggtccatttggtacatcaaaatcgatagtggcatctaaaaatattggcgaggcaccagtcacttctgccatgcgatccaaatccctataaaaataaatattgcttccctctatatttttcatggtaaaattgggtctaggctcatgtgtcctaactacgccaatgacatctacaacaccatttacttgacctctttctctcgttttaggatctttttgtttacttggcacccatcctctattcacaagaattgtttcatctctaccttccagcttcaaaggagatactactaaatacccttggctagaacctgcacttccagaaacaagtgaactcttagctgaagcatcccccttttttaaaacggaacggggccccatatacaactctttgtcatgaagaaactgtccttttacgtgtattggcttgtattcaagtgcacttaaatcgtccagatttgtaggtaattgcaatggttgactgtaagttttttcttgtaactcatctagaagaccttctttccactttttcctctgtacttgccaaacacccaacgaaaatgttgaaacaggaataatcagaagaaaccaaccaaaagggcctattctttcgtcacggcttacttttacatgaaggatatttgcttgtatcgaataattggcta

SEQ ID NO: 11185 - DNA, 466 bp, Diabrotica virgifera
  misc_feature (12)..(267): n is a, c, g, or t
  misc_feature (274)..(311): n is a, c, g, or t
  misc_feature (331)..(344): n is a, c, g, or t
  misc_feature (347)..(369): n is a, c, g, or t
  misc_feature (377)..(399): n is a, c, g, or t
  misc_feature (429)..(460): n is a, c, g, or t
tcccccgggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11186 - DNA, 916 bp, Diabrotica virgifera
  misc_feature (350)..(369): n is a, c, g, or t
  misc_feature (863)..(863): n is a, c, g, or t
acgacatccaatcgatatcacgctataacgaagataattttcggaatttagtggatataaatatttatccttcgttgagaaaacgtgccctaaagttaaattccctccgtgcctcgacatacgcccgtgaatctttattttaaaatatcgaaatacttaaaattaagttaccgatcaacccttaccgacgctcatttagaccaacgccttcgaaccggaaattctacttatattccacattacaacgagctggcctcaaatttacagtgccacatatctcactagttgactacttatgcttatattatatattagaatttgatgtgaaataaaaatttgcctatataatnnnnnnnnnnnnnnnnnnnnctattttcatgttttctcggcggggggaggggggcgctacttttcatcaggtggtgcccgccgaatttcacaatttttaaaatgtgccctcctagtaaaaaaggttgccgacccctgtccaagagtattgtgtgtcaaattggagccccacgttgggcgccaatcattcaattcaatcatgttcaattcaatatatttcatttaataatcagtgctacagaattatctactattaattaaacgttgacaagctagatcaaaaacgaatgaataatgttgataactttcagagtcttaaacagaatgagtttaagccacataccaaaacgaaagtacgtagaacatacgcttattgttgtttcctattttatgttaagtacctttaaattgttattacattacatatcacattggtctctttccaccttcaaagaagaaaattgtcattaattaaacatatcatgtttttaaaatcaaaccaaaatattgtttanataatatttataaataatacactggcgtatctaaaccaggtaacatggtagta

SEQ ID NO: 11187 - DNA, 821 bp, Diabrotica virgifera
  misc_feature (225)..(242): n is a, c, g, or t
  misc_feature (481)..(498): n is a, c, g, or t
  misc_feature (660)..(685): n is a, c, g, or t
atcatttttaagaataacatcgtgattaactaatgaatttgctatttctaatgaattgaaaattactttaactctattaattccaacgggtttaatgtcaattacattattcttcaatttctcatcaacaagaagaaaatggccaatcttaatggggaataaccttcctaggttcaaatttttatgctgcacgaaaacaaaaaagggccctttatcgcctggtcnnnnnnnnnnnnnnnnnncgatttgtacatacctgttctccgtgttatcagtttcactgtttttttgatcgggcggcttatcggccgcccttttttcggacattactacttactaattaataattgcgttaaactaaatcctatcaaaactaaatttatattgtctctttttttaaatcacttccgcaataataaacgcacaaaactcgaatacgactggtcactttgcctaacgaattcaaactgtaagtggttcnnnnnnnnnnnnnnnnnncaatttttcccttaaaaaccaatagtcttctgacaaaaaaatagaattgatttgaagaagatttaacatttattgtgtgttttaaatggagataacagtttaattcgcccaaaaacccaaaacaaaaagtagaaacgtgtagcaaaattacatacttatctnnnnnnnnnnnnnnnnnnnnnnnnnnatatttatcatgtagtcataggtaaacaaaactaataatataaataaagtcagtttagattaaaatacacacaattatttgtccttcaagcactaatccattacaaatgtaccatgtatacgtattaataaaaatt

SEQ ID NO: 11188 - DNA, 916 bp, Diabrotica virgifera
  misc_feature (7)..(30): n is a, c, g, or t
  misc_feature (218)..(238): n is a, c, g, or t
  misc_feature (240)..(257): n is a, c, g, or t
  misc_feature (317)..(336): n is a, c, g, or t
  misc_feature (590)..(612): n is a, c, g, or t
  misc_feature (764)..(764): n is a, c, g, or t
  misc_feature (864)..(864): n is a, c, g, or t
gtggtannnnnnnnnnnnnnnnnnnnnnnnagttcatagcaactatctaaagatttacaaaactgagtgtccgaacgaatgccaaacgtaatgaataattatatcgcggacttcaaatattataatgatatgacgtcacgaccaatgagggcgcgttttgggctggctgctataatttgaattttcttttgattttaatcttctttaggggccaaacnnnnnnnnnnnnnnnnnnnnngnnnnnnnnnnnnnnnnnngttgtgatttatagcattttttcgaatttattattttatgcaagttctctgttattatgnnnnnnnnnnnnnnnnnnnngacgtttcgattttcaactcgagatctagttttttacagattctgttgtgtaatattttcaaaaaggtttttaatacatgcgtcattaggacaacagaataattcgataatatctactttattggattctaaaccataacatttatagtatataatttatattgctctctagtttattgggatcgggatctatcatacatcatactgtataaacaatacacagtataaggagaagtgtcagttacattccaacnnnnnnnnnnnnnnnnnnnnnnngaaggttaaacaatttaaattgcagtttatgtttcatcaccttcgggatcaaaataattgttatcactaatgataacaactaaagcgggaggatttacctttgggcgttttttttttcgttgtttctccttatgctctatgactcatattanaagagtttaatattgaaactctagtaaattacaataaataaatagtgtgaaacattatttgtgtaataaaaaaaatctgaagggcaaaacaatacaatanaataaataaatttaacgtaacaaatataaacgtcagtgaaatggctgcaact

SEQ ID NO: 11189 - DNA, 195 bp, Diabrotica virgifera
  misc_feature (58)..(84): n is a, c, g, or t
  misc_feature (92)..(114): n is a, c, g, or t
gctcgcctgccccctgattaatttgaatgggccgcgggattttgaccgggctaaagannnnnnnnnnnnnnnnnnnnnnnnnnngctggaannnnnnnnnnnnnnnnnnnnnnnggcccttttaactttctacacaatcttttttttccctttaaacaactacattttttttaaaggatacaaaacccttaacac

SEQ ID NO: 11190 - DNA, 1144 bp, Diabrotica virgifera
  misc_feature (2)..(767): n is a, c, g, or t
  misc_feature (769)..(835): n is a, c, g, or t
  misc_feature (837)..(892): n is a, c, g, or t
  misc_feature (896)..(922): n is a, c, g, or t
  misc_feature (992)..(1009): n is a, c, g, or t
  misc_feature (1091)..(1142): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnncccnnnnnnnnnnnnnnnnnnnnnnnnnnnttaagggtaacagcggaattttatttgggagagtcaaatcgaataaaaaaattgggaccctccaggttgnnnnnnnnnnnnnnnnnnggggtgagcacttttttttttaatgtgggtcgactttttaaatttttcaatgtttctggatttaaaaccgggggggggcccnnnnnnnnnnnnnnnnnnnnnnnnnnnnnnnnnnnnnnnnnnnnnnnnnnnngg

SEQ ID NO: 11191 - DNA, 110 bp, Diabrotica virgifera
acatgcgaaaaagtttccccaaaaagtattataaaatcaaccattcctggcctgggatggttacctaaatatgaatggagaaacgatatattatcagaacttgcttctgg

SEQ ID NO: 11192 - DNA, 882 bp, Diabrotica virgifera
  misc_feature (177)..(196): n is a, c, g, or t
  misc_feature (348)..(365): n is a, c, g, or t
  misc_feature (430)..(445): n is a, c, g, or t
  misc_feature (862)..(863): n is a, c, g, or t
taacgataaacgtaatttcaattctgagggcacatccaaggtgcaccacggttttcggagtcagcaccgagtccgtgtacgaataattcttcgtatttaaactcgacctgtccaaagtgcaccttcaccctggcaactgaatacaaagctgactccgaaaaccggcagttttcacgnnnnnnnnnnnnnnnnnnnnaataattcaattttgacgttacgaattgtaccgttacgaattgtgtcgttacgttgcgaactgtcgccgttacgaattaacctcgctacgaattgtccgttaccatttttgaggggttacgaactgttgcgttacgagatgtcccgtcacgnnnnnnnnnnnnnnnnnncaccaaaaaacaccacctttcggcagaatatttacgggtttattaaatatagttcattagacaannnnnnnnnnnnnnnnatttctgtgcattaaaaaggatcttgtaggaaacactatttttttgatagagctcagtatacattacgactgatatttttttttaacttaaattagacgttttagttcgatttgttctgcaacaatacataaaataacttcaactcaacctaaatattaaacatacactctgttttattagttagaacaagttacatcttgatttagagtctgtaatggatccaaataactctgattacaaaagttgatttgtaacttctcgcagattatttcttatttttactttgtttaatgttaaactttggaattcaaattttggttttatttaaatttgagttgtgctcattgcctaagttattcccactctccagcatttttgaggccttcctcatcttctgcagtttggtggaattattnncacatctttttcggggagc

SEQ ID NO: 11193 - DNA, 232 bp, Diabrotica virgifera
  misc_feature (2)..(67): n is a, c, g, or t
  misc_feature (69)..(155): n is a, c, g, or t
  misc_feature (160)..(229): n is a, c, g, or t
gnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnntatannnnnnnnnnnnnnnnnnnnnnnnnnnnnnnnnnnnnnnnnnnnnnnnnnnnnnnnnnnnnnnnnnnnnnggg

SEQ ID NO: 11194 - DNA, 454 bp, Diabrotica virgifera
  misc_feature (319)..(336): n is a, c, g, or t
tatactttctccactatttactaatctcttgcttgatatgatactcatgaatatcgtataccatgtcatctctatcaatagtttcctttaatctagcggtagtatttctctaagctgataactaaactgtcgctttatacaacaattatgcacgagtgatcatctccttctgttggtggtgtatcatgacggcttcgctctattgttcgaacaatttctcatgaaccactgatgagtcttcagtaccattatcttgaatgtttttgattatatctttgtttgtattacattactattacataccaacaataaatttgcnnnnnnnnnnnnnnnnnnccgttgtgtttaatgtgcattgactctgcattagctaggcctaatcgaactacttttgatagctgctgaatctgcttcagagttagtcaacaagttataatgttgaatataaaagtgg

SEQ ID NO: 11195 - DNA, 958 bp, Diabrotica virgifera
  misc_feature (21)..(40): n is a, c, g, or t
  misc_feature (57)..(76): n is a, c, g, or t
  misc_feature (81)..(98): n is a, c, g, or t
  misc_feature (100)..(112): n is a, c, g, or t
  misc_feature (123)..(138): n is a, c, g, or t
  misc_feature (140)..(220): n is a, c, g, or t
  misc_feature (230)..(269): n is a, c, g, or t
  misc_feature (287)..(299): n is a, c, g, or t
  misc_feature (301)..(356): n is a, c, g, or t
  misc_feature (358)..(431): n is a, c, g, or t
  misc_feature (433)..(473): n is a, c, g, or t
  misc_feature (475)..(531): n is a, c, g, or t
  misc_feature (538)..(550): n is a, c, g, or t
  misc_feature (552)..(567): n is a, c, g, or t
  misc_feature (585)..(612): n is a, c, g, or t
  misc_feature (621)..(666): n is a, c, g, or t
  misc_feature (689)..(719): n is a, c, g, or t
ttcatggcgcgcgttatgtgnnnnnnnnnnnnnnnnnnnnccctttaaaataaaacnnnnnnnnnnnnnnnnnnnncaacnnnnnnnnnnnnnnnnnncnnnnnnnnnnnnncattacgatcnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnncaaatttacnnnnnnnnnnnnnnnnnnnnnnnnnnnnnnnnnnnnnnnncaataatatataggttcnnnnnnnnnnnnntnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnaagaccnnnnnnnnnnnnncnnnnnnnnnnnnnnnncactaactttttttaccnnnnnnnnnnnnnnnnnnnnnnnnnnnnctaattgcnnnnnnnnnnnnnnnnnnnnnnnnnnnnnnnnnnnnnnnnnnnnnngaatactttttcgatccaattannnnnnnnnnnnnnnnnnnnnnnnnnnnnnntaacagcgtaattttattggagagttcgaatcgataataaagattgcgacctcgatgttggattagagtttataattggagtagcagctatattattacgcctgctcgactgctaaaattttacatgatctgagtttagaccggagtgagccagagtgctttctatctccacttatctatatattttagtacgaaaggaccacatatataacataaattttaatattaagatacatatt

SEQ ID NO: 11196 - DNA, 1164 bp, Diabrotica virgifera
  misc_feature (253)..(807): n is a, c, g, or t
  misc_feature (813)..(856): n is a, c, g, or t
  misc_feature (878)..(911): n is a, c, g, or t
  misc_feature (917)..(995): n is a, c, g, or t
  misc_feature (1008)..(1020): n is a, c, g, or t
  misc_feature (1023)..(1041): n is a, c, g, or t
  misc_feature (1083)..(1100): n is a, c, g, or t
  misc_feature (1105)..(1135): n is a, c, g, or t
ttcccggccgaaatactcgaacttgtcagattaagataaggtacttttgttacatgcaagagagtgtatatttcaacaatctgacgatttgagcggggcgtaatgaaatgggtgtagtttattaatgttccctgaagataagggaatatttctcgatatgaacgtcttatctatatctaaataatacatatctaatatttttcattatcattgtaatgaaacttttcatgacctccctctgtaatgagatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaagnnnnnnnnnnnnnnnnnnnnnnnnnnnnnnnnnnnnnnnnnnnncatatttagaaagttttttcannnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnntagagtaaagcgnnnnnnnnnnnnnagnnnnnnnnnnnnnnnnnnncaacccccccggggggtaaaaactaaaattttggtggagggnnnnnnnnnnnnnnnnnnacccnnnnnnnnnnnnnnnnnnnnnnnnnnnnnnnggggggagggggcgggtgttttttttttt

SEQ ID NO: 11197 - DNA, 833 bp, Diabrotica virgifera
  misc_feature (172)..(196): n is a, c, g, or t
tttttcccggttatgatggatttattcattcctcttacaattctggtaaaaaacattaagaatctagaacgactgaccgccattcttcggtcagtctgcattcgcatacgatgattaacaccaaaaaaataagaaacaatttaaatgcaaagtcatacctatctctaatggnnnnnnnnnnnnnnnnnnnnnnnnnggataaatcatcagatcacaaaactctattataacagtttttccaagatgatacacctatacttaacagtcaaaaaattacgaatacactaaacacagaacagatttcgctgcatgtcatacttcacttaccatttctctaacgtcaaatatccagtagatttaattaataatttcacttcaattacaatccctgctaaacaaataaactatttgtttattctaacgaagatgtgatacacttgaacttcaaaaatgcgctccacaaaaaagaaaataaagctgtacaggatataacatcaggggagttattgtacagtaaaattgtggcttatttaccatttaaaatagttgattataaaaatgccacaaggaaatagcttcagaacaacattaatcctaatatatagtcttgaaattatgtgttactcgagaaaatttgttgcatatgaggtaaatattcgtctggtcatcaggcggggagttatgtaataggatttcaaatttatgtacaatgttggtccagtgtgactttaatgtgacccatttagggagcattatctcgatcacaaagaacaaatacaatgcccttacaacagtgctcatctcatatgatgacaggtatttaatacgcatct

SEQ ID NO: 11198 - DNA, 1122 bp, Diabrotica virgifera
  misc_feature (453)..(535): n is a, c, g, or t
  misc_feature (537)..(556): n is a, c, g, or t
  misc_feature (558)..(570): n is a, c, g, or t
  misc_feature (572)..(631): n is a, c, g, or t
  misc_feature (633)..(691): n is a, c, g, or t
  misc_feature (693)..(726): n is a, c, g, or t
  misc_feature (738)..(755): n is a, c, g, or t
  misc_feature (770)..(789): n is a, c, g, or t
  misc_feature (794)..(811): n is a, c, g, or t
  misc_feature (851)..(874): n is a, c, g, or t
  misc_feature (877)..(906): n is a, c, g, or t
  misc_feature (912)..(957): n is a, c, g, or t
  misc_feature (1014)..(1062): n is a, c, g, or t
  misc_feature (1071)..(1088): n is a, c, g, or t
ctcaccgccatgggtaagaaagtaaaatttcaaagtaatctattaactttgttgagaaacacagctctccgtgctcactcgattttaagaacagcccttgttgcccccaagccaaatgtatctactatgagattgatgtcaagccacagtaccgaaactgatgaacaatttgatagccgttacgaaaacttcttcaacagaaaagatatcgatggatgggaaatcagaagaggtatcaacgatttatgggggcatgacttggttccagaaccaaaaattcttattgctgcattgaaagcctgtcgcattagtaaatgattttgctttggtagtaagaattctatataacacctaggacaaatgtgtaagtaaaggctttgaaatatacccttatattattctagatctgagatctactttgagagtattaggtctcatattttcaaatatgcnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnngnnnnnnnnnnnnngnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnngtttagttttgnnnnnnnnnnnnnnnnnncagggttggatgacnnnnnnnnnnnnnnnnnnnnttggnnnnnnnnnnnnnnnnnntgaaatgcttaatttttttagaaacgagagacccatagannnnnnnnnnnnnnnnnnnnnnnnacnnnnnnnnnnnnnnnnnnnnnnnnnnnnnngggggnnnnnnnnnnnnnnnnnnnnnnnnnnnnnnnnnnnnnnnnnnnnnnccccttttttggttaaaaagaaaaaaccgagggaaaaaaaggattttttttgaaggnnnnnnnnnnnnnnnnnnnnnnnnnnnnnnnnnnnnnnnnnnnnnnnnngtggcaggnnnnnnnnnnnnnnnnnncactttaaaaatttttattctttttttttccagg

SEQ ID NO: 11199 - DNA, 202 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (163)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttgggttcnnnnnnnnnnnnnnnnnnnnnnnnnnnnnnnnncgaaagg

SEQ ID NO: 11200 - DNA, 342 bp, Diabrotica virgifera
  misc_feature (154)..(177): n is a, c, g, or t
ctgtccaacaacaaactggtcagatccataactgccactggtgtttttcttaacttcatttattatttaacgagcaagacaattctatcaatataaaacaataaattaaattttgcaccctacagcatcaagaatgataaataatataacatannnnnnnnnnnnnnnnnnnnnnnntcctataaaaaatgaaatttcttttattcaccaacaagaatcataaatattttactcttcctgatattgtcatctcttttaatatatattaaaaaatttagataatcatccaccattctttttcttcctctctatccaccatcttatctatcacttcatcacaat

SEQ ID NO: 11201 - DNA, 1251 bp, Diabrotica virgifera
  misc_feature (60)..(82): n is a, c, g, or t
  misc_feature (830)..(847): n is a, c, g, or t
  misc_feature (923)..(955): n is a, c, g, or t
  misc_feature (971)..(992): n is a, c, g, or t
  misc_feature (1030)..(1055): n is a, c, g, or t
  misc_feature (1057)..(1070): n is a, c, g, or t
  misc_feature (1082)..(1105): n is a, c, g, or t
  misc_feature (1123)..(1175): n is a, c, g, or t
  misc_feature (1205)..(1224): n is a, c, g, or t
ggtgtggcaaattttgttggttatgtctcaacagttgtttacaaatattatttttgtagnnnnnnnnnnnnnnnnnnnnnnncttgaaagtattcctcttaaattaggttcaaacatgttttacacaaattttacattgtgttttataatttttagtgcttttgttcaattgtccctttccctagattgttatcagtgttcggggagtgatccaaacaagccatttcaatgtaatgaatggttatctggtgatatagatattacgccagagccatgtgataatgtttttggtgcaaagtattgcataaaacatgttggccgatttgaaggaggtatcggcactaaacgattttgttcgtccttggatcttggcaactattgcaactatgtgaaacaaccaggggatactttaacatacaggacatgcctttatacatgcaccggagatggttgtaatcccgctgcttccaagaaacctcagtctcttctactgttgatgacgatagcgggaatagtattttatagaatgatctaagacggataacatattgtaaaatgtaggatgtcgactcacaaaccctttggctcattgttaacctagtccgtcccttaagtgttagagcaggttcacatgacaaacgcttaacgcatgctaaatttttgtatagcgttcacatggtccatcattgtcaaagatgggcgtaaaaataattttaacagtgactttatacggatagcagaaacgacgaaggttatgatattgtacgatttgtgagtgatccgaatggaaggacatagctagacaggtaaagacccctccagggttatgnnnnnnnnnnnnnnnnnngaccaaaacaaaatgtcaactgaatgataacacaacataaaaaccaatgatatcaaaagcccccttttgacgcgcnnnnnnnnnnnnnnnnnnnnnnnnnnnnnnnnncaacgcggggaaaaannnnnnnnnnnnnnnnnnnnnnggccccttaaaccgcttttccttggggaaacccgcccnnnnnnnnnnnnnnnnnnnnnnnnnncnnnnnnnnnnnnnnaggttaaaaaannnnnnnnnnnnnnnnnnnnnnnngttttaaaatcggaaacnnnnnnnnnnnnnnnnnnnnnnnnnnnnnnnnnnnnnnnnnnnnnnnnnnnnnctctcttttctttattttttacttcttagnnnnnnnnnnnnnnnnnnnncaccctcttaatttttgtacttttttt

SEQ ID NO: 11202 - DNA, 291 bp, Diabrotica virgifera
  misc_feature (2)..(96): n is a, c, g, or t
  misc_feature (108)..(132): n is a, c, g, or t
  misc_feature (134)..(148): n is a, c, g, or t
  misc_feature (150)..(177): n is a, c, g, or t
  misc_feature (183)..(240): n is a, c, g, or t
  misc_feature (244)..(256): n is a, c, g, or t
  misc_feature (258)..(270): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgaaaacccnnnnnnnnnnnnnnnnnnnnnnnnngnnnnnnnnnnnnnnncnnnnnnnnnnnnnnnnnnnnnnnnnnnngggggnnnnnnnnnnnnnnnnnnnnnnnnnnnnnnnnnnnnnnnnnnnnnnnnnnnnnnnnnncccnnnnnnnnnnnnncnnnnnnnnnnnnntccagggaaaacccgcaaatt

SEQ ID NO: 11203 - DNA, 606 bp, Diabrotica virgifera
  misc_feature (14)..(77): n is a, c, g, or t
  misc_feature (79)..(158): n is a, c, g, or t
  misc_feature (160)..(181): n is a, c, g, or t
  misc_feature (199)..(217): n is a, c, g, or t
  misc_feature (220)..(259): n is a, c, g, or t
  misc_feature (265)..(320): n is a, c, g, or t
  misc_feature (325)..(350): n is a, c, g, or t
  misc_feature (388)..(408): n is a, c, g, or t
  misc_feature (481)..(498): n is a, c, g, or t
  misc_feature (540)..(589): n is a, c, g, or t
actcgcctgccccnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnaagaaaaccccaaaaagnnnnnnnnnnnnnnnnnnnggnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnccccnnnnnnnnnnnnnnnnnnnnnnnnnncccaaggggaaaccccggaattttttttgggaaggtcnnnnnnnnnnnnnnnnnnnnncgcccccccccggggggattaaagttttataattggggggggacagcttttttttataattctggttcccccnnnnnnnnnnnnnnnnnngttcttggagttttaaaacccggggggggggccccggggggnnnnnnnnnnnnnnnnnnnnnnnnnnnnnnnnnnnnnnnnnnnnnnnnnngctggggggcccgcccc

SEQ ID NO: 11204 - DNA, 1185 bp, Diabrotica virgifera
  misc_feature (675)..(698): n is a, c, g, or t
  misc_feature (773)..(791): n is a, c, g, or t
  misc_feature (837)..(860): n is a, c, g, or t
  misc_feature (885)..(902): n is a, c, g, or t
  misc_feature (904)..(944): n is a, c, g, or t
  misc_feature (975)..(1017): n is a, c, g, or t
  misc_feature (1072)..(1121): n is a, c, g, or t
attttttccagagtaaatattaaatataagtgcttgtttaatacatgtgagatgcttttgatcttaaacatataggcagctctttttggcgataacatgtctaatgaatagatagttaatactgttttagaaggtatagctaaattaaaatactacattgattatattgataaagaaatatgcttaaataaaaattcatccgatgaggaaacaaaggaagtcataaaaaaactatttagtctttcaaaaacaactaaagacaaatttgacgattattacaaaaataaacaaaaagagagtgaataatcccagactgataaatcagtgcctaacaatgctgcgaatggattagattcgagtgttgaatcggagtattggactgagaaaactattttactagatgatagccacaatgcagatgacccagaatgcatctaatggaatttccaccaacgatacaccagagcccggggataatttggacggcgaaactacaactacaaacaaaccaatgggtaaaaagaggcgcctaaataaaaagaacccaccagacagagaggttgaaaaaaatgataataatacaaaagataaactaattggtactttcaccacaagaaacagccccatagggaaacaactgtggaaaaggatacaaagataaaaaaaaacctccannnnnnnnnnnnnnnnnnnnnnnncgaaagggccacgcggggaaaaatctcttgtaactccctatgaaaaaccaccccaaaaacaacacggggaaaagnnnnnnnnnnnnnnnnnnnccccttcccccccccacaaaaacacccacaaaagaggaggaagggnnnnnnnnnnnnnnnnnnnnnnnnctcttcttcttttgaaggaaaaacnnnnnnnnnnnnnnnnnngnnnnnnnnnnnnnnnnnnnnnnnnnnnnnnnnnnnnnnnnntaataaacacaccccccaagaccacctattnnnnnnnnnnnnnnnnnnnnnnnnnnnnnnnnnnnnnnnnnnntcttccctctcggggcggtgccgaaaaactcacaaaaaacacacgagggagagannnnnnnnnnnnnnnnnnnnnnnnnnnnnnnnnnnnnnnnnnnnnnnnnnccccctctcaccgtcgtgggttgttcgtgtgaggcatggagcacacaacaccaaccagggagac

SEQ ID NO: 11205 - DNA, 939 bp, Diabrotica virgifera
  misc_feature (269)..(289): n is a, c, g, or t
  misc_feature (800)..(817): n is a, c, g, or t
gagacctaaagtatcttcaataattcgacacactactaacagaaggcgtaatagataataatttgatgttaatatagcaataacaacgatatccggattgtaaattaaaaacgtcaacaacatctaattttattagtttcatattgtatggataactggttgcataacatattgttgaattattgctcaaaattaatataattttcacatagatttgaaaaattatatttgccgagtcattgacacaataatagagtcggcggtgaagnnnnnnnnnnnnnnnnnnnnncttgttattaaatatccacgaggaaaagttttcctgtagttggctgtataccatatattacaaaaacgataataaagtcctttataaggggtatatttgttgaaatccgatcgagggctggttctgtgatgtggccctttttagggattttggcaaatatgccttttataaaggattttatcgtttttgttattaaataataaaagtatatttttgataaaagtatatatgtattgtaaaagtttaagagcatcgaagctgttcatcaatttaggaatgaatctaaatgtacaatcgtatgtaatttagatctattaagacgcgacgttatacattttaccggtgttcaagcgatagttagtgacgatgcatcctaatgcaatacttgtagtagaatagtctctatagactgtcttctggtggaatttttctattctagtttgatacaccatattttttatttgtttccctataacatatggggtggggttttaaccacgtttccaaaacnnnnnnnnnnnnnnnnnnggaggataaaaaagggttggggttggaaaaaaacaaaaaaaactctttgtggcttattttttaaaacaccgattctttcaccccttctcccaaaaacccttcacacaacccacaagtggggg

SEQ ID NO: 11206 - DNA, 1013 bp, Diabrotica virgifera
  misc_feature (3)..(568): n is a, c, g, or t
  misc_feature (570)..(652): n is a, c, g, or t
  misc_feature (671)..(828): n is a, c, g, or t
  misc_feature (846)..(864): n is a, c, g, or t
  misc_feature (872)..(891): n is a, c, g, or t
  misc_feature (947)..(964): n is a, c, g, or t
  misc_feature (975)..(994): n is a, c, g, or t
ttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnngagaaaaccctatagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaggggaaaacagccnnnnnnnnnnnnnnnnnnngttcaaannnnnnnnnnnnnnnnnnnncgaccccccccgggtgggatttaaaagtttaataatttgggggggaagggagcttnnnnnnnnnnnnnnnnnnggttctcaccnnnnnnnnnnnnnnnnnnnngaatttctaggtgttaaaa

SEQ ID NO: 11207 - DNA, 891 bp, Diabrotica virgifera
  misc_feature (69)..(699): n is a, c, g, or t
ttttgtccgcagacgtctgggtggtgcgattttatatccacataatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgtgatcgaaaggggttttgtttcccacattccccaaaaacaagaaaggcttcaaaccttaaggggggtatcgcgaaaggcgggggtacaccgggaacatagaaaaatgggcatggtgggtgtggcttccgaattcacgaaaaaagcgaaacaaaacttaaactttctccaaccccacttcccctaaaaa

SEQ ID NO: 11208 - DNA, 440 bp, Diabrotica virgifera
cgtatacagactgaaacaataacttataatttgtcgctgtaaccgcctatagaccagctagaagatactcacacaatgaataatcctattatacgtctcttatgatcgccagtatattagctagatgaccatcagaatctatttcgcaccatgtcatatctaggctcttatcaatctcaacttgattgacttcttcaatttatgctcctcaacactcccgtatacacgaactaatgtacttttggacaactacttctctctataaaatatgaagatataggcacctttcaaagagtactatatttacttggacattgcttagattatgtaaaaaccagatttgaaatttggaaaccgtcccatgacttaaacaacacattttacaagatttacttgtttaccaagcttctacattttatcattctcatccatatttttac

SEQ ID NO: 11209 - DNA, 366 bp, Diabrotica virgifera
  misc_feature (12)..(83): n is a, c, g, or t
  misc_feature (88)..(171): n is a, c, g, or t
  misc_feature (212)..(238): n is a, c, g, or t
  misc_feature (271)..(288): n is a, c, g, or t
  misc_feature (297)..(320): n is a, c, g, or t
  misc_feature (335)..(353): n is a, c, g, or t
gacgagaagaannnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnnnnnnnnnnnnnnnnnnnnnccctagggaaaccaggggaatttttttgtgggggccaatcnnnnnnnnnnnnnnnnnnnnnnnnnnntgggttaaaagttttaatttggggggggaggcnnnnnnnnnnnnnnnnnnggtccaccnnnnnnnnnnnnnnnnnnnnnnnncttggggttttaaannnnnnnnnnnnnnnnnnnggggggcgggggg

SEQ ID NO: 11210 - DNA, 305 bp, Diabrotica virgifera
  misc_feature (4)..(37): n is a, c, g, or t
  misc_feature (39)..(81): n is a, c, g, or t
  misc_feature (87)..(145): n is a, c, g, or t
  misc_feature (213)..(233): n is a, c, g, or t
gaannnnnnnnnnnnnnnnnnnnnnnnnnnnnnnnnngnnnnnnnnnnnnnnnnnnnnnnnnnnnnnnnnnnnnnnnnnnnggggtnnnnnnnnnnnnnnnnnnnnnnnnnnnnnnnnnnnnnnnnnnnnnnnnnnnnnnnnnnncccatttttttggtttatagaaaaaaattcccctagggaaaccaccggaatttttttggaaaagttcnnnnnnnnnnnnnnnnnnnnnccccccccggcggggtttaaagatttttaattggggggggccgccgattatttttttaaatctcggttctcg

SEQ ID NO: 11211 - DNA, 706 bp, Diabrotica virgifera
  misc_feature (2)..(53): n is a, c, g, or t
  misc_feature (93)..(122): n is a, c, g, or t
  misc_feature (151)..(171): n is a, c, g, or t
  misc_feature (173)..(185): n is a, c, g, or t
  misc_feature (210)..(237): n is a, c, g, or t
  misc_feature (287)..(360): n is a, c, g, or t
  misc_feature (381)..(430): n is a, c, g, or t
  misc_feature (441)..(454): n is a, c, g, or t
  misc_feature (456)..(539): n is a, c, g, or t
  misc_feature (554)..(589): n is a, c, g, or t
annnnnnnnnnnnnnnnnnnnnnnnnnnnnnnnnnnnnnnnnnnnnnnnnnnngagatatttaattaaaagagagataaaaaattattagtgnnnnnnnnnnnnnnnnnnnnnnnnnnnnnnccttgagtatctggacctagtgaatcatnnnnnnnnnnnnnnnnnnnnncnnnnnnnnnnnnnccaaattatataagatttatattgnnnnnnnnnnnnnnnnnnnnnnnnnnnngtaaagaaatgttatgcaatgatatgtatttctaatttattaatatctannnnnnnnnnnnnnnnnnnnnnnnnnnnnnnnnnnnnnnnnnnnnnnnnnnnnnnnnnnnnnnnnnnnnnnnnnagatattattaagaataatcnnnnnnnnnnnnnnnnnnnnnnnnnnnnnnnnnnnnnnnnnnnnnnnnnngtaaaatatcnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnatgttgataatatgnnnnnnnnnnnnnnnnnnnnnnnnnnnnnnnnnnnntgcttaatcattgatttcacctgcatattattcacctgtctattagaatcatgtatatatgcactactgaccactgctcacctgccctgtgcgcaatatgattgcccggctaatgta

SEQ ID NO: 11212 - DNA, 602 bp, Diabrotica virgifera
  misc_feature (2)..(54): n is a, c, g, or t
  misc_feature (56)..(78): n is a, c, g, or t
  misc_feature (80)..(127): n is a, c, g, or t
  misc_feature (129)..(142): n is a, c, g, or t
  misc_feature (169)..(229): n is a, c, g, or t
  misc_feature (251)..(316): n is a, c, g, or t
  misc_feature (324)..(405): n is a, c, g, or t
  misc_feature (450)..(467): n is a, c, g, or t
cnnnnnnnnnnnnnnnnnnnnnnnnnnnnnnnnnnnnnnnnnnnnnnnnnnnnncnnnnnnnnnnnnnnnnnnnnnnngnnnnnnnnnnnnnnnnnnnnnnnnnnnnnnnnnnnnnnnnnnnnnnnngnnnnnnnnnnnnnngttggagtgaaaaaaaaactggtcttnnnnnnnnnnnnnnnnnnnnnnnnnnnnnnnnnnnnnnnnnnnnnnnnnnnnnnnnnnnnnaccagaagaaccccatagaagnnnnnnnnnnnnnnnnnnnnnnnnnnnnnnnnnnnnnnnnnnnnnnnnnnnnnnnnnnnnnnnnnncggcgggnnnnnnnnnnnnnnnnnnnnnnnnnnnnnnnnnnnnnnnnnnnnnnnnnnnnnnnnnnnnnnnnnnnnnnnnnnnnnnnnnnccccaaagggaaaaaacgccgaatttttttgggagggtccaaacnnnnnnnnnnnnnnnnnnaccccccacgcgggggttaaaaggttaaaaattgggggggggaggccatattttatatattttgtctccctttttctaaatattttttcatatattcggggtttaaaccccgggggggcggcccgggggggggtc

SEQ ID NO: 11213 - DNA, 257 bp, Diabrotica virgifera
  misc_feature (8)..(34): n is a, c, g, or t
  misc_feature (52)..(117): n is a, c, g, or t
  misc_feature (119)..(146): n is a, c, g, or t
  misc_feature (159)..(225): n is a, c, g, or t
aggtaagnnnnnnnnnnnnnnnnnnnnnnnnnnngctgggaatggaaggggnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnacccccacaaggnnnnnnnnnnnnnnnnnnnnnnnnnnnnnnnnnnnnnnnnnnnnnnnnnnnnnnnnnnnnnnnnnnngggggggtaaaaaaaaaaatctacctcttttc

SEQ ID NO: 11214 - DNA, 183 bp, Diabrotica virgifera
  misc_feature (3)..(29): n is a, c, g, or t
  misc_feature (39)..(114): n is a, c, g, or t
  misc_feature (119)..(182): n is a, c, g, or t
gcnnnnnnnnnnnnnnnnnnnnnnnnnnnaccctatagnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnnnnnnnt

SEQ ID NO: 11215 - DNA, 1103 bp, Diabrotica virgifera
  misc_feature (826)..(859): n is a, c, g, or t
  misc_feature (916)..(1001): n is a, c, g, or t
  misc_feature (1051)..(1080): n is a, c, g, or t
ttttttttttttgtttcgcaatgtattatgtttcccatcttttgagctgttttgccggttattggcgcgctcatcactgtatttgagtcggtgagaggagaaagcggacatgtccatgaatgggtgtttttgacattttgacagaaatccaatgctttgttagtacgaggagatatccggtttctttacaaaacggtgcgtattcgtacttatacctaatggattgctgtcagaatgtcaaaaatgcctatttgtggacatgtccgctttctcttctcgccgattcatttaagctgaattataattttaaaggtagcgagtttaattatctttgtagattgcgtaagggaatataggtgatttattctgcatttcgatttgtaaatttactcatcccaacgttcttcacgatttaatctaaattaatataaccccacctcttttatacaaccaaattaaaaacaactataccctgtttttaaccagcaggagtaaactccaaacacaccccataatgtgcctagaaaaaacactaaattcttcttcttttttgggtgatcatgtcgaccttccacgggaatccctaaatggtatattatactaacacgtcgcccaaaaaatctaaaaaaaactgtttttataaaatgcctacttaaaaacctaaaaataaaggaataaccccgaaaacaccaataatcgccgaaataacttaatcttttcattttatttggcctttatggcgaaaatttctaagtggggggggggtgggcttgcctggtttttggaccccttacaaaaaaaattaacgggcggggaaattgaaagnnnnnnnnnnnnnnnnnnnnnnnnnnnnnnnnnnccctattaaggccccaatttgttatttcgggttgtgcaaaaaacaacaaaaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaatttgagcgaaaaaaacccggggattttcccgggaaggtgcctnnnnnnnnnnnnnnnnnnnnnnnnnnnnnnaagagcccgcggcctttttttag

SEQ ID NO: 11216 - DNA, 191 bp, Diabrotica virgifera
  misc_feature (5)..(116): n is a, c, g, or t
  misc_feature (124)..(124): n is a, c, g, or t
  misc_feature (126)..(190): n is a, c, g, or t
taagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattattntnnnnnnnnnnnnnnnnnnnnnnnnnnnnnnnnnnnnnnnnnnnnnnnnnnnnnnnnnnnnnnnnnc

SEQ ID NO: 11217 - DNA, 89 bp, Diabrotica virgifera
  misc_feature (2)..(82): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnttatatt

SEQ ID NO: 11218 - DNA, 616 bp, Diabrotica virgifera
  misc_feature (3)..(34): n is a, c, g, or t
  misc_feature (45)..(81): n is a, c, g, or t
  misc_feature (99)..(140): n is a, c, g, or t
  misc_feature (144)..(159): n is a, c, g, or t
  misc_feature (162)..(197): n is a, c, g, or t
  misc_feature (244)..(390): n is a, c, g, or t
  misc_feature (427)..(444): n is a, c, g, or t
  misc_feature (566)..(609): n is a, c, g, or t
ccnnnnnnnnnnnnnnnnnnnnnnnnnnnnnnnncatataaagannnnnnnnnnnnnnnnnnnnnnnnnnnnnnnnnnnnnatttgaccgggctaaggnnnnnnnnnnnnnnnnnnnnnnnnnnnnnnnnnnnnnnnnnngtgnnnnnnnnnnnnnnnngcnnnnnnnnnnnnnnnnnnnnnnnnnnnnnnnnnnnnaaaaagctaaaatttttttaaagacgagaaaccccataaaggtttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttagggaaacaccgaattttttggggaagttaaaannnnnnnnnnnnnnnnnnccccccgggggggataaaggcttttattgtggggaacgccctattctaataagccgctctctcttttaaattttcttaagtctgggattcaaaccggcgggggcccccgtggggtttttttnnnnnnnnnnnnnnnnnnnnnnnnnnnnnnnnnnnnnnnnnnnnaaatatc

SEQ ID NO: 11219 - DNA, 821 bp, Diabrotica virgifera
  misc_feature (305)..(329): n is a, c, g, or t
  misc_feature (430)..(448): n is a, c, g, or t
gctacgcatctgtagatcaaaccgaagaagcacttaaggaggctgtgatctttaatgtagttatatgcccaatggggtcaaccaccattggagcctccattgccgtattcaccggaacgatcgactaactgtggggaactccagacttctacgacatactgctctttaactctttgaccttcaagcagcacgcatttaactgattccacgaccaatgcagtacatacaacgatttccttgccaaaaagcatagacatcttactgatcctacgaatagctaggagaaagactctcaaaaacaccannnnnnnnnnnnnnnnnnnnnnnnnaagacagaattacgcaaacctcattctgacgaacctaagaaaccgagaacagataaacctcccaaacctgaaaaagagagaaagcataaagataaaaaggnnnnnnnnnnnnnnnnnnntaaagactctttagaagatttgccgcgaagagaatctacgaaacgcgtagcaaagaaaaaaaacagtttagcggaagtgcgaggaaaagacgacgagccagaagaacctccagagttccaggattctgattctgatccagcgtggactccagccgccaataacgatgaaagaggaaggagcgggaacccgctataaagaacagacgagggagaccattgggcagcaaatctaagaaaacactccaaaacttaatatcagcggcagcttccagggagttgctattggcgtatgtaagattaccgaagtggtatcatttctctccataaaaatatcctcttctaattacaactaatctgcatccaacctttaaca

SEQ ID NO: 11220 - DNA, 1078 bp, Diabrotica virgifera
  misc_feature (10)..(29): n is a, c, g, or t
  misc_feature (31)..(420): n is a, c, g, or t
  misc_feature (430)..(449): n is a, c, g, or t
  misc_feature (451)..(556): n is a, c, g, or t
  misc_feature (561)..(588): n is a, c, g, or t
  misc_feature (763)..(800): n is a, c, g, or t
  misc_feature (811)..(873): n is a, c, g, or t
  misc_feature (879)..(900): n is a, c, g, or t
  misc_feature (916)..(934): n is a, c, g, or t
  misc_feature (1034)..(1051): n is a, c, g, or t
  misc_feature (1054)..(1074): n is a, c, g, or t
ttgcgtccgnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatagaggnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccnnnnnnnnnnnnnnnnnnnnnnnnnnnncttacggataacagcggaattttattggggaaggcaaaacgataataaaaatatgcgaccccccaggtggattaaaagttataaattgggggagaagccatattaattaaaactggtcgcctttttaaaaattacatagagctgaggtttaaccccccgcggaggcccggtgggnnnnnnnnnnnnnnnnnnnnnnnnnnnnnnnnnnnnnnaaagggccccnnnnnnnnnnnnnnnnnnnnnnnnnnnnnnnnnnnnnnnnnnnnnnnnnnnnnnnnnnnnnnngcctcnnnnnnnnnnnnnnnnnnnnnncgggggtggggaggannnnnnnnnnnnnnnnnnntgcccaaaataaattatcttggggggcggcgttttcaaaaagcgggggtggggaaaaaacacgcgcggggccccccccaatttcccctctccggacacannnnnnnnnnnnnnnnnngcnnnnnnnnnnnnnnnnnnnnngccg

SEQ ID NO: 11221 - DNA, 813 bp, Diabrotica virgifera
  misc_feature (282)..(331): n is a, c, g, or t
  misc_feature (428)..(446): n is a, c, g, or t
cctagagctcctatgaagggcatggaagacaaatctcccgacagtaatggtgtaccttccgcttcttcaaacccgcctccacccgtgcctgtcactgtacctcccttgcctacaccaagactgtcgtctcaaggcgatccccaggatgatccgagatacttccctttacctaaggaacgaaaacgcaacagtttcgacagctcagatgacggcttcagttcggacgacgatttctttggaaaaaagcataaacagaaacctgctcctacgaatagcgaggtnnnnnnnnnnnnnnnnnnnnnnnnnnnnnnnnnnnnnnnnnnnnnnnnnncaaaaatacacaaacctcattctgacaaacctaagaaaccgagaacagacaaacctcccaaacctgaaaaagagagaaagcataaagataaaaaggnnnnnnnnnnnnnnnnnnntaaagactctttagaagatttgccgcgaagagaatctacgaaacgcgtagcaaagaaaaaaaacagtttagcggaagtgggaggaaaagacgacgagccagaagaacctccagagttccaggattctgattctgatccagcgtggactccagccgccaataacgatgaagaggaaggagcggtagccgttaaaaagaacagacgagggagaccattgggcagcaaatctaagaaaacactcaaaaacttaatatcagcggcagctcagggagctggtattggcgaaggcgatgattacagcagcgatcattctcacaaaaaaaactcctcaaaatcaaacagccgcaacaaactcagcagcaaatat

SEQ ID NO: 11222 - DNA, 381 bp, Diabrotica virgifera
  misc_feature (16)..(17): n is a, c, g, or t
  misc_feature (24)..(25): n is a, c, g, or t
  misc_feature (29)..(31): n is a, c, g, or t
  misc_feature (70)..(71): n is a, c, g, or t
  misc_feature (74)..(75): n is a, c, g, or t
  misc_feature (80)..(81): n is a, c, g, or t
  misc_feature (254)..(271): n is a, c, g, or t
tagaggccgggagaannagaaggnnaaannnagggggagccatttttaaacatcccgaagaaaaaagggnnagnnacagnncggaaaagggaacaaaagcagacacgaagaaaaataccagttatccttgtagaaagtcccactctgcataatatcaatacaagtgttacgtctattgatgaaactctaatcgacgaagggaccaccaccaatccaccaccattaggtgattatctgggacgaaaagtgcagtnnnnnnnnnnnnnnnnnngaaaatgagattaaaaataattctatccccggtccatcctccacggaggatggggtatatgccgccatgcaattttttttcttaatctcctacgacgcattccgatataa

SEQ ID NO: 11223 - DNA, 530 bp, Diabrotica virgifera
  misc_feature (235)..(257): n is a, c, g, or t
aaacaaaccaagacacgttgaatgttacgaggagcaatcccaaatcatgatttacttatttatttatttattcacgggcaagccctattcagatataaatgttacagtgttctaaattatataacaattatacaattatataacattaatgttaaccaattatataacataaattatcataatataacataacaaagtggtttgagaaaaaataattctatgagtagtacagttnnnnnnnnnnnnnnnnnnnnnnnaagataacattaggtcagtacaattacaaacaaaagatatcacctaaatcaattcagaaatgttccaaggtataacggttttgagtcctctaatacatacaggtcatgtaaccctaatcacaatacaaaagctctggccgaaaatattaaaaaagtacggaagaaatatggtttttatagcgggaaaacgatatattaaaaaattccagggcatttaatgagctaccctaatccaaaagttttttagaataaaacgtgctgtaacgaacaatt

SEQ ID NO: 11224 - DNA, 371 bp, Diabrotica virgifera
  misc_feature (113)..(137): n is a, c, g, or t
gtggtttgtgtttcgtttgcccagcctgtaattcgaaatttagcccagcgttgggagtcctacacgaaaattttcacgcccaatccgttaaacatttaattaacaaacttatnnnnnnnnnnnnnnnnnnnnnnnnnccgaaaattagtgaaaagtgacaaaagaggatcgattgacgtagaacgtcggcccgtttcacactgcaacacatcggtcgaacaatgcaactgatatttttcgaattagtggtgaataatgacatctgaagtgcaagaagtgcgtgtagaatacgttgaaaattcggcacaggagtcgaaggcgacaccctcccccctagctctgctagcggccacctgtagcagaataggctc

SEQ ID NO: 11225 - DNA, 680 bp, Diabrotica virgifera
tgtaaataaatttttcagttcatgtaaacaaatttacatggtagataaacaaactagaaaagtcttatttttagcagcattttgtaccagctaagatcatgaactgatcaacatgtacacgaaacattctgtgatgtggacatttaatttgatgattttggtatttaatattcaaatgatatcatctcgaaatgatcctaaaaatgatcctagaagcaatggagatttggccttatggatcgatgaaaaacaggtgaaaatgtttagtgatccagatcctgaatgtgacaagaaatgtgccaatcaaggcagatgtaaccatgaaaaaatatgccagtgccctgaggggtatatggggccttattgcagaactgctttatgctatcctcagtgtatgaatggaggcaactgtacttcccctggaatttgcagctgtcctccaggatttcaaggaagacattgtgaaggaggtatttgtggtgagaaatgtctaaatggtggaaagtgtatccaaaaagacacatgtgaatgttctaaaggatactatggaccccactgtgaatattctcgttgcattatcccttgcctaaatggtggaaagagcaaagctgtaaataagtgcaggtgtccaagaggatttccgtggtgatcactgcgaaattggaagagcaaaacctgcc

SEQ ID NO: 11226 - DNA, 981 bp, Diabrotica virgifera
  misc_feature (679)..(679): n is a, c, g, or t
  misc_feature (880)..(901): n is a, c, g, or t
ctctgacacctaatcagctttaaaaacccaatttttcgcaattttttcaataagagattatcttataaacactataattttaaatgtactgataaccagaggtcagttgtagtagaaccttaaacatggcagccccagtagtcattgctgcgaccacgaaacacacaggaacactaattttcttacatggattaggagacactgggcaaggatgggcaagtgctatggctgcggtgagacctcctcatgtaaaagtaatttgtcctacagcccctacaatacaagtcactttgaatgcaggttttcgcatgccaagttggtttgatctgaaatcactagacgaatcaggacctgaagatgaaccaggtattaaagctgcaacaaaacaaatccattctttgattgaaactgaagtaaatgcaggaatcagtgtagacaggattattttggggggattttctcaaggaggagcccttgcgttgtactctgctcttacttatcctaaaaagattgctggggttgcagctctatcatgttggttgcctttaaataaatctttcccagcagctaagaaaacagaagacactttaccaatattgcagtgccacggcgactgtgatccagtagtcccttacaagtggggccaaatgaccgcatctgtattaaagaacatgcttanagacgtcgaattcaaatcatacagaggcttgtcacattcttcttcggacgaagaacttaacgacattaagcaatttataaccaaaaacctacctagttcatagatgattctttgtgaaactacttgtgttccttacatacttcttattcaattcccattagggggggttcgaaaatatatttggtaaataggggcgatttnnnnnnnnnnnnnnnnnnnnnnttgaatattatatacatagtgataaaaagtattttgtaaaatatgactagatattgataaaatcttcatttgctatggtt

SEQ ID NO: 11227 - DNA, 602 bp, Diabrotica virgifera
ccccgacggcagatcatcaattactggaatacgtattctttaccttgaggactttattagtaccatcttgcgtttgacgcatcgattcgacctactaatattttcggtatctggaataagttaacgcatgcattgccactgatgcgaaccatgtagacgagctatcctttgtgcgctctctccgaacctaccaacgccacagaatctgaccgacagatttgcctacaccatcatttctcattatccttcgagtactactcctagaccccacttctgtcccttatgaactagactcagccagatcccatttacttgtccgtggcctggctgacgagaggagatatgcaagtattgaacttattacatatcttacctctccaggaggactcatgaacatcgatgctattcgccatatacgtcggaagacaatatgaatgatgtcgtagccgttgcttatatgaacatactgcaagtgctaaagctccgcacctaaaaaaaaagcctgggcagtgaacctcactccagccatcgtgcaactaccataaacaagctacatggtgcgcgacactgaaatttcctattatctgaagaaggtaggggtg

SEQ ID NO: 11228 - DNA, 891 bp, Diabrotica virgifera
  misc_feature (829)..(829): n is a, c, g, or t
atttaactttacttacgacatgtcatatctcgttttctcaacaataatacaaatgataggactgggtatgtacggaggagacgattctggaagtagttcagaggatgagagagatagaggcagttacagagattctgatgatgagttgaggaatttaatcaagcgaaaaatgagcgaatttcaaaagaccgaacgggagatagaagagaaattagacgaagctgaaaggcggaaggaaggcagcgctagcagatcaccaagtccggaatccaacgataatgattcacaggtagacgctcgaagtcaagatcgcagatattcccaacacgatatgagagacgcgtcccccgtgtatgaaaaacacaaatcaaaatccagttcttcatcttcgcaagaagatagctcttcttcggatgaatcgaaaaattcctacaaaagatcaaaaaagaggtcgcccacacccgaaagaagacactcacgagtagcttcctctcgttggtctaagtcccctccatcgaggagatctactagacgggactcgagtagcccgatcagaagagattctagaggatcaaggaagcaatcgacgacgtcttctaagcgatcgaggtctagatcatattccagatcgcgcaggtctagatcgtcttcgtacagacgatcaaaaagatcgagatcgcgagacaaatcgagaagatcgagaagttcgactagaagccgatattcaaaaagatcaccttctagttcgagatcagatagaaagaggaggaggcgctcaaggtcagatagtagcagtagggggtaagcgatctcacagacattgatcgancatcgaaatcccaaagggttgtatatttttacaattcttaagggtcttttttagatgaaaaa

SEQ ID NO: 11229 - DNA, 811 bp, Diabrotica virgifera
actttatgataattatacagcgctccttgccttgacaattcttatgtaatttgtacaggtgtggagtgcaatgtttctgttttgtgtattatctattatgataaataaataaatatctatctatagaaataccgccattccatttgtcgagtgcttttctcattatatattccccatagaaattaaaaagacttggagatagaatatatccttgtcggactcctctacctattttaaaaggatcggacttatggttttcaattcttattctggtttcactgttttcatataggcttttcaccagagctgacagatgatcaggaacccccatctcatgtagaactttccacaaaactgtccagtctacacagtcaaatgccttctaataatccagaaagcagatgatcatcggaattttgaattttcgtgctttctcaatgagttgtcgcatattaagaatttgctcccttgtgcctttacccttcacgaagcctgcctgttcttgtggtatttgtctatccaggtatgtttgcatgcgacacttgatgattctcaacagaattttacttgggtgtgaaattagtgaaatggttcggtagttactacattttgtggttacgcctttcttatgaatgggagtaaatagtcaggcaattgattggcttgcaaattttagaagtcacgaatggtgtaaccagaagattagctgtaataaagttttatttttgatattgttaatagatattaaaagtaaaacttttcattcgtgataaatacgtatttatcatatttatcttattaaaaatggaac

SEQ ID NO: 11230 - DNA, 216 bp, Diabrotica virgifera; identical to SEQ ID NO: 10770
  misc_feature (6)..(28): n is a, c, g, or t

SEQ ID NO: 11231 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11232 - DNA, 926 bp, Diabrotica virgifera
  misc_feature (828)..(828): n is a, c, g, or t
ttcttattaaaatcaatatgatctttttaataggatgttctgttataattttggttactatcatagccattattcgttcaaaaaaacctctacatactctactagaagaagctaaatgtgagatgatatataattatattggatccaaaggaatttttcaggatttcattatgagaggaagtaataaaattgatttgcctatagagactggtcgaaatgctgtgataactggaggtactagaggaattggtgtggaagtaataaatgttattgaaatgtgatattaatgtaattatgggctgtagaaatataaaacaaggtgaattattactccaaaattttagagatgaagggattaaaactggaaacattgacattattaatttagatataagtgttatggactcagtaagaaattttgttaaatctgttaaagagaaatactcagtagtacattacttaatcaataatgctggaataatgtttggaccatatattgaaaccagagatggctatgaatctcagttttctacaaattacttaggacactttttattgacacatttgctgctaccacttcttaaggcaggtggcacaaaagagaagaaagcaagaattgttaatgtttcttcttgtgctcattttgttgttggagatattaactttgaggatattaataacaggcatcactatatatctggtgtagcttacgcacagtcaaaaatggctcagatattgtttacaaaatatttggatgcaatccttgagaaacaaaaaataaatgtgcaggttcatgcagttcatcctggacttgtcaatactgatttngttcatggcacaaatttgaaaaagtgcgctcctctgatacctgccttagtggtcaagagtcctgaaaaaaggtgcaacacccattctgtatgcttgcg

SEQ ID NO: 11233 - DNA, 122 bp, Diabrotica virgifera
  misc_feature (20)..(56): n is a, c, g, or t
  misc_feature (58)..(90): n is a, c, g, or t
cgaaaaaaccccataaaggnnnnnnnnnnnnnnnnnnnnnnnnnnnnnnnnnnnnncnnnnnnnnnnnnnnnnnnnnnnnnnnnnnnnnnggggatttaattaatatactttatattttttt

SEQ ID NO: 11234 - DNA, 984 bp, Diabrotica virgifera
cagaaaatgtcaaaaagtgaacttctaaaagaatacaagaaaaatgtagtccaaatcaaaaaacatgccaaaaatttaggcttgagtgaaaaagaagtcaacatactattcgaacaatcatttctcgaattaagaaaggaacaaaatggtacaaatgtgcccaaaccaatcaaagctcaaagtctctgtactagcataagaaacatattcgtactatttactaccctatctttttttatttacatcttgttgaacgttcatcaaccaacgtccagcatagttttaaggaatgttcaaggtttaacttatccaaccttgaaatttataaggtttttatctgtcccaataatcagactggttccatctttaacagatttatatgatgaaacatgtcttataaaaaacccctacttttatgtagcagatatggaatgctggccctgcgaaaatgttttcgctggggtgaatatttcatccatggaggaaaggtatcttaaatctgaatctggaactccttttattgtcaaatcgaaccaaaagactgtaacccttaaaaccctccaacaaacttacaaacaaaacagggtactcctggattccgaaacaagaagactaccatctactaattccagtattactacattaagagatttattttggtagtgacgacaatattttttctgtccaatttgaacactcatatctcttggagaataaccaaaatggcatctgcttcgaatcatcgtcagggctttccaaaaacatttttttcttccagaaaagaatctggtcaaaggttgaaagggttttgtatgtttaaatggtgccacccaggagaagcctttcctggttacctaaaaccaaatggcagcttaactattttttaattatactgggtatgggaaagagaaggattcttgactaaaaccctccccaacaaaaggaacaaaaatctgcccgggcctgcaaccgaaaaatttaaac

SEQ ID NO: 11235 - DNA, 342 bp, Diabrotica virgifera
  misc_feature (6)..(28): n is a, c, g, or t
tcgtannnnnnnnnnnnnnnnnnnnnnngatagaaaccaacctggctcacaccggtttaaactcaaaacatgtaaaattttaaaagtcgaacagacttaatgagatagctgctactccaattagaaactttagtcctgcatcgtggtgccgatctttatattccttttgagctctcaaataacccaacgctgttaaccataaggatatttatgcgttacaaacatctatattgataatattaatatatgaattaagtaggtgcttaaaaaaaaaattatctattaagatttagcttagggagacggattacgattaggaatgttcgtattgtaacaagatgc

SEQ ID NO: 11236 - DNA, 684 bp, Diabrotica virgifera
atgagagaggatatattgttatcaatgaatcaaaataatccaatttttatctaaacttgataaccatattatattaacggtggatttctaaaaatatgagtttaattaaaatagtgtatgtattaggtgatgtagaagcagaacagaacatactgtggaaactaactttagtattttcaaaatgttaggtaaaaaagtggacttcaaatgtttcataatttttctaatgggtattaccatattggtatgtgtatatcaacaagataatatattttcccgaactgaaattatcgaaaacattagtggagaagaactaaaattgacagcagaggcaacttccaacggaggagtatttacgataaacacccctggttgtacaattccatacctgcatccttatgataaaagtattttagattacgtagagcagccaggaaaatatgtttgtaataatggtaccccagcattatttgaaacagacatggagtctataaaaattatagagaaatcattatccttctatcacataaccaatataaatgatctgaaatgttgctacaaagcattctggagagaggatcctcacactatggcagacaagaaaataagctacagtaatagttgtgaaacatttgttaataaaactgacataaaagaaaagtttataaaagtaacttgccacta

SEQ ID NO: 11237 - DNA, 63 bp, Diabrotica virgifera
  misc_feature (2)..(62): n is a, c, g, or t
gnnnnnnnnnnnnnnnnnnnnnnnnnnnnnnnnnnnnnnnnnnnnnnnnnnnnnnnnnnnnng

SEQ ID NO: 11238 - DNA, 720 bp, Diabrotica virgifera
  misc_feature (2)..(171): n is a, c, g, or t
  misc_feature (184)..(270): n is a, c, g, or t
  misc_feature (272)..(286): n is a, c, g, or t
  misc_feature (288)..(436): n is a, c, g, or t
  misc_feature (443)..(480): n is a, c, g, or t
  misc_feature (500)..(513): n is a, c, g, or t
  misc_feature (516)..(538): n is a, c, g, or t
  misc_feature (546)..(568): n is a, c, g, or t
  misc_feature (598)..(629): n is a, c, g, or t
  misc_feature (636)..(679): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggatgaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnncaaaaaaacttacagagcactcaaaaaacacacaatacaat

SEQ ID NO: 11239 - DNA, 191 bp, Diabrotica virgifera
  misc_feature (33)..(58): n is a, c, g, or t
taaaaatccgctttaattttaagtcatcgttcnnnnnnnnnnnnnnnnnnnnnnnnnnacagacaccttcaaataatattgtgagagaattgaaacgaaactgaaatctatttactagtttgactctctagttacgtaatgaagaaaggaaatgaaaggcacatatgagatcttctactacaaagcgtata

SEQ ID NO: 11240 - DNA, 335 bp, Diabrotica virgifera
  misc_feature (101)..(118): n is a, c, g, or t
caaaatgaataagttagcagtgttcactttattttttgctattggtttccaatcatcagcacgaaatccggccgagaaaacacgacaaaaacggaaacgtnnnnnnnnnnnnnnnnnnctcgacttctgagataaagcaaaatgcagtccacataggagatctacaccactaagaaaatgaggatcatgacgggaccgcaataccaaactatagtctgaatgtaatcaccgccacctgaacttcaaattaaatagatgccaagacggataagtcgaaccaggtggccccgatggagaatgaaacgtcaaccaaacacgagaatgaaaaacaaaat

SEQ ID NO: 11241 - DNA, 502 bp, Diabrotica virgifera
  misc_feature (186)..(204): n is a, c, g, or t
  misc_feature (371)..(394): n is a, c, g, or t
  misc_feature (440)..(466): n is a, c, g, or t
ataattaatccaaatccaattataaataaaaattcaatataattgtccacgtccatacatgatttgtgttagagacaattaacacaacaatatcaataaatttttaactcagataaggtgttattccagtaagtactaaataaatgttaaatatttatttaccagtttgtaatagctaagagctgnnnnnnnnnnnnnnnnnnngcagaatttatataccaattaagtacgtgtgtgtgatactgcagtcgctatatgcatatgtctatatattttagtaagaattatatattagtaataaatgagatattaattattaagatactagtatataattaatatttatatgtatgaggtatgagcttacaacnnnnnnnnnnnnnnnnnnnnnnnngaaaataagaagtaggatttacccattttatagtatactataagcnnnnnnnnnnnnnnnnnnnnnnnnnnntctatactctatatattacatattaaaaatataaat

SEQ ID NO: 11242 - DNA, 444 bp, Diabrotica virgifera
  misc_feature (23)..(41): n is a, c, g, or t
  misc_feature (199)..(223): n is a, c, g, or t
atgatttgcaggggtgtgtggtnnnnnnnnnnnnnnnnnnnatatccacgtctatacaagttttgtgtatttgaccattaagacatcaatatattagattttattgttataagaagtagttgtaaccatatgaaccttgggtcacttggaatttcaccagagctatacaaatgctcttgttcttgtattcgtaagtagnnnnnnnnnnnnnnnnnnnnnnnnnagtatatgcattttttataccttctgatgcatcaaaaggtcatttatcttttatttattacgaatagctgaagaattaatatgaccatgttattgattctttacacttctaacggatgatcttacaattagcattataatagatagtgaccggcagagataaaataagattagacgtttcgcatattaaatcctatgtaaagaactactcatttatatatt

SEQ ID NO: 11243 - DNA, 407 bp, Diabrotica virgifera
caaagatggtatactgtgttggtattatttagcttaacttcctattggacggatcattatccttgatccggataagttgtattcttttgttcggaatccttgccagttaattccgtgatattttatcgcatcagggacaataacagttgaatactttccgttcagacaacttgtgaagcaacttttataccaccatcctccctcaggatttttaccgagagtggagagattacaagtttggctttggaaatctagatggagagttctggattggattatagaacattcaccatatgacagcggttgaacccagagaactgataatagaacttatagataagggacagaaatcaggtacatgccctaagtacatggctaagctatggcccctagacaggacatgtacg

SEQ ID NO: 11244 - DNA, 232 bp, Diabrotica virgifera
  misc_feature (9)..(10): n is a, c, g, or t
  misc_feature (16)..(66): n is a, c, g, or t
  misc_feature (69)..(69): n is a, c, g, or t
  misc_feature (94)..(123): n is a, c, g, or t
  misc_feature (134)..(222): n is a, c, g, or t
gctggaatnngagggnnnnnnnnnnnnnnnnnnnnnnnnnnnnnnnnnnnnnnnnnnnnnnnnnnntanaagcttaatttttttaaagacgagnnnnnnnnnnnnnnnnnnnnnnnnnnnnnngtttttttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttgat

SEQ ID NO: 11245 - DNA, 202 bp, Diabrotica virgifera
  misc_feature (163)..(192): n is a, c, g, or t
gtcaaaatggactataaatatctgctcatattcacatttttatgcagttcataataaaaactcattgtatgttccaccaacgtaacctactcgctaaaactgctataatatctatttctttgcattacgaccgagtgtcataaggcaaggatactttgctagnnnnnnnnnnnnnnnnnnnnnnnnnnnnnncgagtattat

SEQ ID NO: 11246 - DNA, 244 bp, Diabrotica virgifera
gccccccgcgcgccccggttgatagttgttttttatgacacatgatacatatttttcagtaaaggaaagatcatctaataaaggacgtcgttgagcatgggacaaatatttatctttcataaaaaaaatcacttctgcgcaccacgagggccagcgactgatgaaccaactgaaccagtataggtactaaagggtagttgacaaccggtcaagattatgatggttatgtcaaatgagtgtgtct

SEQ ID NO: 11247 - DNA, 887 bp, Diabrotica virgifera
  misc_feature (60)..(831): n is a, c, g, or t
cagacgtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacttagacttcaaaaaaccccaactccgacaaaagcaaatggatcactcctgacc

SEQ ID NO: 11248 - DNA, 1013 bp, Diabrotica virgifera
  misc_feature (37)..(51): n is a, c, g, or t
  misc_feature (53)..(147): n is a, c, g, or t
  misc_feature (149)..(256): n is a, c, g, or t
  misc_feature (258)..(285): n is a, c, g, or t
  misc_feature (287)..(541): n is a, c, g, or t
  misc_feature (556)..(575): n is a, c, g, or t
  misc_feature (577)..(657): n is a, c, g, or t
  misc_feature (659)..(696): n is a, c, g, or t
  misc_feature (698)..(720): n is a, c, g, or t
  misc_feature (722)..(748): n is a, c, g, or t
  misc_feature (750)..(802): n is a, c, g, or t
  misc_feature (811)..(829): n is a, c, g, or t
  misc_feature (879)..(911): n is a, c, g, or t
  misc_feature (919)..(932): n is a, c, g, or t
  misc_feature (934)..(976): n is a, c, g, or t
  misc_feature (988)..(1005): n is a, c, g, or t
tcttatttattctaaaataataacatattttttagcnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaaaaaattgcnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnncnnnnnnnnnnnnnnnnnnnnnnnnnnngnnnnnnnnnnnnnnnnnnnnnnnnnnnnnnnnnnnnnnnnnnnnnnnnnnnnngtaaaaaannnnnnnnnnnnnnnnnnncgcaaagaccccacacagctttataaactattaataagctttttttagcnnnnnnnnnnnnnnnnnnnnnnnnnnnnnnnnngggggggnnnnnnnnnnnnnntnnnnnnnnnnnnnnnnnnnnnnnnnnnnnnnnnnnnnnnnnnncactttttttgnnnnnnnnnnnnnnnnnnccccaggg

SEQ ID NO: 11249 - DNA, 448 bp, Diabrotica virgifera
  misc_feature (7)..(253): n is a, c, g, or t
  misc_feature (305)..(322): n is a, c, g, or t
  misc_feature (365)..(384): n is a, c, g, or t
  misc_feature (392)..(415): n is a, c, g, or t
  misc_feature (432)..(447): n is a, c, g, or t
gaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaaaaattaccttaaggaaaaacagggaattttttttgggaagttccaannnnnnnnnnnnnnnnnnacccccctggggggggtttaaagttttatatttgggggaagannnnnnnnnnnnnnnnnnnngtttccannnnnnnnnnnnnnnnnnnnnnnnatttcgagatttaaaannnnnnnnnnnnnnnna

SEQ ID NO: 11250 - DNA, 122 bp, Diabrotica virgifera
  misc_feature (18)..(50): n is a, c, g, or t
agataaaaaaactgtccnnnnnnnnnnnnnnnnnnnnnnnnnnnnnnnnngtaaaaaatgcttatattttttttacaagcaccagaaagactccctatagaagatttatacaaattttttta

SEQ ID NO: 11251 - DNA, 943 bp, Diabrotica virgifera
  misc_feature (664)..(689): n is a, c, g, or t
  misc_feature (704)..(723): n is a, c, g, or t
  misc_feature (853)..(853): n is a, c, g, or t
cactaatcgtcttccttttggggaaccgtctctcgctgccctgactatcctatttgttgtcattcggcttatgtggtcattccattctattcttctgtttcttacccagacctcatacttatatctgggatcattgatcataaacacagcgtcactaaagaaataaaacgtgaataatagatgtgatctaccagaattcatcataggaaagatgactaaaatatggaaggactctcaaatttcacgaactctgaaaataaggctgatcaactacttaatattctactgtactgacatacggatctatatcttggatcctaggacaagcggaaagaagaagaagatggatgccactgatatggtctgttggagaagaaagttatgaattttgtggactgaccacaggacaaataattcaattttaaatgagctaaaggtcagtaaacggctctccagcaaagtccaactgcatcatttaaaatactttggacagtttatgacagcagatacagaaaatatggaaaaacttattatccaaggaaagatagaaggccggaaatcacgaggaagatacccaacaagatggattggccaaactacaggaatacgcaaaagacctctgcatcagttgaaagaaatattccggtaggtgtgagttgacggnnnnnnnnnnnnnnnnnnnnnnnnnnttaacgaagaacagnnnnnnnnnnnnnnnnnnnngtaacaaaaggtgttttgcttatacatcgcgtaagagggtttgttattgtttcggcccagcgagcggccgatgcctctggggtgttgtaaccgactgactgagtcgctgaaaagaaaccacaacgttaantctgtttgtgttttaccatctgaccagatgggcaataaattatttagatctggcgtttaaagggtgaacatttctgcagtcttacgtttt

SEQ ID NO: 11252 - DNA, 838 bp, Diabrotica virgifera
catccccactccaaacggcagagacgaagctggcgccaacagagattgctttattttaaacccactagccaaaacttgtctgaacctcaacatgttcaggtttcttggtgttctaatgggcatcgcaataagaacgggatcacctttaagcttaaatctagccgagccagtttggaaacaactagcgggcatagaactaacgcccgcagatttgactgaaatagatagagactatgtaccaggattgttatgtattagggatatggctccggaagagcctctgtttcaaaatttggaaatgccgttttcgactccgtcttcttgtggaactgatgtacatttaagtactagatacaagaggataacattcgaaaatcgactggagtacgtcaggcttgccttaaatttcagattgcacgaatttgacgaacaagttaaagctgtgagagacggtatgtcgcgggtggttccggttccgttgctgtctctttttagtggatacgaactagaaaccatggtttgcggatcacctgatatacctttaacactgcttaagtcagtagctacctataaaggaatcgacagcagcgctccgctgatccagtggttctgggacgtgatggaagaattcacgaaccaggaacgatccctatttttacgcttcgtttggggtagaacgcgtcttcctagaacaatcgcagacttcagaggcagagatttcgtcatacaaatcctcgacaagtatacgccccccgacaacttcctacccgaaagttcacatgcttctttttgctaaaatgctagattttgtggaagcctattttgcttaaaaataaag

SEQ ID NO: 11253 - DNA, 1049 bp, Diabrotica virgifera
  misc_feature (207)..(230): n is a, c, g, or t
  misc_feature (243)..(260): n is a, c, g, or t
  misc_feature (294)..(316): n is a, c, g, or t
  misc_feature (542)..(562): n is a, c, g, or t
  misc_feature (641)..(660): n is a, c, g, or t
  misc_feature (725)..(771): n is a, c, g, or t
  misc_feature (916)..(933): n is a, c, g, or t
  misc_feature (938)..(972): n is a, c, g, or t
taattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnngtgaaatttaaccttcttccctcacattttttatgattaataggaatacctccgacgatattcagattatcctgatgtatttatattatgaaatattgtatcttctattggatcactaatttcttttaatggggggattatttcnnnnnnnnnnnnnnnnnngagannnnnnnnnnnnnnnnnnnnnnnnnnnnnnnnnnncctttaaaaaataactttttttcattgaatgactaaaaatttaacccccccccctaaacccagaaatttctgaattt

SEQ ID NO: 11254 - DNA, 620 bp, Diabrotica virgifera
  misc_feature (2)..(493): n is a, c, g, or t
  misc_feature (499)..(619): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 11255 - DNA, 855 bp, Diabrotica virgifera
  misc_feature (387)..(411): n is a, c, g, or t
aaaatcgggaatattttctctatctgctcctttgagctacttaattaatttatcggttgctaatggcaaatttcctgacgcacttaaaagcgcaagagttattcctatacacaaaaaaaatgatccaggattgatttcgaattatagaccggtagcagtgctgagcgttttatcaaaaatttttgaaaaggttgtatataataaaatggtttgttttctcgacaaattcgatattatatccccgcatcaacatgggtttaggtcaaagaagtcaacgttgactgctgcatgtcatttttttaattatatatatagagatcttgacaggggaaggcatgtggcaggtctcttttttgatttgtcccgtgcctttgattggctggattnnnnnnnnnnnnnnnnnnnnnnnnncaacctaggtttcagaggagatttcttggactggatagtagactatttgagcaatagaaaaatgttagtttcatatcagaattctgcttcgacagttttcaatattgataaaggggtccctcaaggatctgttttaggaccgcttatatttattctttttatgaatgatcttcctgactacattaaatctcgagttattactatttacgcagatgatactgcactagcggtctctgcgcctagtaaagaggaacttatattattatccaacggtgtttttgggtcatttgtagattggtccaaagcaaatggattaatagtaaacgttgataaaactcaatttttatatttttcatcccaaaatgttcttagcaatgtatactcattatcattttaattttgacaatatacttatttcgtcagttaccacaacaaaaattttta

SEQ ID NO: 11256 - DNA, 54 bp, Diabrotica virgifera
  misc_feature (5)..(48): n is a, c, g, or t
agggnnnnnnnnnnnnnnnnnnnnnnnnnnnnnnnnnnnnnnnnnnnntgtatt

SEQ ID NO: 11257 - DNA, 752 bp, Diabrotica virgifera
catctattccttacattttcgtttttcatttgattatcgattcatacttttctcataaacaacttaaatacgactagaaatgaataatacataagtacttgatacagagcccgcgttctctatatacgcttacccgattactatggcttttagtgaactatcaccatgctatgatactaattctagatacatttgaagaaacagagggcaatgttagcaaaactttttgtaattttacggaagcctttatcgaattccgtagtagaagagaacagatactattggactgaggctccaagacgaaaagtgaagccctggctcctctacgagaatgccgctatatgattttatatagaattgaatctacagataagattaattaatactgggtcagcaataattatctccgaattgtatgaatatggaaatattttcgacaaatgcaagcttattgggaactcttccggaagttccaaagctcaaaaaagtgccttatataagctgtagttatgaaccatctctacaagatgtgatagctgagatattgtctgagctgggagatatttataagattcctccggtacaggcacctgaattaaccgagaaacctgtagtagctatattaaaatgaagagttgtgcatgataatgaacactagatatctgacatagaagaatttaggcttctacaggtgctacgaaatgtacacgaacataaacatttacttgtgaattgtcatgatgcttaccaag

SEQ ID NO: 11258 - DNA, 241 bp, Diabrotica virgifera
  misc_feature (6)..(196): n is a, c, g, or t
  misc_feature (233)..(233): n is a, c, g, or t
aaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttaggggataacagcgtaatttttattggagagntcaaatcg

SEQ ID NO: 11259 - DNA, 106 bp, Diabrotica virgifera
gcaatttcgcgagccgctttaatagattttacttttttcgaagttgaaacttattttggatagtttaatattcaatagagagcagtcatactttatttacatagaa

SEQ ID NO: 11260 - DNA, 778 bp, Diabrotica virgifera
  misc_feature (175)..(193): n is a, c, g, or t
  misc_feature (440)..(440): n is a, c, g, or t
gttcaagaattaatctactttagtacatttaaataattgtaaatggttaagataaattaaactattggaaagtttgtattttatttcgtattttcaacaatagtgcatttttttctaatggttaacagcataaatttgaaataaaatcgaccaatgtatttttataaataatagnnnnnnnnnnnnnnnnnnncgttacaactaatcatgggaagaccaacaaattcgtccagaagtaaaggatctcaaagatctttaagtcaattaactcaagagagttcccaaagaaatggaaatggaacagatattgaagaccatgttaataatttggtaaggtattttatcaacagagcgggagaacatgtatctttcaaaagaacagaattaaggaaaaatgtgttagtaaacgtgggaacacaatttcaagagattatgaatanagctacaaaaatattagaagaggtatacggttataagatattaatagcagattcatcacaaaattcagcaaaggagtacctgattactaatgttttaccatataaaccagatccaacagaatatataccctcccaatggttatcctgaagatgcaaataaggtttttactctattggttttatcccatgtatttatgagtaataattcagtcagtgataattctctttattccttcttaaagacatttgggatagacgtgcaaaggcgacacgaaatttttggaagcattaaggatttgttaaatgtattaaagaataaaaagtatataaacatggaa

SEQ ID NO: 11261 - DNA, 727 bp, Diabrotica virgifera
  misc_feature (3)..(31): n is a, c, g, or t
  misc_feature (114)..(136): n is a, c, g, or t
  misc_feature (277)..(304): n is a, c, g, or t
  misc_feature (427)..(465): n is a, c, g, or t
  misc_feature (638)..(656): n is a, c, g, or t
  misc_feature (703)..(721): n is a, c, g, or t
ctnnnnnnnnnnnnnnnnnnnnnnnnnnnnncacgaaaaatctcatttaatgccagctacttagtattgcgacagaaccttttattctcataacagaacaatctattccttgcnnnnnnnnnnnnnnnnnnnnnnnttaacacccatctatttattattctcgaattcaaaagagctaaaaacctaaaatttctattgtaaaacaaatattctacatacctcttctgtaatgaaatgttatccccttttaaatatctctaactttttaagaaccaannnnnnnnnnnnnnnnnnnnnnnnnnnnctacttacatactcctatattattaatactacatatttttaggcatgagcttaaaactacaattctattaaaatctaatttcccaatacaaattagcaccaaacattttcatattttacaacnnnnnnnnnnnnnnnnnnnnnnnnnnnnnnnnnnnnnnnctataaacctttcactaaaatataaactcacattacttaaacccagtaacgatgataatatcagtattcaaaaactgtctatttagtaaacatatatagcgtctactaaaggccttcggcaacattttcttcacctgcttattatacacctgtctttttgtcttaaacatccnnnnnnnnnnnnnnnnnnnctaatttcaatggccgcggcctcttcaccgtgctaacgcaccctacnnnnnnnnnnnnnnnnnnngaagct

SEQ ID NO: 11262 - DNA, 1005 bp, Diabrotica virgifera
  misc_feature (552)..(552): n is a, c, g, or t
  misc_feature (728)..(728): n is a, c, g, or t
  misc_feature (741)..(741): n is a, c, g, or t
  misc_feature (758)..(758): n is a, c, g, or t
  misc_feature (778)..(779): n is a, c, g, or t
  misc_feature (811)..(811): n is a, c, g, or t
taaacacatgaaaatacatacagaatgaaaacgtttgaaattgttgctggtacatacgaagagtttttaataggatatgagttttttgaaaaagactcacagctggttcaaagctttgcttctcatgatcacagtgctagtatacgttccctaaccaggtgtgaccactatgtcgcttcaggaggtgcagatgatcgtataattatatatgactttagaatgcgaaaagaacattgcatgttatcacatcatagttctacagttacatgtttagattttactcctaaccattcgcacatactttcgggcagtcaagatgggttgttagccatcacacgagtaggcaattggcaggttgaaaaactatgggacaaagctcacaaaggctcagcaataatagacattgcagtacacccaactggaaagttggctttgactttaggagatgattgtacattaagaacatggaatttggtaaaagggcgtcaagcttacgcagtcaacttaaaaagcaaaagtaaagatccaaaaagtatatttaaaatatgctgngctgctgatggagttaggtttatactttatggtggaaaatacacagaaatatggggcactgaatctggaggtatactccaagtgatagaacacgatgttaaagttagcagttgtatttggtattcagacaaaaaaatactagttggttatgaagatggaaatataagtttagttanattatcttcattngaaaagactacaaatanagtccataaagacagagttnnaagtttagctaatttgaagattgatcatatcngggtcagcagtggtgaataaagtctgtataaagtctggagaagtagtaaataactgccggtgtagaataatctatgttatatactccgattcaataaaaaaaatgaagggtgagtgaactgaaaattgaaatgggaagaccataaaatcgagaagaaaaggctcccaatgtgtgaagcgtaaacagtgaaaaat

SEQ ID NO: 11263 - DNA, 852 bp, Diabrotica virgifera
  misc_feature (13)..(770): n is a, c, g, or t
  misc_feature (772)..(829): n is a, c, g, or t
  misc_feature (832)..(849): n is a, c, g, or t
cggacgcgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnagnnnnnnnnnnnnnnnnnncga

SEQ ID NO: 11264 - DNA, 248 bp, Diabrotica virgifera
  misc_feature (41)..(60): n is a, c, g, or t
  misc_feature (96)..(115): n is a, c, g, or t
  misc_feature (165)..(187): n is a, c, g, or t
atatagtaaaataacattggttacctgcctattgttttccnnnnnnnnnnnnnnnnnnnnccaaaactttaatatcacaagatttaaagttttggnnnnnnnnnnnnnnnnnnnngtaaaataacattggttacctgcctattgttttcctcgagatgtgacacnnnnnnnnnnnnnnnnnnnnnnnaagattcaaatgctatactaatatttgaaactgtgataggatctgtataaattacagtatt

SEQ ID NO: 11265 - DNA, 285 bp, Diabrotica virgifera
cccggcgggccccccctccccggcgttctttaacctatagtaatatattataatattttgatgaaatagctagtatagaatgtgggatactgatgatagaggaatggagttcgagaagatcatgaaaccttaagaaagtaagcccgtactgcgacagtgtgggacgggatatgaattattataaatggatatgcttatcattactccttgacatgtgtactagatgtcctccgaagatgactgttgacagtttgcttacattggttgccgctgaccgtccaacac

SEQ ID NO: 11266 - DNA, 258 bp, Diabrotica virgifera
aaacaagcatcggccaaaattttgtggattaatgtaagtacaattttaagttactttataaaatgccacgaaagcatactatgttaaaacgaaaccgtaatttttatctaagaaccaatagaggaaatagtccatggtcgaatgtatgtagacggagatagataaccaatatgtcgctaacaaaacaagtttatctggctcttctcactttttcctctcatgaacaattctccagtgacgcacatatagcgtttatcg

SEQ ID NO: 11267 - DNA, 611 bp, Diabrotica virgifera
  misc_feature (165)..(183): n is a, c, g, or t
cccccagttctttgaacaaccgatcaacagcaatatctgcagcttctctagttagtgctgttgatcggttgttcaaagaactgggggagaatgaaaaaaaagcaagaggaagaaagtacatcagtgtctgaagttgtgccggtggaagttgaagaatcatagccnnnnnnnnnnnnnnnnnnngtttatgaaaaaacagaagaaaaatgaaatgcaaatagttgcactcctgacatgtcacaataagttgaagagaaagaaaatgatgaggatatcattatatgatgacactccttaacaaaagactttaccaactgctgatgatttcacgtaagacccgactatagttcatgtggatgtcccaagtatgagtgagaggacgagctccaaaggaaatctctgtattagtaaaattgaaacccttattcctggtggtatttcgactgtatgataagatgacctaatcgttgaacatggaggaatgagagctgatgaattcaaagtcgtcgagactgatcccgtatccgtattgaatcttggctcctcaccccagacttcctggtgatggagattcaatcaagcggcgatgaggaagaggtagcttcttaaca

SEQ ID NO: 11268 - DNA, 337 bp, Diabrotica virgifera
gaatgtacaggaggatatggtttgggcaacagaaacgcaagaggtgacgtggaatgttataagtctacattcagcctttccatttctttaacggcattatgtacttttccagcttgatgtagacttataacattccacgtcactacttgcgtaggtgttctattgttaacaaccgcgagtgccttgaggacgcgagagtttactcgtatggcatatcttgttttccgaggttgttcatgagtagagtataggtgttacgatatcgagcttgctgataacttggataatagatatttatttgctttcttcttatcatatggatgattatataatttaa

SEQ ID NO: 11269 - DNA, 916 bp, Diabrotica virgifera
  misc_feature (703)..(703): n is a, c, g, or t
tatgtcttgtcatggaatataaccaaaataattatcaaaataacaacaaacaactttgaactttaactttacatactcatcgtgccgtcgtaaggaaattcgaaattctaaacctaaagtactctataagattacttaaaaatataatacatatagtgtttttgctgcaaaggcgttgttgcgtgggtcagagtttttgacgtgggagagctgtcaaaacgttggaatgtgacttttcattattgccgtgtttataataaacatagcaatggtgaggagtcgcattctggtgttttgacagttctcttacgtcgggaattttgacctacgtagtggcgtttttgtagtaaaaatactatagtacttaggcacttaccaactctagccttactggtttttttaatacgggttgagaatttacatagtatagttcaagcaatctatatagtgtaataggtacaaatatacaaaataatttctacagcggaatcaattcggacaaagcaatatcattgtgtgtgtcgaccagagcagcagggtttggagcagcccatatattcaatgtaatttcccactaccaaaatgtacccaatgctggaaacatctatcaatattatcgtatttgtttggctattttagagagcaaggcacaagttgtccagcgtagcgttaccgtcattcaaaataatgaagacgactacgncaaattaattctgaattatgaatttatcacaaccatgatacgagttatgaattatttaccagatcagataacaaatgttgctaatggcattagaaaaattggataaatgggagatgtacataccaaatttggacgtacaatttaacaaaaaaggatattcatcctcagtcagaacagttacatattcaacttacgacgagtagttatcgcgct

SEQ ID NO: 11270 - DNA, 1013 bp, Diabrotica virgifera
  misc_feature (110)..(128): n is a, c, g, or t
  misc_feature (141)..(154): n is a, c, g, or t
  misc_feature (156)..(173): n is a, c, g, or t
  misc_feature (624)..(642): n is a, c, g, or t
  misc_feature (657)..(657): n is a, c, g, or t
  misc_feature (849)..(868): n is a, c, g, or t
  misc_feature (897)..(916): n is a, c, g, or t
cgaccgcacaaaaaaattgttaaaaggaaattgtaatatattgtaaatgcgatttatttggaacaatttcagttcctaacatttttgtcacaaagttaaaaatggcggannnnnnnnnnnnnnnnnnntgctagacgaccnnnnnnnnnnnnnngnnnnnnnnnnnnnnnnnnttaattgtctccatttttgtataggtacatttttgtcgtaaaactaataataaacgcgataactcaataattctgctgttacttttttcccccattactcggaaaatatcgaccgcacaaaaaatttgtaataaaagacattatagaaaatcatattttcaacaatttcagtcgtcgcactttttgtcgaaaagttgaaaatgacggagatattgagcaaaaacggctctcctttaaattcaacatggcggctaacgtaacggcggaattcactcgcgatattaaatttacactactattgacacccgtaaagattagaaaaattaaattttggacatctcggcatgcaaggtcaaagctaaagtcctgtattttggctatctgtaggaaaacatcaaaataacttattataatgctgtttaatgacatttttgagccccttatgttgaannnnnnnnnnnnnnnnnnnatactttctgataanatatacaaatttattaaaataaacaccaaatcactgtgaaattgctacaaatgatatttaaaacattttttatgttgcgcagaagctatgcaccaagttttttggatccaaattgagtggtttgaaatgaatcgcccataaatatttgagtttattgtcattggaaactataagcaagtattacaatacgcnnnnnnnnnnnnnnnnnnnngggatttggactgactatgaatctgatcnnnnnnnnnnnnnnnnnnnnaaaatttgatgagtcattatccctgtgtgggtctgattgtttttaatagaaactttttttaaacagtgtaatatttctagtaaaataattttcaacc

SEQ ID NO: 11271 - DNA, 1116 bp, Diabrotica virgifera
  misc_feature (1011)..(1082): n is a, c, g, or t
  misc_feature (1084)..(1097): n is a, c, g, or t
ttttttttttaattctacatctatattttaacattatgctgtcatacttgcaacaaaactgttatcttcgttatctattatctgagttcctggaattcgagcaccatttaataactttgccctttcttcaagaatgccatacgcaaaatggtttaaaataagtggtttgggtaaagctactccctgaaatctataaatgggtccaccttcaagatcagtttccaatttgattacgttggctattgtaactcttcccatatgattggtatttggtatcatgggccccttagatatatctatatgagtgccagctctgaataatgtaacttttccgccattgtgttcagctatactaggtatttgttttgttttgtggggattatttttgaaaatgtcaaatgctatatcttttgatacatccaaacattctagtggaagttcttgttgacacatttttatcatttctattgataaaacttttagttctgatgttgtgggtttccagtcttctaattccaattgaatatcatatacaaaactacctgattttacattaggactcggaaaactatgtaggcacaacctaacattatctttaaaagcttgtgaagctactgctcccatgagaaagctacaagttctccaaaaagttttattaacaaatgttggattgggagagtgatagtgaacaagttctaatttacaggctccttggtaactttttatgtagatggccaagaagttctccatttactaagcctagtactgacttattgcgaacagtatcacccatatgttttgcacaatcaaaaggtggggatacatttttgttcaaaaggaaaatttcttttttggtgcaccaacataatttatttccattttttctatccgcccaaagcttccctttgtcgggatggttcctggaaaaaatacaatttggtgccttggatcaccaaaaaaaacccccttaaaaagacggaaaacgggcccctgccatcccttactaaaatnnnnnnnnnnnnnnnnnnnnnnnnnnnnnnnnnnnnnnnnnnnnnnnnnnnnnnnnnnnnnnnnnnnnnnnngnnnnnnnnnnnnnncttttgccctggaaccctt

SEQ ID NO: 11272 - DNA, 514 bp, Diabrotica virgifera
  misc_feature (2)..(326): n is a, c, g, or t
  misc_feature (338)..(338): n is a, c, g, or t
  misc_feature (343)..(363): n is a, c, g, or t
  misc_feature (365)..(513): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttnaattnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11273 - DNA, 918 bp, Diabrotica virgifera
  misc_feature (490)..(508): n is a, c, g, or t
  misc_feature (863)..(886): n is a, c, g, or t
catacataccacagcgaagcgtttcctgaacctcgatgtgcgaggtttgtgtttaatttatcctttggcgctgtagaagtttattacacgcatgcattaagaaaagtacctccaattaagattaagaatttaagcaagttttaagaatttaggcaagttatctccacagcactaaagaaattaagaaaaataaagtcagagtgtttgtctcaattgtatcaagtttagaagagcgaggataatggatctcgtcatgtccttttatacccactcaagactgtacaaaaagacaagcactctagacaatcaattcaagacaagtactcatcttaacgcagtcaagaagtttgtttgtagatataagtacattttttttgttaagtttccattctaaatggtgggccagttttgtcaagtttagaaacaagatttgggcaagaggttcgtaagagggaagaatagaagaaagcaactaatacagtttgtagcnnnnnnnnnnnnnnnnnnngaagataacttgaaaacggagactaaactttaatggaagaactatcaagtttattatcattaacaccttttattctcggtaacaagtatgtaaaagcaaatattatttatggagtagaaaaaataatgtttgttccacttctgtcaagaagacagaatgaaattcaagctggttaaattaaataaaagattctcttgtctaatgaattgcattgaagatatcttcacctgattgtcacatgcctgtcgaaaatatctagctatatcagaataataaggactttcataaattacgaaaaattaacgaagcaaagaaaactgtttgaaaaatcattaagaaacattcggaaagggcnnnnnnnnnnnnnnnnnnnnnnnnacataaaatctaaaagatatataaatattaca

SEQ ID NO: 11274 - DNA, 426 bp, Diabrotica virgifera
  misc_feature (2)..(218): n is a, c, g, or t
  misc_feature (220)..(374): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccttaaggataacagcgtaattttattggagaggtcaaatcgataataaag

SEQ ID NO: 11275 - DNA, 198 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (168)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccgttgtgagccaggttggtttctatcnnnnnnnnnnnnnnnnnnnnnnnnngaaaag

SEQ ID NO: 11276 - DNA, 1240 bp, Diabrotica virgifera
  misc_feature (639)..(658): n is a, c, g, or t
  misc_feature (753)..(799): n is a, c, g, or t
  misc_feature (872)..(913): n is a, c, g, or t
  misc_feature (1034)..(1053): n is a, c, g, or t
  misc_feature (1113)..(1136): n is a, c, g, or t
  misc_feature (1178)..(1199): n is a, c, g, or t
attattatctcgatcgcgagagaacattctacctacataacacataaattttttttccgtacctcgcgtatcacgcattattaatcaataactatacattcatcattgtctactctacaagaccctgaaaaattacgatctctattgttcacatacatcacttttccacactttttttgtaatgtaatgtcctccccctctacagatatcccattttttaagaaatccattatctttatcctattaaccctatatctatcactacccactcccctattattaacatctacccattttcccggatgccgctctaatcccccgccctcattcaccacctcaccccccaccacaactgtccgattacaaattttcatatttcactctatgctattatcttatttctatacactgctatctcttcgttcttatcaacctcttccttcccatctacccaccccctctctatacatccacatgctgacactacccccacccccaccaccgcctcatcccacccactcactcccagaccccgtacccccccctccccatcccctccctccccctcatcggcactcccaccatcttctccttactccccgcttatctccccaccccgccctctttgcttcaaacttnnnnnnnnnnnnnnnnnnnnaccgtccccctttcgaacccccccccgcctcccctcccccgtccccaccccccctccttcttcctctaccttccttccttgctccccccctcctnnnnnnnnnnnnnnnnnnnnnnnnnnnnnnnnnnnnnnnnnnnnnnntcaccctcccccccccacctctccccccccccaactctccctccctccctccccccccctctcccccccccannnnnnnnnnnnnnnnnnnnnnnnnnnnnnnnnnnnnnnnnntctctccaccccccctttccaccccccccccccctagacaaaacgccttcccgcccctccacccctctcccctccccgtcctcgctcccccccctcatcttgtctccctccctctcccctnnnnnnnnnnnnnnnnnnnnacaccccccccaccccttccctccccctcctcccctctcccgcttccgctctcctaccannnnnnnnnnnnnnnnnnnnnnnnccaccttctcccctcctccctcccctccacccccaccccctnnnnnnnnnnnnnnnnnnnnnntcccaccacccctccctcccgccctcgcctcccccctccct

SEQ ID NO: 11277 - DNA, 226 bp, Diabrotica virgifera
acccttcgtccggtttaacgcacacgctgcccggagattgggcatggaccgctgatcggccagcagcctcctctgcaattttgggatcctgactgcgaataatgaaagggctgaaagtgcgaattttgtgatgaagtttggtgtgtggggatgcaatagtgatagacaagttgttggcttatccatcggtctcgaagaagaacaatatctctggatatatacagat

SEQ ID NO: 11278 - DNA, 266 bp, Diabrotica virgifera
  misc_feature (11)..(90): n is a, c, g, or t
  misc_feature (104)..(198): n is a, c, g, or t
  misc_feature (202)..(265): n is a, c, g, or t
gatgaaggggnnnnnnnnnnnnnnnnnnnnnnnnnnnnnnnnnnnnnnnnnnnnnnnnnnnnnnnnnnnnnnnnnnnnnnnnnnnnnnnngagaaaaccccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnnnnnnnnnnnnnnnnnnnnnnnnnnnnnnnnnnnnnnnnnnnc

SEQ ID NO: 11279 - DNA, 79 bp, Diabrotica virgifera
  misc_feature (3)..(76): n is a, c, g, or t
ggnnnnnnnnnnnnnnnnnnnnnnnnnnnnnnnnnnnnnnnnnnnnnnnnnnnnnnnnnnnnnnnnnnnnnnnnnngat

SEQ ID NO: 11280 - DNA, 246 bp, Diabrotica virgifera
  misc_feature (141)..(161): n is a, c, g, or t
  misc_feature (182)..(204): n is a, c, g, or t
atttacctacatatttgtttaagatgttgttttattgtaggaagtgtcacgcttctgtcaagggtattaagtaatatgaacctgttataaaatattatcttaaataatctttactcatgtgcctgttacttatatgaagcnnnnnnnnnnnnnnnnnnnnncaacttgtcaatttaatttcnnnnnnnnnnnnnnnnnnnnnnnatctgtttgcattttgttatctaatataaacatatccttctt

SEQ ID NO: 11281 - DNA, 178 bp, Diabrotica virgifera
tgatttattagattatatcaaacaaactggttctatgctaactacatatcacacctcctctaacagtcgttctttttcaatactatcatcctgcacaggcttaggaggattatgaacaggattttgcgaatataagtacgtagcacccataacagtagcaatacttaatactgtattt

SEQ ID NO: 11282 - DNA, 735 bp, Diabrotica virgifera
  misc_feature (2)..(15): n is a, c, g, or t
  misc_feature (20)..(533): n is a, c, g, or t
  misc_feature (540)..(577): n is a, c, g, or t
  misc_feature (597)..(610): n is a, c, g, or t
  misc_feature (613)..(635): n is a, c, g, or t
  misc_feature (643)..(665): n is a, c, g, or t
  misc_feature (695)..(726): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggtggttnnnnnnnnnnnnnnnnnnnnnnnnnnnnnnnngaaagggac

SEQ ID NO: 11283 - DNA, 172 bp, Diabrotica virgifera
  misc_feature (2)..(164): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 11284 - DNA, 177 bp, Diabrotica virgifera
  misc_feature (10)..(174): n is a, c, g, or t
gttggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggg

SEQ ID NO: 11285 - DNA, 1106 bp, Diabrotica virgifera
  misc_feature (559)..(577): n is a, c, g, or t
  misc_feature (867)..(902): n is a, c, g, or t
  misc_feature (1052)..(1087): n is a, c, g, or t
  misc_feature (1090)..(1090): n is a, c, g, or t
gttcaagttcaattcaactcaactaaaattcggtgatcatgatgtgttgtaggttgtagttgtattggaaacatcgtctgcggtaaacattaggtttgaaaatccctctcaaaaacttgaaggctacacccaagcagaattttaagagaattagacaatagatataagtacagacactgatcgctgaggggcaagacaaaagtgtttcctccagtgttaacgaaggacataacccataaaaagaagaaaatatggtggggttattgtgaccttgtttcatgttaatatggttctgaattgaaaatatattcctagtacaccacttgtacacttggttactctactctggagtataaacacaatactgaaacagataaaatcatgtctgatcacataggagtaaaacaagaatttagtgaagtgtgtaaaaaagaagaagacgatgatgaggtgggtgatgcactacaggatacctttaaaatcgagatcaaggaggagcctaagagggaaagtgccagtgatacatttgattctgcagaccttaacgagtatcctatannnnnnnnnnnnnnnnnnnatggtgtctctcgcgaagacatcaacaatgatgcacgaaacctattaaagtacactggaaataatttggaccaaaagttactgctactacggatgtgaacatcgaagaaaaacattttgaatgtggaatatgctccaaacaattaacaaccaagttattctttttaacagtacatatgggagtggatactggcgaaaaaccattttctgtgaaatttgcgccaaaccatgttcatcaatgttgttctgaaattatttccttgtgggatttttattaactgtcctttgcgnnnnnnnnnnnnnnnnnnnnnnnnnnnnnnnnnnnnattcttggaaatattttgaaccaaaatttccctgcccccccttatggggaaattcgcaaaaaaacaactttgaatggggaatattgctcccaaaaaaattaacaacaaagggtttcttttaaaaaatcccactttgggaaaaaatacccnnnnnnnnnnnnnnnnnnnnnnnnnnnnnnnnnnnncancacaacaccccctttt

SEQ ID NO: 11286 - DNA, 302 bp, Diabrotica virgifera
atattgtgaaaaagaacatttattattgcttatactggattcatgccctctaagttcgcggattagcgaagatactcagtcactaataaatctatttaatatatctatttatgaatttctcggagctatataagcacttttttgattcatccagcgttacccacccattttttgttagcaaactcgtccccactcgtcgtcctttcactcttttgtaaaggacaaagatagcaggcccaaagcactgatgctctcttagcataacttatcactgttattattatattagtatcactggaaca

SEQ ID NO: 11287 - DNA, 222 bp, Diabrotica virgifera; identical to SEQ ID NO: 7599
  misc_feature (6)..(28): n is a, c, g, or t

SEQ ID NO: 11288 - DNA, 256 bp, Diabrotica virgifera
  misc_feature (176)..(243): n is a, c, g, or t
ttccattttttgatataagaataattacctagggatacgcgtaatttttattggagagtccatcgatataagatttgcgcccccgagggggggattaaggtttttaaattggggggcaccattttttattttaacctggttcccttttttaaattttaatggttcgggggttaaannnnnnnnnnnnnnnnnnnnnnnnnnnnnnnnnnnnnnnnnnnnnnnnnnnnnnnnnnnnnnnnnnnncacagagggaccc

SEQ ID NO: 11289 - DNA, 237 bp, Diabrotica virgifera
tacattttttgttagaactcctaaagaaaaactcgtaacaagtgagcagatagcatcgtaggcgcataaaactagcttatttcttttgattacctcgcgcatcatgccctattaggcaactacaaagtataaattgttagcatattctcggtgttgaaaaagaaaaacatatatgggcaaatccagatcttcccagaagatttgtagatgaattgccctaccctgcgcccgatacct

SEQ ID NO: 11290 - DNA, 302 bp, Diabrotica virgifera
gatgtctcacagaaagttcagtgcgccacgtcatttatcgatgggattctacccctatagtgtgatctcggaaaggccgtggaaagatagaaggttgcttaaaagaaattttcattccggtagttcgcccgtaaggatgtcatcagcagaacgaaaagcgtaatgaactacacaatcactaggtctcgaagaagaataatatctctgtctatgattggatcgacccacttgaacattacattaggcgcctcagacttagccgctaactgatcttgtaccttgttctcttacccctataacta

SEQ ID NO: 11291 - DNA, 864 bp, Diabrotica virgifera
  misc_feature (546)..(564): n is a, c, g, or t
  misc_feature (773)..(773): n is a, c, g, or t
gttgaagtgattgttgttggtgagaaagaaattgttgattttcattatataggactaatattatagttccttttaagtgacctcatgtgacacataataaattaatattcgatacattatattataaacaatgttggtacctttgctattacttctcggcatagtagcatatctttacaaaaaatggagttattcctactggaaacgaagaaatctttactacatagaaccggaatctttctacggtaatataaaagacctaatggtgggaaaagcaagtttgacggatcagtacaaatcactctatgatgagtttaaatccaaaggcttaagacacggaggattttatgaaatgttcgcgcctgcgtatatgccagtagatatcgaaattacaaaaagtatcatacagaaggactttgcaaatttcagaaatcatggagagtatactaacgaaaaagtggaccctcttagtggacatttgctgtttttgacggatgataagtggaaaaatcttcgagccaaactaacacccacatttacgtcagnnnnnnnnnnnnnnnnnnntcccacaatggtatcctgttcaagtggcttaaaggacctccttaaagaatcagctgacctccaagatgccgtcgatatcaaagaaataatctccagattcaccaccgatgtcatcggatcggctgcctttggcctcgactgcaacagtttgaagaatcccaactctgaattcagagagttcgggtaaggaaagttttcaaaggaagcanatggcgcagaatcaagcgcactttgctcacacttgccccggtaagtttggtcactttctttcgtataaaacgaacaccaaaggaaaattga

SEQ ID NO: 11292 - DNA, 151 bp, Diabrotica virgifera
attgcaattaccagaaagaaacataattaggtacatcgatttaatatttatttctggtaattgcaatatcactatgttatttccgtttttccatttttggcgggatgtatgtaacattaataattgtatttttcaataaaatccaatatag

SEQ ID NO: 11293 - DNA, 238 bp, Diabrotica virgifera
  misc_feature (2)..(132): n is a, c, g, or t
  misc_feature (134)..(193): n is a, c, g, or t
  misc_feature (199)..(212): n is a, c, g, or t
  misc_feature (214)..(226): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnncaaatnnnnnnnnnnnnnncnnnnnnnnnnnnnctatttttaagt

SEQ ID NO: 11294 - DNA, 144 bp, Diabrotica virgifera
  misc_feature (69)..(69): n is a, c, g, or t
cactggcagaagtgcttaatgaccacccgtgagcattttgaaaatggtcctgggattgctctggtcatnaagaaccgattttgcaaagaaagtcgtttttaaagaacggtcttctctggtcgtcctgattcttctcgcgcctga

SEQ ID NO: 11295 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11296 - DNA, 121 bp, Diabrotica virgifera
  misc_feature (2)..(24): n is a, c, g, or t
  misc_feature (32)..(54): n is a, c, g, or t
  misc_feature (84)..(115): n is a, c, g, or t
gnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11297 - DNA, 846 bp, Diabrotica virgifera
  misc_feature (2)..(44): n is a, c, g, or t
  misc_feature (53)..(753): n is a, c, g, or t
  misc_feature (758)..(831): n is a, c, g, or t
cnnnnnnnnnnnnnnnnnnnnnnnnnnnnnnnnnnnnnnnnnnncgtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnngggggggattaaaaa

SEQ ID NO: 11298 - DNA, 309 bp, Diabrotica virgifera
  misc_feature (203)..(219): n is a, c, g, or t
aatacgtatataggtaatgtatattttagtatacatattttattagttaatatgtttcaactatacaattatgtaaacatattaactaataaaatacgtatataggtaatgtatattattagttaatatgtttacataattgtatagttgaaacataaacgtaaatagagaatcatttttctgtaacaaattataattgttgnnnnnnnnnnnnnnnnnatacctgaaggaacagttttacgtatgtacttctatttatctgttcttttatattaacttttaattgttgaatatatttaatgttttcct

SEQ ID NO: 11299 - DNA, 615 bp, Diabrotica virgifera
  misc_feature (22)..(416): n is a, c, g, or t
  misc_feature (423)..(460): n is a, c, g, or t
  misc_feature (480)..(493): n is a, c, g, or t
  misc_feature (496)..(518): n is a, c, g, or t
  misc_feature (526)..(548): n is a, c, g, or t
  misc_feature (578)..(609): n is a, c, g, or t
catgtttttaataaacaggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11300 - DNA, 723 bp, Diabrotica virgifera
  misc_feature (14)..(45): n is a, c, g, or t
  misc_feature (68)..(68): n is a, c, g, or t
  misc_feature (85)..(85): n is a, c, g, or t
  misc_feature (91)..(144): n is a, c, g, or t
  misc_feature (146)..(423): n is a, c, g, or t
  misc_feature (425)..(505): n is a, c, g, or t
  misc_feature (507)..(533): n is a, c, g, or t
  misc_feature (541)..(563): n is a, c, g, or t
  misc_feature (565)..(588): n is a, c, g, or t
  misc_feature (606)..(625): n is a, c, g, or t
  misc_feature (627)..(639): n is a, c, g, or t
  misc_feature (641)..(653): n is a, c, g, or t
  misc_feature (656)..(679): n is a, c, g, or t
ccttcccaggccgnnnnnnnnnnnnnnnnnnnnnnnnnnnnnnnncatagaaaagaaaaagtgaattnaaggagagataatgagnattgannnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnncaatgatnnnnnnnnnnnnnnnnnnnnnnnannnnnnnnnnnnnnnnnnnnnnnnattactaaaggaattcgnnnnnnnnnnnnnnnnnnnngnnnnnnnnnnnnnannnnnnnnnnnnnacnnnnnnnnnnnnnnnnnnnnnnnncactttgaatggtcgcgatattttgaccgcgctaaggcagcata

SEQ ID NO: 11301 - DNA, 839 bp, Diabrotica virgifera
  misc_feature (27)..(46): n is a, c, g, or t
gacgccaaaaaaaaaaaggtatgttannnnnnnnnnnnnnnnnnnnaagaagagggggtgtaatgataggctgacgctccgtccaaacatcgacactcggaaccgtgcgattctctcaaatcgcgcaggtgcccccactaagttccacctctccgaaccaacgccgccagagggatatttaagagcatcgtaagcgacgatccggcagtcctgaacgaccgttctgggctccataaccagccaagcgaagtgagcgaggccggccaacctgaatcgcgacgtgcaccgttcgtgaggtgattcgtaaactcaggcaggccaactcgagacgagacgcacggtgtaccgaagtgaggtaatgtgcgactcgtaattcaacggaggcaagcgtattgagcgagccccgatagatataatatatttgaatacctctgttaattttggttcttctgttacagacgcccatccggaggaagacttcgctggaacgggataaaatatcaaattattattttgcgttatattgttataatttagagttaataaatttgctttgttttcaacctgtgttttactgagtctgtcgtcctgaaagaactacccgttacaagatataattaaaaaaagatacttttcgtgcttttgcattagcaaaatcttgaaataatattagaaaatgatcttccactatgcgctactgtcactggcaatgtgaggtaaattctaagagcaatgaacaagtttgggaacaccgaatgtaatttatttgtatacagtatacaagtaatttaaaatgaagctggaccttgaatactgcatcaatgaaaaacagaatcatt

SEQ ID NO: 11302 - DNA, 307 bp, Diabrotica virgifera
  misc_feature (7)..(84): n is a, c, g, or t
  misc_feature (207)..(224): n is a, c, g, or t
  misc_feature (251)..(294): n is a, c, g, or t
ggggtgnnnnnnnnnnnnnnnnnnnnnnnnnnnnnnnnnnnnnnnnnnnnnnnnnnnnnnnnnnnnnnnnnnnnnnnnnnnnnntaaattaccttagggatacagcgtaatttttttggagagttcaaatcgataaaaagatggggaccccgaggtgggataaaggttttaattgggggagaaggttattttttaaagttggttcgnnnnnnnnnnnnnnnnnnattcggggtttaacggggggggagccnnnnnnnnnnnnnnnnnnnnnnnnnnnnnnnnnnnnnnnnnnnncaaaaggggccca

SEQ ID NO: 11303 - DNA, 928 bp, Diabrotica virgifera
  misc_feature (39)..(59): n is a, c, g, or t
  misc_feature (884)..(884): n is a, c, g, or t
ggtttacattattacatttagctataaaataaaacatgnnnnnnnnnnnnnnnnnnnnncaatcaggtaattcaaaccactataacgtagaagatgaaatggacaattatgaagaacccaaacagtggtatgaagagatacaagaagatccgaaaagcttttctaaaagtactgaacaagttctgatagagctcaaagatgaagctaaaaaatgtcacgattccgaggtgttacattataatacgaaaaactccaagaccaattctgattttcaatggatgaaaacagtgatgtctaagggtacactatcagacaaaatagctgctcatacagtaatgatacaggacaatccagttgcttgcttggatactataagaaatcttgttggcatggtaaaagttggaaagaaaaaagaatgtacaactgttatggaaacattaactgaattattcctgtctaaccttttaatacctaatagaaaacttaaagctttccaccaaagaccactttcagctctaaatgaactctcatcaggcaatgcagttagcaggagaaaaatcttaagttattggtattttgaagatcaactgaaagaaatatatgccacttttgttgtggcattgaatgctgtagctcatgatactgtggacagtaataaggacaaagcagttacagctttgtataagttgttagtggacaattcagagcaagagaagaatcttctaacctacattataaacaaacttggtgacccatctcagaagatcgcatccaaagtgatttattgtctgacacagttattatacaaacatgtgaacatgcaactagtagttttgaatgaatcgaaaagctggtattcaggcccaacatctctaccagagcancatactacagtttgtgcttttttgtccccagtttcatttaagtc

SEQ ID NO: 11304 - DNA, 281 bp, Diabrotica virgifera
  misc_feature (2)..(55): n is a, c, g, or t
  misc_feature (238)..(268): n is a, c, g, or t
gnnnnnnnnnnnnnnnnnnnnnnnnnnnnnnnnnnnnnnnnnnnnnnnnnnnnnntcccatttttttgatattagaataaataccttagggtaacagcggattttttggggaagtcatccaaataagatgcggcccccaggtgggaaaggttataattggggagcgcctattttaaattcggtcgcctttaaattttacggactgggtgtaaccgcggggggggcgcgggggggcttnnnnnnnnnnnnnnnnnnnnnnnnnnnnnnnggggccccccgcc

SEQ ID NO: 11305 - DNA, 221 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (154)..(154): n is a, c, g, or t
  misc_feature (169)..(191): n is a, c, g, or t
  misc_feature (209)..(209): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtggagcccagngtggtttctatcttnnnnnnnnnnnnnnnnnnnnnnngaaaggacaatatataanataatttttata

SEQ ID NO: 11306 - DNA, 433 bp, Diabrotica virgifera
  misc_feature (14)..(14): n is a, c, g, or t
  misc_feature (29)..(29): n is a, c, g, or t
  misc_feature (37)..(37): n is a, c, g, or t
  misc_feature (121)..(178): n is a, c, g, or t
ctctccactgccgntcatttcttttcttnaaaaaagntaataattctccataagtacttatatcaatatcttctctaatgttaataaccgatttcagcattgagtaatgtgcccagagagnnnnnnnnnnnnnnnnnnnnnnnnnnnnnnnnnnnnnnnnnnnnnnnnnnnnnnnnnnaggttgtctcacattttttaagcggcaccactttttaaaagcatcgcactgctgctcgtatagttttctagatttcggtggtaacaattcttcacctacttcggctgctcttttatcaatatcagatacaccttcttcactcatgataccaataattatcaataacaatgtttctttactacgacactagtaatgacaacgactctaaattataactgtcacaacgcaatgtcactatggaaacttattttaaat

SEQ ID NO: 11307 - DNA, 218 bp, Diabrotica virgifera; identical to SEQ ID NO: 7300
  misc_feature (6)..(28): n is a, c, g, or t

SEQ ID NO: 11308 - DNA, 606 bp, Diabrotica virgifera
ccccttcccacggcgtccgcctgacttcgagatagtctccgacttacaactctctaggaaagtaagcacccaaggaatattcggttttagaccacaacgtatgaaaacgacaaatataaaaccactttctctgtctcctagaatcaaaactagatcatttcgattgacctcctataactacaatcttagcattgactcaaatcgcatcatataatgaagaaaaccaagagaatgtattctcctgtcacgcaaaggcttagcttttattgaacatactgcacctcaataaccaatatgatgctccacaaagggttgtggtgcagccataccaaaccatgcacattgtgattgaacacaatactggatcaaagatttactcaaggtgagcaacaacaatctacataccagcaggtatcattttcagctcgaatggtgatcgttattgaccacgtttaagatcacattcataaacttgtagactcttacgaaaccattcctgatatagctttgctgaataattattctttattaccaatagctgatatcgctgttttcagacacaatgatgaatcacacaataatgatccagtgaggtgcctgtgacta

SEQ ID NO: 11309 - DNA, 952 bp, Diabrotica virgifera
  misc_feature (824)..(824): n is a, c, g, or t
  misc_feature (908)..(908): n is a, c, g, or t
gtaaaattatgaatgctagccttaaaatagagttagaagactttgaatttatgtcaacagtatcctaagtgttaagacaataaaatatacactgcgacaataataatattacgcattgtaagtattgtggtaaacaatagaaaacacaataattcatctgtgtataagtcattaaatatcatgttaaaataagtgttttggctaattattattaattgcttgtataaaactaatgaccaaagaactcaacatatatatttagataaaaactacagagtcgaaatatatatcacaaaataagccatatcaaaatagtcatcccttaaaacacaaaatagaagtcataaccaccaaccagttaaattaatatttacgttcttttgtgctatattgtggctgttgttaaatgacgatatgaatttatcgttacaaatatttttcaatattgaaatgtgttcttatagttcaacgtgttccagagaaaatgtatgttagagattaattttcaaagattgttagacaaaaacgtcaatatactaatatttctctttaatgttaaataaaaaaatcctgatatagatgttcaattatcactaataacgagtgtaagaagcggtataattcagcagtgatcatttttgttccatcgatctttcgacgcctcccatggagtcatcttaagaaaatggttttgcactagggaattaagttgctgatgcctcaatccatatcattaccactcgtcagataatcgtattcatgaaatgatgtcatcaagtggttgttcatttccattgtatttttataggagacattgatacagntggtttgtactaaataaatatataaagctgttaattttctcgttttctgtagatcgcatccagttttattcttcccctgtaganttttcataatttgtctacaaacatctaatgctacaaagacttct

SEQ ID NO: 11310 - DNA, 114 bp, Diabrotica virgifera
  misc_feature (2)..(100): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagagtttataaa

SEQ ID NO: 11311 - DNA, 746 bp, Diabrotica virgifera
  misc_feature (2)..(547): n is a, c, g, or t
  misc_feature (554)..(591): n is a, c, g, or t
  misc_feature (611)..(624): n is a, c, g, or t
  misc_feature (627)..(649): n is a, c, g, or t
  misc_feature (657)..(679): n is a, c, g, or t
  misc_feature (709)..(740): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11312 - DNA, 922 bp, Diabrotica virgifera
  misc_feature (685)..(702): n is a, c, g, or t
  misc_feature (814)..(814): n is a, c, g, or t
  misc_feature (883)..(884): n is a, c, g, or t
  misc_feature (893)..(893): n is a, c, g, or t
gacgaagaaagcaaaatggaaaagtatctaacaacaacctcttctcttggcagccgcttacgccaggaacgtaggatgcttatcgaggatgaagaaaatttatctagctttttaaagaaactgtcacaatgtcttacaatatctgacatttgcagtgaaattaataatgcaggaataactaacaaattttcaataggaactttagaaacactcaaatcacctaatgcagatatagaagaggcaagaagtttagtacaagagaagtgccagaatataattactaacagagcagcaatatcattgttattagatgatagtaaatttgatagcaatattaaagaatttattgataggtttcgtattataacggattatccgaatgttgatgagttgaatatatttttaagtaaggagctgggagtaacattccaactgttaaattctgatttagtgacacatttgtttcaaaaggaaatgcttgatttttttaagcaatactttaaaggacgcagtgactttcttggtaaaaataaagttaaaaagttttttatctcattaaatgaaaaaattcatactctgatgacatctggcctaaataaagcttatcccgaaaaattaaaagcgctagacataactttactacacgatcttgtttgtgtcaatgaatttttaaaatctaacaaannnnnnnnnnnnnnnnnnacagactcatcgcgattggcctccattcatttacttcagaccttagagaactctaataattttagagcgcatgacagttttgtatttttaagactcaggacatttcttctgnaagatatagaaaagcttgtcataaattctttcaggtctgagaaaagtcatcattttgtaattattgaanntacagatanactgctggtcgacaacaccgtatggacac

SEQ ID NO: 11313 - DNA, 919 bp, Diabrotica virgifera
  misc_feature (213)..(231): n is a, c, g, or t
  misc_feature (252)..(275): n is a, c, g, or t
  misc_feature (529)..(546): n is a, c, g, or t
cccacgcgtccgcgattcatctctggaagataattaaacgtaccagttttcgtttttctaaatagtttttttaacacacgtgtcttcaagatatgtgattttcacccacatctcttcgtgggtcaagcatcgtcattaacctatgaaaagcactgatgatggaatttattccgaaaacgttctgtgttttttaatttacctttaataaaggannnnnnnnnnnnnnnnnnnttaaatctctataatctgtannnnnnnnnnnnnnnnnnnnnnnnggcctgggccaaactgatttatcctgatattaatacggacgctgcaggataaactagtaaggcctttataatatacctacaaaacgaaaataaatatgtagatgaactgaatgaaatgctccgtaattggaaaataatcatttttattaaaagttaatgactcgttaatatttatggacagttggcggtagaaacaatcatgttatagaaggtagtcggtgtttttataaaagcaataattatacctcaattgnnnnnnnnnnnnnnnnnnccatggagtattttggtgacacttataattgcggattatcattggtttcttgctcttgcatctgtttgtggaagtggaacagtttttgttgcagctgaatttgacaaaaacttgtcctaatcaaactgaacctctcgtagctgcaacctttaacggtatttcagagccttgctttaaatctactacctctaaaaaagtttgatgacaaatgtcgaattctgatctgaaagagacagggacattcgtacgccaaaaagttagatcggacaagggtgtgtcaaatgcagctggaacaaagattatttgcacaatagatgcaagtgcaagaaagaaatgaaactctgcaatttctagggtgtacaaacactcaatg

SEQ ID NO: 11314 - DNA, 150 bp, Diabrotica virgifera
  misc_feature (7)..(25): n is a, c, g, or t
  misc_feature (76)..(99): n is a, c, g, or t
taaaagnnnnnnnnnnnnnnnnnnncgagaaaatcccatacagttttctgaatttttttttaaagtgttactatgnnnnnnnnnnnnnnnnnnnnnnnncactttcttaaaattgggggtgaataaaaaaaatcaactcaaacttttttt

SEQ ID NO: 11315 - DNA, 521 bp, Diabrotica virgifera
  misc_feature (288)..(302): n is a, c, g, or t
tgggcctacggatgagacaatagaaatggagagggggagaggagaactaatgaaacagaagcgagcagaaattgtgtaagaatagggaggaagtggattttaaatcagaaggaattaattagtgaactgtgccctgtttgataagaggaagcaaggacgattaccaaaacacagatatgagagataaagttctggatctgaagagcaatctagacaggagattgagatatcaccttccaccttacagaaaggataggaggaatcccaccagtactgttaaatgaaaannnnnnnnnnnnnnngaaacaaatgattacctaaagaccttaaaaacgcacagtgcaggtgttatatttgaataatactgatgctgaattagagtgatcaggaaaagaagatgatgaagacatgaaagggctaattaatatcatgtactagaagagggtagaaagaatagattataagatgagttaacctaatagattgccaaaaaagaagatcgaagaaatagaggatgaagg

SEQ ID NO: 11316 - DNA, 712 bp, Diabrotica virgifera
  misc_feature (213)..(286): n is a, c, g, or t
  misc_feature (291)..(356): n is a, c, g, or t
  misc_feature (374)..(393): n is a, c, g, or t
  misc_feature (401)..(415): n is a, c, g, or t
  misc_feature (417)..(433): n is a, c, g, or t
  misc_feature (436)..(454): n is a, c, g, or t
  misc_feature (469)..(489): n is a, c, g, or t
  misc_feature (627)..(642): n is a, c, g, or t
  misc_feature (644)..(663): n is a, c, g, or t
cggacgcgtggaaatgtaaagataaaaacgaacctggtctcacaccggcgttaaactcagatcatgtaaaattttaaaagtcaaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnntttttaannnnnnnnnnnnnnncnnnnnnnnnnnnnnnnngannnnnnnnnnnnnnnnnnncccttcattccagcnnnnnnnnnnnnnnnnnnnnnttatgctaccttaacacggtcaaaataccgcgaccattcaaattaatcagagaccaggcgagactttatatttaatacaaaaagacatgtttttaacaaacatgtgaaaaaaatgttgcctaattcctctattaaacnnnnnnnnnnnnnnnncnnnnnnnnnnnnnnnnnnnnaatatgatcatcaatactatattgaaataatttacgtatatatgttaat

SEQ ID NO: 11317 - DNA, 850 bp, Diabrotica virgifera
accttactaccgatcgcggggtaaacggttagcttgcgtgaattgccttttctgtctcaaactggtcggtaatttgtgaaactgtatatgaaattattgttagcgtaaaaaatgtggccgaaataaatcatttagaaaacgccgcgattctcacgttggtatgatttggtgcattttgtcagatcatagcgcagatgatgacaccagaaacaccttcaagttcagggagtgatacttcaaaacccggctgcagatctgaagagcgattaatggtagcagtgagaattcgtccattaaaacaagatgaatcaacaagagctttgtacgcactcaacaagaagacaattatattggaagatgcagacaaatcagatgcaattcggcaaaaaaaaggtatggaaaaacaatactcgtttgatgttgtgtttggagaggattcgacacaagaagaagtatacaaagttactacgaaaaatctcataaccgacgttcttaacggatataatggaactgtatttgcatatggacccacaggagcaggcaaaactcatactatggtgggcacaagatcggctccaggaatcatgatcagagctcttaacgatctctttgaggcagtcaaagataaggaggacgagtattcggtcactatgtcataccttgaaatttacaatgaacaaattagagatttacttaatccatcatcaggatttttagaattacgggaagattctaaaggaaagagtatgcaggtagctggattatctgaagtttcaacaaatagtactgacgaaatcatgcaattgcttcacaagggtaacaagcaagaacgatagagcccactgctatg

SEQ ID NO: 11318 - DNA, 463 bp, Diabrotica virgifera
acccctgcaggcaccggcccggaatccccggctctttcacgcgcccggatataataccaaattgtgtagaaaagcaacacagtattaaacaatgctatcgactacacattgttgatacattgagaatatttcttcatcattgaagtattatatcctctcgattcgctataccgtattctgaatatctattcgaatatccatcctcttccagtgtataaaagttaaacgcttacaaatgtactattgaaatgcaacgtctatctaatattcggaaagagcttgatgtcattgatctttctaaatttctatctggttctactcatctcataaatgaatcattatctaaattttttccttatatatacacttgctattcaaccgttataaaattttcatttccgtccagaaacttcgcctctcatctaaatttattatattaggacggttcctcaataagaactat

SEQ ID NO: 11319 - DNA, 426 bp, Diabrotica virgifera
  misc_feature (3)..(20): n is a, c, g, or t
  misc_feature (76)..(94): n is a, c, g, or t
  misc_feature (369)..(419): n is a, c, g, or t
ccnnnnnnnnnnnnnnnnnntttatatagttatgtaagtatgaactttattttagagattggggcctatcgtacgnnnnnnnnnnnnnnnnnnngagatagaaaccaacctgtatcacgccggattaagctcagatgatggaaaattttaataagacgaactcacttaattatatatctgctactccatttataaatgtttaatccaacatcgaggtcgcaatatttagtatcgatttgagctctccaataatgattacgctgttatccctaaggtaatctattcttataatcaaaaatgtgagcaaaatgaactattatgtattatactaatatagaaaaaacaaaatgtattcattaacctccccannnnnnnnnnnnnnnnnnnnnnnnnnnnnnnnnnnnnnnnnnnnnnnnnnngggagat

SEQ ID NO: 11320 - DNA, 100 bp, Diabrotica virgifera
  misc_feature (6)..(96): n is a, c, g, or t
ttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtg

SEQ ID NO: 11321 - DNA, 229 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (156)..(156): n is a, c, g, or t
  misc_feature (179)..(179): n is a, c, g, or t
  misc_feature (204)..(228): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggntggtttctatctttaatttattnaatatatttagtacgaaaggaccannnnnnnnnnnnnnnnnnnnnnnnnt

SEQ ID NO: 11322 - DNA, 603 bp, Diabrotica virgifera
  misc_feature (206)..(223): n is a, c, g, or t
  misc_feature (255)..(272): n is a, c, g, or t
ctttcccgccgccggagattttgaggcgcttacatggttattccccgaggattgagaaccgataggaaacatgtgaatcaccgcacgtgaacgaagatggtatgataaaaattacagaaaggcacatttatgaactactatggaaggataatccttttggaggtgattctcatgatgaaggaattgtattgcaaaaagaggtagtnnnnnnnnnnnnnnnnnnctctgctattctcaagagcgttagggttcagnnnnnnnnnnnnnnnnnnaaaatcacatacctgcgtacctaaagatagttgattataccatatacaataaaacaatgaaatgctagatgcaagatttttacgaaaaggacatgctgtaggagatcttgccagagatatatataaagtaagttaagggcactagagcgcccctattagctttatacaaatacaagaaggaaacgccataatcattgttaaaatgccatgtttcttatttatgtgcatgtaacttatattggttaaataaagtggtaagcatataattttggacggagggttatttcaataaacaattttatacctgtaaaaaaaataaaaaagggatgaa

SEQ ID NO: 11323 - DNA, 629 bp, Diabrotica virgifera
ctgacgtgtgtgtgggtcctggacctctttgtgatcaactggaatgtttgaaagtctgcttatccatgcctgataaacaacatcatgactgcaaataatgagaacatcaataaatcctctgtacacctcccaccgctaccgccatagacgatgatttatggaatgttcctgaattcatcaatgagactgattttaaaagatattcatctcagaggccttcttctccagtacatcacggactgacatgtacttcgtagccgaggacgattcaaacttatatacactccagaaataacaagttaccctccagaatactccatactgacttagagatgattgtgacaaaacaggacttagctacgccacaacagtcggactcttatcaatatcagatacatccgtgaaggtatttagagaaaatcacaacgtctagtgtctgccggttagaacactttaccatgatagcatgctctaaaagaccgtcacaattgcaatcgacctaacttcactacttaccaacacagacatcctccatccaacctctgctggcactcaacttaagatgagtacgattacagaataaatgtagatataatgatcatctcccacttccatccgtctcggaccct

SEQ ID NO: 11324 - DNA, 636 bp, Diabrotica virgifera
atacttctcgaaagataaagattatcttcttctataggggttctgttcgctagtaccatatattcttaaatcaacgatgtaaaacagcccgactcacaccggatcaaactcctaacctgcaaaaactaaataaacaaccaaacaaaataatataactgctacacactctataaccctctacatccaacagtccacgacgcaatcttgattaccaattggatctctccatcaccattacgatggtatacctaagaaatattatgcacatcatctacatcattaactcgaaaaaatattactccctaaagtatgatatgaatggtattatctatctttatgacgccccaaatacaaagacctattatataaacatgaataagactaaactgacttatcaaaaagatgatttacctccatagggcctatctcgtattgaacatgaattataaccattatgacttaaaaacccaagacgaccatgaatgactacaaacatgtcatgttcatccactccttacctccagcgatgaccaaaaaagctaatattcatcctacctatagaactgcaaaatacctcgagcattcgaatgtaatctccggtgaagagagactttatattttatacaagatgcaaat

SEQ ID NO: 11325 - DNA, 819 bp, Diabrotica virgifera
  misc_feature (107)..(107): n is a, c, g, or t
cggctctttcccacgacgctcccaggaaatatcggtatatagtaataagaatattcatctacagtaagttgtgcatgatctatacgtatcaatagaaataagtcctnatattagcagcacgcactgaaccataataatatgtaccaaagaaaaggatacgttatttcttggcacgttcaatagcgtagagatacactacctaaaacgcgtaaactgacgtcggaaggagctgaataaagtatctatcgcacggatatatatgtaataataacatcgtcgcttgttattgactaatcaatgtcaactatacactgaccaccgacctagtccacatcccgatatactttactcgctccatagaggagagacgatgccttatttcccatataacaatgcccatatttactacttcagaacatatagctgcattaccaatggaatcgtgaaaccatctgaaccaaatagacaataaaacctctgctgaacaaatagagaaattcttaatctatcgcaccaaatcctgccttatcctgaaaatcctcagatatgaataatctatatggcctatcttaatacctgcaacaatgcacttaatctcctattctatataactgcatgaactcatgtaatactcgatataatagtatcaatcattaattcagtacagtctaattatccataatttgactcatatgacttcaatctattcatattattaaaagatacaactattatatactgacatgttagtaatagatcgatgatactcatgacttccaatcgtactgatgaggtatccaaacacgatgagtctagcta

SEQ ID NO: 11326 - DNA, 880 bp, Diabrotica virgifera
  misc_feature (101)..(118): n is a, c, g, or t
  misc_feature (865)..(879): n is a, c, g, or t
ggcaaccttctggccagatccagttaattgctccgaatatattgagtgctttgctggaaaggcaagtataatggaatgtccaccagatctatggtggaatnnnnnnnnnnnnnnnnnngattataaatcgaatgtcgactgcaaaatcgatccatcagctccaacagaggctccacgtacaagagctacacaggctactcgaccatcagattttacgccagatcctaattgtccttatccctctgacataatcacatacgattacgttcctggtaattgctcagaatattacgaatgtgaccatggactcagatatcttgaaaaatgtccagccaatagattatggaatcatatcaaaaactactgtgatttccctgacgaagttgactgcagtcgtgctccagtagcaacaaccacacctggatcttcgactaccccaagtcaagtttgtgttggccaaaaagacgggaccttgttaccagatgaagatgattgcgccaaatattacgaatgtctacgaggacaggctattgaatttacatgcccagatggtactttatgggatcaagatgaacaagtttgcgactatcctagtagagtcgattgcaaagtaacacctaaaagtttctaaagttgtatttagtacttatcagcactaaatattagaagtcactaactgttcctccaatatttatttgaagcatagttttcttatcgcgggctacggacggagcgatggacacgcagatgtatgataaaataaaagatgaacgactgaaacgactgtaacgacatatttcgcatcaccccacatttcggtgatcagacactacgtggaaggtaaatgcagtcgcatgatgtttcnnnnnnnnnnnnnnng

SEQ ID NO: 11327 - DNA, 929 bp, Diabrotica virgifera
  misc_feature (160)..(179): n is a, c, g, or t
  misc_feature (190)..(681): n is a, c, g, or t
  misc_feature (690)..(803): n is a, c, g, or t
  misc_feature (808)..(921): n is a, c, g, or t
attcttatttatgtaagaataatacagtattttttacacacagataagaacactttatgttatgatagataattatgttgaagacagatgttttatttcttacacagaacaatttattatccttgcacctcgcgtatcaacgattatttagtaataatcnnnnnnnnnnnnnnnnnnnngttacaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgcggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgatt

SEQ ID NO: 11328 - DNA, 624 bp, Diabrotica virgifera
tccatcccccccgcccggggtactcttaaaattacgtgataaaatcgtctataccacgtatgcacataactagtagagcgcttataacctggagacaccagcatattatttgcataaagacgaacctataggaccctatatattatcaatctaggttcttataacttgatccccccacctgaattgctgctactgaccttttcccgcaaatgctcctttcccctattacctaaccctaccatgaatgcttcatctaagactcttctgctgccttcgccgatcaacgttatcgtatatctcactattccaaccagactactctctctcctaaaaatcttttcccggtatttacaccaaacacatatttatccttatacctctctgatactggtattgctatgaccaaaagctatacaaggaactcccctggaccactgctacaaccctaccacatctatattccccaagcctttaacttggaaacaacattaatatgattggtcgctctctggtatgttacaacccttcccacttagttgctccccttctcacggactaatctctttacaacaatcatgacaaatacacatgtaaatcatatacaggatcggacgcacgataaga

SEQ ID NO: 11329 - DNA, 691 bp, Diabrotica virgifera
  misc_feature (2)..(184): n is a, c, g, or t
  misc_feature (189)..(230): n is a, c, g, or t
  misc_feature (240)..(272): n is a, c, g, or t
  misc_feature (274)..(291): n is a, c, g, or t
  misc_feature (293)..(332): n is a, c, g, or t
  misc_feature (343)..(416): n is a, c, g, or t
  misc_feature (418)..(507): n is a, c, g, or t
  misc_feature (524)..(595): n is a, c, g, or t
  misc_feature (597)..(618): n is a, c, g, or t
  misc_feature (646)..(679): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccnnnnnnnnnnnnnnnnnnnnnnnnnnnnnnnnnnnnnnnnnnctacttatcnnnnnnnnnnnnnnnnnnnnnnnnnnnnnnnnncnnnnnnnnnnnnnnnnnncnnnnnnnnnnnnnnnnnnnnnnnnnnnnnnnnnnnnnnnngattaaaaacnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaattccgcaacatcnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncgctaccgtagcataatcattagtctcnnnnnnnnnnnnnnnnnnnnnnnnnnnnnnnnnncaatactgtctt

SEQ ID NO: 11330 - DNA, 906 bp, Diabrotica virgifera
cccacgcgtccgcacaagtcctgaaagcataccacgactccgaagaggccaatcacccaggacgagacgagaccatccgggcgatcaagaggttctattactggccaacactatccaaagatgtccggaactacgttcgaccctgcacgacatgtgcctccataaaacgagcaccaacacaacccacagcaccaatcgtagcaagagagccccgccagccatggaagagggtctcctttgacgtattaggaccatacccagctgcccgagggacacgcaacagatacatcctcctggccacggattgcctaagcagttgggtggagttccgctgtgtccaaacagccaaaagtagacaaatcatctcgttcctccaagacgaaatatgcagccgctgggggaaaccaaccaccatcatcacagacaacgggccccaattccggacggatgcctgggagagattcctgaggagaaacaatattcaagccgaattcagccccatttatcaccaacgagccaacaccatcagccaacgagcaacgacatcatcttcagcctgagaaccaggaggaacgaagccaccaaagaaacaccagcagagttattgctgggataccttcctagacgctcggaagagagcgaaaaggaaatcagagaggccaacaccgcagccagacggcaagcacgagtagaacaagcagtccgaagagccacggtgtacgccaggaacctatatcctgacaacccaaacgaaccaccccccagacgctacatccaaggagagcaagttagagtcagaaaccaccacaaagggaattttgggacctacatggacaggaccacacacaatcctgagggtcctcggcaacaacacctacgaggttcaccgtgaccaggatgtaaatc

SEQ ID NO: 11331 - DNA, 173 bp, Diabrotica virgifera
  misc_feature (3)..(88): n is a, c, g, or t
  misc_feature (90)..(160): n is a, c, g, or t
aannnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnncccaaattttttt

SEQ ID NO: 11332 - DNA, 734 bp, Diabrotica virgifera
gataactataactcttaaaataaaaccactttttatagtaacaagcaaagaaaaattatttccagtgatacctcctatatcctcgcgagagaatatcatatctttatagaaaacaattttcatttacttgtaccttgcctctctagacttattaatgaataattatctattgattattttcgaatgtccaatagctccaaaattattacttttattgtaaaataaccttatattacattgttttgatactgacatgacaatcatgtttaactatattctaaaatcctaaaaactaaaatcaatttatccattaattatatatatcttaatcactatttttacagaatcactccttattcctctattgcaggagcttttaaatatatactacatacaaattaacttattatataagcttatctgatagatataattcttatttggatactgttattactgattataataaattataaaccatctcatacatatatcttatacaaaaatagaaactcatatcaatacaaaattgtagagatgcttcttttaagataattatactgttcatatatgaagaaaatttacgtatattttatgcattcatatccataatattgcacggtgctataaccacttgtgtcctagaataatatataatatatctcctgcacaatgatgactttacaggttcgcggaattctgaccgtgatattagctaccaatcatatcttgtt

SEQ ID NO: 11333 - DNA, 762 bp, Diabrotica virgifera
  misc_feature (13)..(125): n is a, c, g, or t
  misc_feature (132)..(206): n is a, c, g, or t
  misc_feature (208)..(320): n is a, c, g, or t
  misc_feature (325)..(451): n is a, c, g, or t
  misc_feature (460)..(499): n is a, c, g, or t
  misc_feature (501)..(514): n is a, c, g, or t
  misc_feature (516)..(528): n is a, c, g, or t
  misc_feature (537)..(564): n is a, c, g, or t
  misc_feature (575)..(592): n is a, c, g, or t
  misc_feature (600)..(618): n is a, c, g, or t
  misc_feature (620)..(635): n is a, c, g, or t
  misc_feature (637)..(698): n is a, c, g, or t
  misc_feature (714)..(728): n is a, c, g, or t
  misc_feature (730)..(752): n is a, c, g, or t
cattttatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatctccnnnnnnnnnnnnnnnnnnnnnnnnnnnnnnnnnnnnnnnncnnnnnnnnnnnnnncnnnnnnnnnnnnncttaatacnnnnnnnnnnnnnnnnnnnnnnnnnnnncttattaaacnnnnnnnnnnnnnnnnnncatatacnnnnnnnnnnnnnnnnnnncnnnnnnnnnnnnnnnncnnnnnnnnnnnnnnnnnnnnnnnnnnnnnnnnnnnnnnnnnnnnnnnnnnnnnnnnnnnnnncttggatgaaagaacnnnnnnnnnnnnnnncnnnnnnnnnnnnnnnnnnnnnnngttacacagc

SEQ ID NO: 11334 - DNA, 765 bp, Diabrotica virgifera
  misc_feature (51)..(75): n is a, c, g, or t
  misc_feature (79)..(101): n is a, c, g, or t
  misc_feature (121)..(144): n is a, c, g, or t
  misc_feature (454)..(477): n is a, c, g, or t
  misc_feature (482)..(504): n is a, c, g, or t
  misc_feature (669)..(691): n is a, c, g, or t
ccctcccccctcccctccgacttttctttatcttaaactcatacaatatcnnnnnnnnnnnnnnnnnnnnnnnnncacnnnnnnnnnnnnnnnnnnnnnnncgagagcatatttcatttcnnnnnnnnnnnnnnnnnnnnnnnnccccctgtcgctcctgcattatcaattattaatcatccatttattactcccgaatttacaccacctaaaaacttcaaactcttattgtacattctctatcccacctaacttcttcgcaatgccatgttatctcgtctttaaatctctctcttttcttcagacatcaacccaatttattcatcaacaatatatctacactcaaatatctttccattcttaatcttacacattcttagggacgagcttcccaactcactttcattaacatctaattcttaaataaaaattaagcttaccactttcatattcnnnnnnnnnnnnnnnnnnnnnnnnatatnnnnnnnnnnnnnnnnnnnnnnncctttccattataatccaacctcagcctcttcatctttcccattgacgattatattcctctcaccaacttgtacatctagcacctctacatccgcttaataaacgacttccgcattcctttttacacccgtttattaaaaacgtgtctttttgtcttaaataccnnnnnnnnnnnnnnnnnnnnnnnctctgtatgcccgcggtaccttgaccgtgctaacgtagcatcttcattagattatatattgaacgctggaatga

SEQ ID NO: 11335 - DNA, 648 bp, Diabrotica virgifera
  misc_feature (464)..(464): n is a, c, g, or t
aaagaaacgcacagggggaagagaagagggaagaaccacataggatcaaccacacccagaaacacaagcaacaaccccagaggcgacagagccacagacgagagaaacaggacacgggaagacgcacacccccgaagcagagggacaaaggaaggagaaacccaagaaagaagcgacacaccgagggaggccaacgagaaagaaaaacgaccgaaccggcaaaacgcaaaaaagaaacacgaagcgaacaaaaagaaacacgagcaaggaggaacaaaaacgccagaacagcgcgcaagcacaacacgaaccacaaccaaacccaaaagacgagcaagccgggaccgacaacaacaacagaaaggaacaaagccaaaacagagaaaaaccaacgagagcagcaagcccacgacgggggaggcagacagggaaaaacaacagggagccaaacaagacgaacgacnagaagacagcaagctgacaacgaagcccacagaaacgcatcggcatggagaacaaccgacgcctgacaaagaggacatatgttgaaaatattgttggatgttatggaaaggcatgtggcttatttggtcgagcaaaatgacgttgaacaaagaaaatctattcacacatagcaaggactgatgt

SEQ ID NO: 11336 - DNA, 854 bp, Diabrotica virgifera
  misc_feature (814)..(826): n is a, c, g, or t
  misc_feature (828)..(840): n is a, c, g, or t
atgcggtacacaatagcagacactttcttgttttatgtgaattaatttgactcatatacagaggtattggtctaagcctggcgtacttcaacatttacaactttatatgaaagcattttggaagatgtaactgctaggttttagatgcatatttgatatatttaaggaataaaacaacatggaggtagaagatataatgtgcgatcaaagtattttacaccctgaagtaaatgttcagtttgatagtaaatcaccatatccagttattccagcaagcaaattatggatttttatagacttagtggccagatcaatcgttccaccaatttcaacaatttgttacacagtctttaaaaatcctcaagtggttatttagaatgtaagataccaaattttcccagcagtcgtagcatttttagttaataatatatctggatcattagcatccgtccaaaatatatcattaccagtaactttaagaataacgcggggtccagatggacgcgacagagctgtgattagcgacactaatgaagatactgattctgaaacgccagaaaaatcggttgattgtttggttttatttgaaccagaagatatcgatattgacgttatatttttgcatgggcttcacggagcaatcaataaaacatggaaacaaggagtttggagaacaagctcccacaagctcaacaaacaatcgcctgtaagaaggctatcgacaggcgatatgtacgtcccaaccaaagaccatacattaaaaagaaccatttcaagtatttattccaaaatacccaacaaagtggcgagacgnnnnnnnnnnnnncnnnnnnnnnnnnntaaagaatataacg

SEQ ID NO: 11337 - DNA, 873 bp, Diabrotica virgifera
  misc_feature (561)..(580): n is a, c, g, or t
  misc_feature (857)..(857): n is a, c, g, or t
tattgatgatattaactgtaattttcgtcaaattagatatttttaattatctagtttgaaatttaggggggtgaccattactaatacacaataaaccgagagggctagttttggacaccgggggtgtccatttataaacagtcagtttttagtaatggacacacctcaaatttactacttaccagctactatgtttcacagtttaataatttgtgcaataattttcagcaaatgccgaaaactaaaaaaattggcactcgccagtttttttcatatagcgaagacgacttgaaaaaagctattgaagctgtaacacaaaatggaattagtagaaaagctgcagcacgtcagtttaatgttcctcgaaccacactgatccgtaaattatactcgcctgctactactcctcggaaaatgggtccagcaacagagctttctgaagcagaagaaaatgtttttgaaaactgggtactagcaatggctcgcaagggttttcctattcatagacaaaaccttatgttatcagtgaaaaaatttcttgaggaaactggccgagaaacnnnnnnnnnnnnnnnnnnnnctcctgggcgttcttggtttcaaggatttttaaaacgtcaccctaaaattaaagagagatatcctgaagctgtcagcaaagctcgggcagcagtaacacaagaccgaattgaagcatggtttgatgaaattcaactttttttagaggaagatagatatgatgaaatattattagatccaactcgggtatttcatgcagatgaggcaggattttgcctatgtccgaagagtgaaaaagttctaggccctgtaggctacaaagaagatttttatattanggtatcatcgggaaaa

SEQ ID NO: 11338 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11339 - DNA, 725 bp, Diabrotica virgifera
gcgtaatcttttaattttgaatgaaattagttataagacgttgagtctaattgggagagggcatataaagggtatttaccagcaattttattgcttttgtcggattatcagaccctatatattatcaatataagttcttataatttgagtccagtaacgaatttgctgagaaataacttttctccgataatgctctattctcctatttctttccagactattataggtacatggaagagtattgtcggttttctcagatcgaatgtatatcgttatttgatattggaacaaaaggaatctatctacgaataatcttttgccggtatatacactaaacgcatatttgtgattatactctctgatatagttatatctagagccctcatcttatgaggatagtatttggaccactgttatactcttgccacctattagtacccctgctttttcctgaggatgtcatcaatacttgtttgtgcactcagattcttagatacattctctgctagtattacccttctcacggaatatcatgtgtcactatacacggcttacgtgcaactattcaagacatgctactttgcgattgtattgttcctactgacacttgtatctatgatgtattttaccgctccatactgagtacgagatgtgtggatttatatatatacaatcctggaatatctctatcatatgctgatacctggcaacattcttgactgcta

SEQ ID NO: 11340 - DNA, 755 bp, Diabrotica virgifera
  misc_feature (136)..(153): n is a, c, g, or t
  misc_feature (208)..(226): n is a, c, g, or t
  misc_feature (228)..(243): n is a, c, g, or t
  misc_feature (245)..(264): n is a, c, g, or t
  misc_feature (529)..(551): n is a, c, g, or t
  misc_feature (612)..(624): n is a, c, g, or t
  misc_feature (626)..(643): n is a, c, g, or t
ctcccactatggaaaactgggacgcccgcccgtacccggccccgattcccgcgtcccttacacgtccccggacgcgacgggagcattgaaaagacctcctatatctattgagtaaaagtaaagagaaattttatcnnnnnnnnnnnnnnnnnngactgtgagagaatattctatttttataaaggaaatatttatttcttcgcacctnnnnnnnnnnnnnnnnnnncnnnnnnnnnnnnnnnncnnnnnnnnnnnnnnnnnnnncagccaaaacactaaaatttttattgaacaatcaatcttttacatacctttattggaatgcaatgtatattctctattaaatatatctacttttttaaaatacacattaaattcatttattaactgtatatttatacttcaatattcttatattattaatattcatgattctcctggatgatctaataaccagcattctcttaccatttatatttgtaaatcaaaataaggaccacaaattttcatattttaagatatgttatcnnnnnnnnnnnnnnnnnnnnnnncctatttttacataactactctatcagaatatacatttatgagtatttacctttagcaccnnnnnnnnnnnnncnnnnnnnnnnnnnnnnnnataccattactatctacgcctcatataggaattcggcaactttgctctcacctgtacatacatcacatgtcttctagtacaactataaagcctctcctgtccactgattaat

SEQ ID NO: 11341 - DNA, 751 bp, Diabrotica virgifera
  misc_feature (59)..(76): n is a, c, g, or t
ggaaaggtggcacccctggcgggaccgggacggaattcccggcccttccacggggtcgnnnnnnnnnnnnnnnnnngtctagaacttttttttaggtacattgaaaacatactcttcatattcagaatcaagacagaatatcacatattccgcaactggtacatgatagattggcctttgcccgtatcactagttgtatatctatgttaaggcaaccgttagaccgactccatggcgtttcacctcactggagttctgttactatattttctttctaggtcatgccggtctacctctctgtccggtgtgtcgaatctggtatctctgtctattctttcctcgtcgattggaataaagcttcggaggatgtcatcgcacggagatactctgtgacaagggctgtctcgtgcgtatccgaggacttcgctctgactttctgaagctgcttggacggaaagtggaggtaaatgatcctctatatgactctgaagtttttgatgaatgtggaagtggaattctgtccaacaacgctgaaaagcattcaagcttgatcagtgactgctgcaccatcactcacgtagccatatttcgaccgccaccagatgttacatctagctcctcttcatgctctaaatgatcttcggaacattccacaagactggcacgtagggaaagagtcacgtatatacataaaaccatgagctctaatgtaaggacattcactgtgacctatgatacatttaactgctga

SEQ ID NO: 11342 - DNA, 686 bp, Diabrotica virgifera
  misc_feature (317)..(340): n is a, c, g, or t
cagaactacaatatgaagattttttcatggcgtactgatcgcaagcttttctctagtggtctgctctgttattgagatatgatacttcattataataaaagaacaactaattgtttgcgccgagggaacaaggaatgattaaatgacaagtatagatgaattatgttctggctgaaacgatctgaatgatttaattgtttattgataaatcaatgattgtaaagggtttaattgcagtgtgaagtctttggtttctgaggagatctaatccgatttgacctaggcagacttatttattatctatatatttatactcnnnnnnnnnnnnnnnnnnnnnnnncaattttatttaccgactgagcttaacctacatatctggatgaagcgtaaggtctgatccaagaatcacagattaaacattttcatatctcaacaaatgctcttatttatttatgtatattgtggatgttaatttcatatatgttttttatgagaatataagtttaaataatttcaatgatgatactgatgatagtattagtattaataattcgcagatttattgaaaatgatatcaggtaaatgcaggatatctgcgaacatcttgctcacgtgtctatttaagacatgtgtttaggtattagatataaaggcacgcctgaccaatgagtactaatcatggtcgc

SEQ ID NO: 11343 - DNA, 571 bp, Diabrotica virgifera
atgacattgtatggggacggccacttaatgagaatgatcatatcctctaaaagtggcaacgcaagaatgaaaaacaagacatttcaatagtgagtatgacacaccatctcccagcaacgactgatcggaatctgtttatcatcgaataaataagaggtggtatccttcccttggtactagcccgatatgcctctagccggggccgtaactgtaccacattttctggaggcctaggatgatggcaatgagttatctacagctgtgcccacaaatactcgatatcgattgattatctggggtacatggggggcattacaaatacctcttctccgctaatctattaactaaaataacgttcagtctgtatcacacgagtgatccagtgtcgtgaatgtacaaaaatgttgagaaggtcatatatcgcacctctccgtccagcgatggtttttgaacagtactgggaagtttgagacctacacatacgatataattcacctcactagtttagagatatcttgacatacggatagattggataggatttttatggagattccgttttactacacca

SEQ ID NO: 11344 - DNA, 829 bp, Diabrotica virgifera
  misc_feature (17)..(57): n is a, c, g, or t
  misc_feature (204)..(204): n is a, c, g, or t
  misc_feature (383)..(406): n is a, c, g, or t
  misc_feature (469)..(554): n is a, c, g, or t
  misc_feature (592)..(609): n is a, c, g, or t
  misc_feature (678)..(700): n is a, c, g, or t
  misc_feature (730)..(761): n is a, c, g, or t
  misc_feature (799)..(822): n is a, c, g, or t
ccccttttacgcgcccnnnnnnnnnnnnnnnnnnnnnnnnnnnnnnnnnnnnnnnnncgtcattttatgatattaaatcatgaaacgtctcagccatgcgccacatcgattcaattttgaaatgtgttcgcaggttatcttatgaactcgatagcatactgtgtcatgtccatatatacacttagtattgtctgtattaatgtngaaagattcatcgtgtatatcgtaacgtggagttaggtatcgcacaaaataataacctagagcgttatagttctacatatctcatacaacgtaatctattcatcttatatagagactaaacacaagtctatacatagtttcttctctaagaaagatcgacgacagaacccatatgagannnnnnnnnnnnnnnnnnnnnnnnacagttgttatttacacatataaatttcatttatatagatagaatttatgttaattcggggannnnnnnnnnnnnnnnnnnnnnnnnnnnnnnnnnnnnnnnnnnnnnnnnnnnnnnnnnnnnnnnnnnnnnnnnnnnnnnnnnnnnnaccttaaggataacatcgtaatattattgaagataacnnnnnnnnnnnnnnnnnngcgacctacaatgttcgaatcataagagtataattgattgtagcagctatattataaagtctgttctannnnnnnnnnnnnnnnnnnnnnnaatataaaccggtgcgagacaggctgattnnnnnnnnnnnnnnnnnnnnnnnnnnnnnnnnaaaaggaccatatatatacaataatctttatattcagnnnnnnnnnnnnnnnnnnnnnnnnggtcgat

SEQ ID NO: 11345 - DNA, 293 bp, Diabrotica virgifera
  misc_feature (2)..(104): n is a, c, g, or t
  misc_feature (106)..(144): n is a, c, g, or t
  misc_feature (151)..(172): n is a, c, g, or t
  misc_feature (177)..(213): n is a, c, g, or t
  misc_feature (252)..(273): n is a, c, g, or t
  misc_feature (275)..(291): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnntgtttannnnnnnnnnnnnnnnnnnnnncctgnnnnnnnnnnnnnnnnnnnnnnnnnnnnnnnnnnnnnctcttattattatgttagaaagcttaaattttcttaagnnnnnnnnnnnnnnnnnnnnnnannnnnnnnnnnnnnnnncg

SEQ ID NO: 11346 - DNA, 242 bp, Diabrotica virgifera
  misc_feature (4)..(128): n is a, c, g, or t
  misc_feature (166)..(196): n is a, c, g, or t
tagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattgatataataacatttattttatttgacgtgattnnnnnnnnnnnnnnnnnnnnnnnnnnnnnnncataatatttaattaaataattgttatagatccaaattttttttga

SEQ ID NO: 11347 - DNA, 828 bp, Diabrotica virgifera
  misc_feature (217)..(235): n is a, c, g, or t
  misc_feature (544)..(544): n is a, c, g, or t
  misc_feature (744)..(763): n is a, c, g, or t
gaaaaatatacatcctatatcctaccgcatcttttaactggaagcaaataagtacgtaggccacttaaaataccaaatcctattcatcacactgtacgtagtttgcagggaatagcccgtatctatttttgcacagtcctctccaccatcctgcatcaatcttgtcaatgtgcgtaataacatcgtcaggatcgaatgatatttcgtcttctgcggnnnnnnnnnnnnnnnnnnnggccacagcagtaataccagtatcaacaatttcctcttgatactcttcttcagtctcttgcggtgttgcagcaggttctggttctgtaggagtcatttcttcagctggagcagtactggcactaggtttgcccctttttatcgttgacacatcaaaattttcgtatatatcatcagagtccgaatcatctggcttttgttgctgtaattgtcttaataactccaattcttcttgcatcatactttgttgtttttcattttcagtctcttcattctgagcaaatttcattttggggcctgaatccaagcngtttcggctccacagtcatcttctcctcgggctcgctattttggttttgctgtgttaaaaacgcagttttcgattgatctaacttcttcggtggtgcctccatggtggttgtgtttccgttctccttttctttatcttcgcgaatggtttgagtcaaaaacgctgttttagagtggtcgagttgtttgggagagacgacnnnnnnnnnnnnnnnnnnnnctggagggtccttcttgacattagcgaataaagcggctttagcgtgaacgtattctccggggggg

SEQ ID NO: 11348 - DNA, 707 bp, Diabrotica virgifera
  misc_feature (19)..(43): n is a, c, g, or t
  misc_feature (46)..(110): n is a, c, g, or t
  misc_feature (138)..(150): n is a, c, g, or t
  misc_feature (152)..(166): n is a, c, g, or t
  misc_feature (197)..(240): n is a, c, g, or t
  misc_feature (244)..(266): n is a, c, g, or t
  misc_feature (304)..(350): n is a, c, g, or t
  misc_feature (362)..(406): n is a, c, g, or t
  misc_feature (609)..(643): n is a, c, g, or t
  misc_feature (647)..(705): n is a, c, g, or t
ccccttcctcgcgcccgcnnnnnnnnnnnnnnnnnnnnnnnnnacnnnnnnnnnnnnnnnnnnnnnnnnnnnnnnnnnnnnnnnnnnnnnnnnnnnnnnnnnnnnnnnnnaacgcgatattttgaccgtgctaaagannnnnnnnnnnnncnnnnnnnnnnnnnnnatgtgaatgtaaggattgcgatgaaaaaacnnnnnnnnnnnnnnnnnnnnnnnnnnnnnnnnnnnnnnnnnnnncacnnnnnnnnnnnnnnnnnnnnnnncaacaccctatagacctttataaaattattactaaggnnnnnnnnnnnnnnnnnnnnnnnnnnnnnnnnnnnnnnnnnnnnnnnctattaaaaacnnnnnnnnnnnnnnnnnnnnnnnnnnnnnnnnnnnnnnnnnnnnngatcccatttttttgatcataagaataaattaccttacggataacaccgtaatattattggagatatcaaatcgataataaaaattgcgacctccatgttggattaaagtgtataatagctgtaacacctatattataaagcctgttctacttttaaaactttacatgatctgagtgtagaccgatgcgagacaggttgattnnnnnnnnnnnnnnnnnnnnnnnnnnnnnnnnnnnaggnnnnnnnnnnnnnnnnnnnnnnnnnnnnnnnnnnnnnnnnnnnnnnnnnnnnnnnnnnngt

SEQ ID NO: 11349 - DNA, 742 bp, Diabrotica virgifera
gacacgccgggaggaaccgcgccggaatgcccggcccttcccacgcgccggttcctgatttgctactaccataggtgtgtgccatactttcgaagcgcaataaagcctagctcccataactcgagaaaaagggccacctacattctactagctatccgactatttaaaaaagacggccgccccacacggacaatgatacataggcttctaatgatgtttaaaattacttccaatgagacacacaggtatctgttacctgcccggcaaaacacaacatacttggctgttccctccctcgcttgtatcccatactgctcactgatgcaaatgaatcccccttacaccggctgacgacttagccgcaaacaccatagccaatgcccttaccagataacgcacagactacatcgagggatgcaactgtacccgtcgcattccatcgggccattcccgggcgccggcatcgccaggagagaccactacatctgataacacactcgcgccctcgactctacatttcttcgcttcccttcacgccacatcatgccgcataacgccgtgaggcgtctatcatcgttactgaccctgtaaggtgccaattaaacgatttgctattcctcgacccatgaatactcgaatgactggacgtgtccacaggagttccgtcatcgatgaatacgactgctcgtccactgaagcggggggctccggtatatgtagagtactcttgatacagactgca

SEQ ID NO: 11350 - DNA, 882 bp, Diabrotica virgifera
  misc_feature (13)..(42): n is a, c, g, or t
  misc_feature (48)..(198): n is a, c, g, or t
  misc_feature (205)..(645): n is a, c, g, or t
  misc_feature (647)..(695): n is a, c, g, or t
  misc_feature (697)..(808): n is a, c, g, or t
  misc_feature (810)..(828): n is a, c, g, or t
  misc_feature (838)..(875): n is a, c, g, or t
cccttcccgcgcnnnnnnnnnnnnnnnnnnnnnnnnnnnnnncatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnntaacaagctnnnnnnnnnnnnnnnnnnnnnnnnnnnnnnnnnnnnnnaataaaa

SEQ ID NO: 11351 - DNA, 837 bp, Diabrotica virgifera
  misc_feature (433)..(452): n is a, c, g, or t
  misc_feature (487)..(517): n is a, c, g, or t
  misc_feature (783)..(835): n is a, c, g, or t
agcggataaatggattgaagaaaacttattaatctaagtgataatgaacatgaagtaacaaatgacaatatcgatatcgagaaaacttcacctccgagtggtactaaaaagggtaaagattgtatagcttgctgttacgctgttttgcatgattacaacttatatcactgtgctgagtgcttatccaaatttaaatatgtattataatataaagcatttattaactctttcattgacaccattaacttgcaaaaaaagcttttcaacattgaaaggcataaaaaatcggataagaagtactttaacacaaaatcacttttatgctaatggctatagaaaaagaaactttgtatcaacttaaaaatgatgtaataatcgacgtatttgctcaacaatctactttaatgcggaaattattgatcaagagataagnnnnnnnnnnnnnnnnnnnnctctaaagaatatttagattattgcgttgaattannnnnnnnnnnnnnnnnnnnnnnnnnnnnnngcactctacttgcatttgtactctcttgcataattaatttactaaaattgagcttaatacataattgaaaaattcttaaaatcttattttactttcatcttaatttacatcaaattcatattatatttattcaggaaattatgctttctgcgatactgcatacaatattgtcatacatgtcatttattatgtgtaagattattattcttatatgaaaaaatacagcaaattataaaaatcattgaattcgaagttttatatttgannnnnnnnnnnnnnnnnnnnnnnnnnnnnnnnnnnnnnnnnnnnnnnnnnnnnga

SEQ ID NO: 11352 - DNA, 780 bp, Diabrotica virgifera
  misc_feature (234)..(252): n is a, c, g, or t
  misc_feature (475)..(492): n is a, c, g, or t
  misc_feature (579)..(600): n is a, c, g, or t
  misc_feature (624)..(642): n is a, c, g, or t
gggtagagcaataaattgcattattcacctttccactgactgcaccaattattaatagaaaccctgtatcaagtggtcttaattactaaatacataatttttgcataatggaacgttgtatatgcggtatcagtagccagcgagacctgagaatacatactacattaatactactgagttagtaatcaccaatcatctataataaaaatatttgtcattatttaatagttgtcnnnnnnnnnnnnnnnnnnntatactatactatataatactattatgtaaacagtaaacacttgcaagttgcaacaataaagtgtttcttggcataaaacttcagaaataaattatggtaggggagcccaagcgggggtttttgcagttactcgagcgcgtcagattatcatatggggagaaaccttgtaccctgtaaatgtacctctaccatatattggctcttaatacagggtagctcgtnnnnnnnnnnnnnnnnnnaaaaaaaatctatccttagaaaaactccaaatcatcagattaaaataaggtcagttaagtacatgcaaaacgattgttggaaatggnnnnnnnnnnnnnnnnnnnnnngtcaccactaaaatggaaaactannnnnnnnnnnnnnnnnnnaggacctactcttcacaacccagaagatcgccaaagcgctcgagtgactgcacatttagcatactttcctcccctaattaatacctcgcatttcacttttcaggctttgtagttttgaccgatatctcgacttttgga

SEQ ID NO: 11353 - DNA, 811 bp, Diabrotica virgifera
ttctttgatagtttgaatgatatcaagtgttattgaagatatgtaagagcacgagagggggtgtgaacgacagatttggataattgaatttttataaacgtatataattcttcttatcctgttaacgatatggacggtaattcattaagaattaggacccctattattcatggaaggcctgcgcctccgctacaaataatgacaacaatctcatcaacagtgatccaatatatcggcaccaagtgatgtccttttaatacaatgttatgcaacaaggttatataacaagtattccagaaaggtatgcatggagttcctccagtctcacggacacgtcgttttacacgggtcacctttaagacagagataccggcatccagataccggacttaatgtagtcgaacgatggtcctcacataagatatcgtaaaataccacaacctaatgaactaagtcgtcaattaccgcaaacacaatctactatttcaggaagaacatattagaaaaaccctgtaaccccgtttcatgtttgacgacaagtgagaattcaagatgcctatacctacagcaccatcgcataaaccgtttagatctgcaccaaacatacctacatcagaggaattcgactaccacattctaatgaatctaattcctacagcacacataaatcctatacagtatataggcgataaaagactcatacacacaatacctgctcaggatataagactcaaagatacgccactgcacatataagaggtccggaatgacatctgattcccgcacccatctcaccataatgcacacctaa

SEQ ID NO: 11354 - DNA, 732 bp, Diabrotica virgifera
  misc_feature (316)..(334): n is a, c, g, or t
cccgaatttcccgcccttccaccccgcccgacctgtgacgacgtgagagcacaagcgtgtttagaaacacgattatcaccgacttcgttttcagagtactttgcaccatcgcatctagtgcgaattactaaatgacactacatacattcataccacctttgaatgctcgcttaccaccggcactaatatacattaaccatgtcctcttctgtctacttctttcgatgaggaggatgtttgcttgatgctgaacaaacatctgaaccttctcctgcctgctcctgattgttcaagacgtgataggatggcaccatcnnnnnnnnnnnnnnnnnnnaggatggaaacgatggatgaccattcgcaccacacctcgagaataacgacagatgagaacaccttagatattcccgactgcgccacactcatcatctgaaaaaaaattgtcaacatcaaagatgccacgcctgtgctccatcatggctcctttttattctacagaaactaacactatcactccgccccagaggaagtaaaagattgtgtgagtgacttcctcagaaaatactagtgaaccgatgactacgttgacataccaaatgaaggagtgaaagacatgttagtaaatctcgactgactgttataagagatcttgcaacacaacgatcactagaagagcgaatactatttctcttctagaattctccgtaccgaagcaccacgaataatacaaca

SEQ ID NO: 11355 - DNA, 137 bp, Diabrotica virgifera
  misc_feature (10)..(54): n is a, c, g, or t
  misc_feature (56)..(117): n is a, c, g, or t
  misc_feature (121)..(136): n is a, c, g, or t
atggatgacnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnngccnnnnnnnnnnnnnnnng

SEQ ID NO: 11356 - DNA, 573 bp, Diabrotica virgifera
  misc_feature (16)..(43): n is a, c, g, or t
  misc_feature (47)..(103): n is a, c, g, or t
  misc_feature (105)..(167): n is a, c, g, or t
  misc_feature (169)..(197): n is a, c, g, or t
  misc_feature (287)..(308): n is a, c, g, or t
  misc_feature (391)..(413): n is a, c, g, or t
  misc_feature (432)..(449): n is a, c, g, or t
  misc_feature (460)..(490): n is a, c, g, or t
  misc_feature (513)..(533): n is a, c, g, or t
  misc_feature (541)..(571): n is a, c, g, or t
ctctccacgagccccnnnnnnnnnnnnnnnnnnnnnnnnnnnncttnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnntaagagttaaagaattaaaatttttattggagaataaatattttgtgtaatttatttgtaatgaaaagatattcggtaataaacataacnnnnnnnnnnnnnnnnnnnnnngattatttgattcgctgtgtatttataattaggtatatttatattatgaatatataatatttctagggatgagctcaaaaatnnnnnnnnnnnnnnnnnnnnnnngtaaaataaaatcaggagnnnnnnnnnnnnnnnnnncagatatattnnnnnnnnnnnnnnnnnnnnnnnnnnnnnnngttagtataaatattgatagaannnnnnnnnnnnnnnnnnnnncatgttannnnnnnnnnnnnnnnnnnnnnnnnnnnnnnta

SEQ ID NO: 11357 - DNA, 657 bp, Diabrotica virgifera
  misc_feature (14)..(43): n is a, c, g, or t
  misc_feature (126)..(156): n is a, c, g, or t
cccttcacgcgtcnnnnnnnnnnnnnnnnnnnnnnnnnnnnnncttataggaaaaaactaaaacaaaattatgataaactcggctataaattaaacatcaaggacctttatctaaagtgatactgnnnnnnnnnnnnnnnnnnnnnnnnnnnnnnntacatcctaatgatggaaacatactcattgatatctcaaaacaccgcattgatgaaaaaggaattaacctattgatagaattggatcaatcaaggatcgtataatctgcactacatgctatgattaaaggaactttattaactacaccgaaaacacagctgtattactcaacccaaaaagaaatacaacaaaactaccaatcatagttgatgttaaacacgacacgactgaagtacatcgctgtcctaaatcacatgtaaagctttatagaaaaactgctatcaggtgcatggataggatactctgccaaacaaatcactgacgatgacaacctagcaattggagtgatcaaatgaaggaccattaatggctacagaatctctaaaatcttacagcaaacgactctactatacatatatgtacccatcttgacggtacatatctcgcagatgagctacaaaaagacatcccccattctgacctcgcttctatatgcatctc

SEQ ID NO: 11358 - DNA, 487 bp, Diabrotica virgifera
  misc_feature (84)..(102): n is a, c, g, or t
  misc_feature (187)..(222): n is a, c, g, or t
atataatccattatattatattatttatcaattttccaattaactacacgcataaaaaattaccattgtcatagaaaaataacnnnnnnnnnnnnnnnnnnngaacggaaatcctattcgattatatctatatcttcattctaaaaatacaatttatttataatcattatctatatacttatatatnnnnnnnnnnnnnnnnnnnnnnnnnnnnnnnnnnnnggcatcgaacttaaccttttcctaatatcttaatttctttatcaaattaaagataagattacttcttatcctatcatatcatatgatttactttaatattctataatattacttttctacataataattcttctactataacatccatttatattacttatattcacgatggatgatatacctcctataaaatgcttgtatacttagtatatatatataggataaatgaatgcatccacctacatttctcccgcctgttaattac

SEQ ID NO: 11359 - DNA, 818 bp, Diabrotica virgifera
  misc_feature (87)..(119): n is a, c, g, or t
  misc_feature (755)..(774): n is a, c, g, or t
gaaatgcctcattgtactcaagaagaactggctgatttcccacgcagaatgcgtgattggcttttcacattatgagagaacctgaannnnnnnnnnnnnnnnnnnnnnnnnnnnnnnnngaatctcgtcgtaaagaatgctccatctacatcgaatcgtggtcttcagattgcgctatctaccaacaaagatgcttgttgtgctaaaggagaccaataatgcaaaggaccccaatattaacatgtacacattgaatattacggacaatgtacggaaatgcctcattgtactcaataagaaatggctgatttcccacgcataatgcgagattgtcttttcaacattatgagagatttgactgaccgacaagaacttactcctcattacatgaacatggaaaaagaagctgaatcaaacatgactcgccgctggacaaatgctgctgtctggaaattctgtgatttagatggaaatcctccagatagatctgtttctcgtcacgagctgttcccaattctcgcaccattgatgtctttggaacattgtatcatccctttcttaaattcatgtgatgcagataataaccacagaattacacttcacgaatgggtcaaatgtcttcttctggtatagtaggatattgagctccagtgtgaagaaattagtgatatttcagcaaagtaatgcggaccttacatataaattgttaatatttcaaaagtgctgtagaattcatagaaaacgcgccataatgnnnnnnnnnnnnnnnnnnnngatatcttaacgaaatttaaatatgacatttaattatagtatat

SEQ ID NO: 11360 - DNA, 976 bp, Diabrotica virgifera
  misc_feature (9)..(29): n is a, c, g, or t
  misc_feature (69)..(197): n is a, c, g, or t
  misc_feature (199)..(821): n is a, c, g, or t
  misc_feature (823)..(906): n is a, c, g, or t
  misc_feature (924)..(955): n is a, c, g, or t
tcctatagnnnnnnnnnnnnnnnnnnnnnctaccgctccggacatccccccgtcttcccacgcccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnncgtttatacattatgacnnnnnnnnnnnnnnnnnnnnnnnnnnnnnnnnctacatttatttaattgcggt

SEQ ID NO: 11361 - DNA, 902 bp, Diabrotica virgifera
  misc_feature (116)..(173): n is a, c, g, or t
  misc_feature (197)..(265): n is a, c, g, or t
  misc_feature (269)..(367): n is a, c, g, or t
  misc_feature (379)..(555): n is a, c, g, or t
  misc_feature (557)..(614): n is a, c, g, or t
  misc_feature (625)..(695): n is a, c, g, or t
  misc_feature (714)..(814): n is a, c, g, or t
  misc_feature (821)..(840): n is a, c, g, or t
  misc_feature (843)..(885): n is a, c, g, or t
ccgcgcccgattttaatatcataaaatattcttttagtctgagcatcgaaaaatctcatttaatcgatcctcaattcgccatatgcgatcagcacatctttattaattataacagnnnnnnnnnnnnnnnnnnnnnnnnnnnnnnnnnnnnnnnnnnnnnnnnnnnnnnnnnncattattttcaaattcaaaagacnnnnnnnnnnnnnnnnnnnnnnnnnnnnnnnnnnnnnnnnnnnnnnnnnnnnnnnnnnnnnnnnnnnnnttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnctcacctgtcnnnnnnnnnnnnnnnnnnnnnnnnnnnnnnnnnnnnnnnnnnnnnnnnnnnnnnnnnnnnnnnnnnnnnnncattttgaccgcgctaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacgctnnnnnnnnnnnnnnnnnnnncgnnnnnnnnnnnnnnnnnnnnnnnnnnnnnnnnnnnnnnnnnnncatcaaatttatttata

SEQ ID NO: 11362 - DNA, 804 bp, Diabrotica virgifera
  misc_feature (3)..(27): n is a, c, g, or t
  misc_feature (37)..(57): n is a, c, g, or t
  misc_feature (59)..(83): n is a, c, g, or t
  misc_feature (94)..(128): n is a, c, g, or t
  misc_feature (139)..(194): n is a, c, g, or t
  misc_feature (196)..(209): n is a, c, g, or t
  misc_feature (211)..(232): n is a, c, g, or t
  misc_feature (234)..(365): n is a, c, g, or t
  misc_feature (385)..(457): n is a, c, g, or t
  misc_feature (507)..(543): n is a, c, g, or t
  misc_feature (576)..(595): n is a, c, g, or t
  misc_feature (603)..(656): n is a, c, g, or t
  misc_feature (759)..(797): n is a, c, g, or t
ccnnnnnnnnnnnnnnnnnnnnnnnnnatattgtgcnnnnnnnnnnnnnnnnnnnnncnnnnnnnnnnnnnnnnnnnnnnnnncgtatcaggcnnnnnnnnnnnnnnnnnnnnnnnnnnnnnnnnnnnaatttaaaacnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngactaataattttcatatcnnnnnnnnnnnnnnnnnnnnnnnnnnnnnnnnnnnnnnnnnnnnnnnnnnnnnnnnnnnnnnnnnnnnnnnnnctaaattatttaactttagtactgatgacagtattagtattaacaaatcnnnnnnnnnnnnnnnnnnnnnnnnnnnnnnnnnnnnnctctgcaacattttcttcacctgtctattaacnnnnnnnnnnnnnnnnnnnnctataacnnnnnnnnnnnnnnnnnnnnnnnnnnnnnnnnnnnnnnnnnnnnnnnnnnnnnncgtagcatcatcattacttattctattgtacgctggaatgaagggatggatgcaaacacactgtctatatttcatttataaggaattttattgttatgttatnnnnnnnnnnnnnnnnnnnnnnnnnnnnnnnnnnnnnnnttttata

SEQ ID NO: 11363 - DNA, 209 bp, Diabrotica virgifera
  misc_feature (17)..(54): n is a, c, g, or t
  misc_feature (74)..(87): n is a, c, g, or t
  misc_feature (90)..(112): n is a, c, g, or t
  misc_feature (177)..(203): n is a, c, g, or t
accttacggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgactcataaaattttacatgatctgagtttaaaccggagtgagtcaggtagatttctatnnnnnnnnnnnnnnnnnnnnnnnnnnngaaagg

SEQ ID NO: 11364 - DNA, 589 bp, Diabrotica virgifera
ttacatacaactaaacttgtactcttgtcctattattctgtaaaacatttctaacaattatctttaatgtaatgtcacatcaacaattaaggcctatataaacattattaccaacgacagtgttcctggattcatagtgttgataatgtataataacactacacgtgttatcaccatggtctatggccaatcaaaacttcaacactaataggaatttttactaaagctactatactctccagattcttaactctaccggtctacactacttgatgagcttacgccttactgagaccgactcaccataatattaatgctctatgagtcaaatcttccaaaccctaatcatgtcgtttactatgtctcctttaacattataatacttaaagatgatatcaatactattgcccagcatgactaacatgtcgcggtcctagaaatccaacagctatacatgcattatttggactctcaaaccacatcatgatctcactacatgctactacctctgctttcgactttactcagttgtaatttaagggatattaccaacaaacagccatcgactgatctatgaaatactgtatca

SEQ ID NO: 11365 - DNA, 741 bp, Diabrotica virgifera
gcctgcagggaccgggcctgaattccctctttcctcccgcgcgaactatgcgatgtgaatacatgacgatgtgaagatatttcccttatcacacttacttttatctctgcatcgttttcatcataggatattgcaccacataccttgatacccgcctggatattcagagcagaaccgagcgaagaactaaagatttagatacaattgatgacgacatctaacctgagaactctgaagattgtgcttaaccttgacttaaatttggacaaaccaggctcatttcacttctacttgcattcattgcgccaggtactttattagtgataagggctctacaagatgattttaagacaaaaagttcatatgagaatgtacttaaggcattggaatctgaaccctagcaccagttgaagacatctccaacgggcagcacagattgcttaaactgaaagacaaccgagctagaggatagaaagaaacacaaccatactgataagattcaaaaggctctagcaaagacaatgaaatttgatgagaatgaataaatgtatgttgtctgtctacctaattaaacattgtactacgatatattactcatctgcgctatacataactgatgatatggctcaagatacatacgtcgttttaactacatctataaattttgaatcacgtttgattaacaacattatcgatgttaagaatatcagagtaagaggatctaaaattgactttgataga

SEQ ID NO: 11366 - DNA, 823 bp, Diabrotica virgifera
  misc_feature (88)..(108): n is a, c, g, or t
  misc_feature (755)..(776): n is a, c, g, or t
gaaatgcctcattgtactcaagaagaaatggctgatttcccacgcagaatgcgtgattggcttttcaacattatgagagaacctgaannnnnnnnnnnnnnnnnnnnnccagaagaaagtgaatctcgtcgtaaagtatgctccaactacaacgaaacgtggtcttcagattgcgctatctaccaacaaagatgcttgtgtgctaaaggagaccaggaatgcaaaggaccccaatataaacatgtacacattgaatattacggacaatgtacggaaatgcctcattgtactcaagaagaaatggttgatttcccacgcagaatgcgtgattggcttttcaacattatgagagatttggctgaccgtcaagaacttactcctcattacatgaacatggaaaaagaagctgaatcaaacatgactcgccgctggacaaatgctgctgtctggaaattctgtgatttagatggaaatcctccagatagatctgtttctcgtcacgagctgttcccaattctcgcaccattgatgtctttggaacattgtatcagccctttcttaaattcatgtgatgcagataataaccacataattacacttcacgaatgggtcaaatgtcttcgactggaagaggaggatattgagcaccagtgtgaagaaattagtgatatttcagcagagtaatgcgtaccttacatatatattgtaaatatttcaaatgtgctgtagaattcatataaaacgtgccataatgnnnnnnnnnnnnnnnnnnnnnnatcttaaccaaatttaaatatgacattttattttcgtatatcctgca

SEQ ID NO: 11367 - DNA, 907 bp, Diabrotica virgifera
  misc_feature (179)..(198): n is a, c, g, or t
  misc_feature (347)..(370): n is a, c, g, or t
  misc_feature (447)..(472): n is a, c, g, or t
  misc_feature (475)..(488): n is a, c, g, or t
  misc_feature (884)..(884): n is a, c, g, or t
ttgacattttttatccgatcaaaaacccctagttgatggtgtggaaaatgacttgtatttccataataactttgaaattttatgtttcacgatctattttagtcccaatcactgcagcagtggagccatgtttttgttttcagggtgccagtagatggcgcataaatcgtttaattttnnnnnnnnnnnnnnnnnnnntgttttacatgtacttctttttattgggaccgtgcaagttcggcaaagcgacccctatttctacgctctatactaaaattcgcacttttaattatattggccaattatattagtcctggttactggataattgtcaaggccatagtccnnnnnnnnnnnnnnnnnnnnnnnnaagattcaggttatgttataaaaacgtcaacaattgtatgtagtaaataaaattagttattaaaatgcagtactgcnnnnnnnnnnnnnnnnnnnnnnnnnnccnnnnnnnnnnnnnngcatatcatatcaatattgtggagcaatatataatttttctgcttcactgacagaaagtatgaaatatacgtcaatttgacaatatgaattatttaagatagttgcaatatttctccgcgactcgcgcagggtcgtttctcgtttccccttccaagtacttgcacaccgcgaatagtaaatgctcatgcaaattttcaaaacaattggtgcagtactttttattgtagaaattcccacacaagtgtgtgaatctcctacttttacactaggatagccctttaatgcaaataacaaaccagggggagaaggtctataggacggcatagaaaaggtggaaagaggggatctggagaaaataggagtgagacgatgggaagtagcggtacaggatcganagacatgggaagcaataataaac

SEQ ID NO: 11368 - DNA, 633 bp, Diabrotica virgifera
ctcttatctgccagaacatcccaagcactgtaccttttattctattttccacttcaaacagttgcatatactaaatttccaaacaatcaaaatgactgaagaaaagattcttattaacctcatggtcatcgtacctataaatcctgtgaaatctactactactgcacatttaattaacaaaagaggagtaatctacaaacaaaccatctaacatttccaaaaagaatcccaagaactgggaagaagcacattcaaacatgcctggatactctacaaactcaaggacattatataatcaggaattacctttgatattgatatcctgaaaatcaaaacccttaaatactatgaaaccatcatttatgaacctaaacacagagattccataacttaacatgatcactgttacatcacaaaatgaccgtattgtacacattgttgctactgatactgatgaatgagaaacatgtatttccaataatggatgaataaaagaatatgttctaattgcttacaacctaacagtaaaacatcttattattagtgtaaacaacatgtactcatctgaaccattatacattcaataaccctactcggacatcatcaatatatactcctcatatataaagataa

SEQ ID NO: 11369 - DNA, 700 bp, Diabrotica virgifera
  misc_feature (5)..(23): n is a, c, g, or t
  misc_feature (422)..(441): n is a, c, g, or t
ccttnnnnnnnnnnnnnnnnnnnctccggaacaccatccatgcgtgtattttctagactttgctactgatagtatactttgagactgttagcgttgagctcatgcataatttatgatggtgcaaaatcgccaatgatcctctcgagatgtgagggagagacagggacagtactcccttattctccgacccggcctctcctcctgcaccatacacgctcgtcccatggggtatagatactactgctcccacactacctcctgaggtcattcaaatacctgcaccaacacctgaaacacattcttcgcgcaatgacgtgccccccgcatatttcgatcctaccatacagcatgcttacatgatatcttagtaatcaccaccatccattccacacggtagatatatgctctgtccctcccattcnnnnnnnnnnnnnnnnnnnnttctggtctccaaaactactatcaccggctgaagactgtcctatataagcggcgtgatatggatcccactgataatctatgtgcctctattataccccaccgtcgaccctgtcatcatccttaattagacgtactatgactgaactcttaccttcaagtgggacaaggctctgcgaatgatttcggtacagcccatactgcttgtggtacagccaccaaacctgatgatctccatatatcgtgaataggtattgctaca

SEQ ID NO: 11370 - DNA, 976 bp, Diabrotica virgifera
  misc_feature (847)..(847): n is a, c, g, or t
aacaaacaacaaggtctgatttttgatctttggacctctggtgtcaaagtttgaagacataatattgcttctcgtgtttctatgcatttcctaaagccaaattgttctcgaccggtgacctcgtcacgtcttttatacagttttgatcgtgctaatagccggcaaaatgtcgcaaaagatggaaaacataatacgctgtgaaataaaacgagattaaactagtagaggtgggaaaattatcgatagagacctataaattgattattgataatttcccaccttcacgtacttctccgatgcgtctaaaggtgggaaactatcaatataatgaatatttataggtttttatcgctaaatttcccccctctaacaatttcgtctcgttttatttcacaacttaatatattttccacattttgcgttatttttccggttattagcgcgcttatcactgtgtattatgtactgtaaatattatttaataggccaaggtgaaggttcaagttttcctcgttgattaacttcggtaggtcagctggtatttcatcttttcctgcagatttgttgcttttcagttgatgtagagcatatgtattccagttcggacttcattattgtgaggaccttcgttgttccctttatttaatgtaggaggttctctgatgtcaaagaagagttcttttatatagtcttcccacatgtttatttgttcttccgggcttgaaatcagttttccttgattagtttatttatatgtaaattctgggaagcttaaggagttgactgaaaatattccaaacgcatgttctatattcaatttttgaataataatacaatttgtcgcttngtaaaataataatctccagtaataatttgtgtgaaataatccacaaaaatcaaaatttaaaacataccatcctactggaccaactaagtacaaaaatgaaaagtgtttaccatgtaagttaatttttta

SEQ ID NO: 11371 - DNA, 398 bp, Diabrotica virgifera
  misc_feature (2)..(91): n is a, c, g, or t
  misc_feature (100)..(125): n is a, c, g, or t
  misc_feature (127)..(163): n is a, c, g, or t
  misc_feature (165)..(200): n is a, c, g, or t
  misc_feature (231)..(253): n is a, c, g, or t
  misc_feature (280)..(322): n is a, c, g, or t
  misc_feature (343)..(358): n is a, c, g, or t
  misc_feature (360)..(386): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattattacnnnnnnnnnnnnnnnnnnnnnnnnnngnnnnnnnnnnnnnnnnnnnnnnnnnnnnnnnnnnnnncnnnnnnnnnnnnnnnnnnnnnnnnnnnnnnnnnnnnattctattgaaagctgctatgaacggttgcnnnnnnnnnnnnnnnnnnnnnnncaatttataaagagttttatttctacnnnnnnnnnnnnnnnnnnnnnnnnnnnnnnnnnnnnnnnnnnnttgtataaaatcatcaccacnnnnnnnnnnnnnnnngnnnnnnnnnnnnnnnnnnnnnnnnnnngtggcggtgatt

SEQ ID NO: 11372 - DNA, 490 bp, Diabrotica virgifera
  misc_feature (32)..(59): n is a, c, g, or t
  misc_feature (100)..(123): n is a, c, g, or t
  misc_feature (206)..(232): n is a, c, g, or t
  misc_feature (266)..(298): n is a, c, g, or t
  misc_feature (305)..(328): n is a, c, g, or t
caagagctacacaattaaaattttccttggcnnnnnnnnnnnnnnnnnnnnnnnnnnnnaatggaatggtattcccttttaaatatatccaaatttttcnnnnnnnnnnnnnnnnnnnnnnnnaacacatatatatttacataaatatctttatataataattataacatatatttatagatgagctcatacatataaccttatcnnnnnnnnnnnnnnnnnnnnnnnnnnngatgataaattttcatcttctactatatctatcnnnnnnnnnnnnnnnnnnnnnnnnnnnnnnnnncttatcnnnnnnnnnnnnnnnnnnnnnnnncaatcatttatattaattaatgacgctaatattatatataccaccatcgaatatttaatatacatatattatatcagtaaaataatcgacttcatcttcttcacctgctcctgaaaatcatgtccttgtctattatctataaagtctcacctccccactgcc

SEQ ID NO: 11373 - DNA, 649 bp, Diabrotica virgifera
  misc_feature (2)..(177): n is a, c, g, or t
  misc_feature (179)..(218): n is a, c, g, or t
  misc_feature (220)..(291): n is a, c, g, or t
  misc_feature (293)..(328): n is a, c, g, or t
  misc_feature (335)..(445): n is a, c, g, or t
  misc_feature (456)..(468): n is a, c, g, or t
  misc_feature (470)..(550): n is a, c, g, or t
  misc_feature (552)..(572): n is a, c, g, or t
  misc_feature (574)..(601): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnngattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgatgagnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnannnnnnnnnnnnnnnnnnnnnnnnnnnnaccgctgaattttgaccgtgctaggtaacataatcattacgtttttta

SEQ ID NO: 11374 - DNA, 961 bp, Diabrotica virgifera
  misc_feature (39)..(87): n is a, c, g, or t
  misc_feature (128)..(158): n is a, c, g, or t
  misc_feature (180)..(207): n is a, c, g, or t
  misc_feature (225)..(245): n is a, c, g, or t
  misc_feature (247)..(273): n is a, c, g, or t
  misc_feature (316)..(345): n is a, c, g, or t
  misc_feature (354)..(403): n is a, c, g, or t
  misc_feature (409)..(456): n is a, c, g, or t
  misc_feature (494)..(570): n is a, c, g, or t
  misc_feature (575)..(596): n is a, c, g, or t
  misc_feature (601)..(620): n is a, c, g, or t
  misc_feature (795)..(814): n is a, c, g, or t
  misc_feature (820)..(852): n is a, c, g, or t
  misc_feature (864)..(903): n is a, c, g, or t
  misc_feature (926)..(957): n is a, c, g, or t
cgccgccaattcccgccgccgtctcctcccgcccgatgnnnnnnnnnnnnnnnnnnnnnnnnnnnnnnnnnnnnnnnnnnnnnnnnntattttgatttaatagtaattattgagaaataatgattatnnnnnnnnnnnnnnnnnnnnnnnnnnnnnnngttccttgtgcctcgcggatcnnnnnnnnnnnnnnnnnnnnnnnnnnnntctaatttacaaaatctnnnnnnnnnnnnnnnnnnnnngnnnnnnnnnnnnnnnnnnnnnnnnnnnatgtattgaaatgtgatacgttattcaaatatatctaatatcnnnnnnnnnnnnnnnnnnnnnnnnnnnnnncattatacnnnnnnnnnnnnnnnnnnnnnnnnnnnnnnnnnnnnnnnnnnnnnnnnnnagcttnnnnnnnnnnnnnnnnnnnnnnnnnnnnnnnnnnnnnnnnnnnnnnnnaaagaatatttcatattcatataatatgatatgatatnnnnnnnnnnnnnnnnnnnnnnnnnnnnnnnnnnnnnnnnnnnnnnnnnnnnnnnnnnnnnnnnnnnnnnnnnnnnngatgnnnnnnnnnnnnnnnnnnnnnngaatnnnnnnnnnnnnnnnnnnnngtattaataaatgagaattacattcaacatcattttctcctcctgattattaacatcacgtcttgtattatatataaagactctctgcccccagctgaatatgaatgtgcgcgcgatattgtcaccgctcaggtaacctatactctaatttttttaatgaaagcttgaatgaaannnnnnnnnnnnnnnnnnnngtctcnnnnnnnnnnnnnnnnnnnnnnnnnnnnnnnnncaaaagcttacnnnnnnnnnnnnnnnnnnnnnnnnnnnnnnnnnnnnnnnncattattaataggttttttaagnnnnnnnnnnnnnnnnnnnnnnnnnnnnnnnngggg

SEQ ID NO: 11375 - DNA, 843 bp, Diabrotica virgifera
  misc_feature (467)..(486): n is a, c, g, or t
  misc_feature (642)..(662): n is a, c, g, or t
aagaaaaattatgaggccatataattaacaccagacggttatgggcaatatagacagtatagattggaacatagtgtgaaatatctatgttgctcttgaacataattttaaaggaccttttgactgatgataagtatgtctgagaatttataggatatgaatcttcctgccctaaataaagactctacaaaaatttggcctgtactaaaaaggaaccaaacacatttttttgggtaactaattcaaaatcaaatgagaaataaataccagaacataaaataagatgagttcctcaaataaagaatggaggcttcttcagccaacgaggattttttttgccaacagatacataaaataactgatgggtgcacttgttttaaattgctcaactcttagtttttaccagattttgtcagagttagtatattttaaagatttttcactattaaaattgtcagatatttacnnnnnnnnnnnnnnnnnnnntaaaacaataattgattgaaatattgtttaaatataagcgagtcaacaaaattttttcggtttaaaataacattagcttaaaaaaacagttttccaaataaagttatcattccactaatcgtattgacaattgactactataagtttattacagcnnnnnnnnnnnnnnnnnnnnntgtttgatctatacctaatataggtatccttcatttatcggtacgagatgtcatggaaccgtcatttatatgtgctcgaaataattgtatatcaattttagaactgtctaatgttagcaattcgttgttaaaatttaaatgcgtatttttgttgccactagaataaatgatggtggaatgc

SEQ ID NO: 11376 - DNA, 775 bp, Diabrotica virgifera
  misc_feature (78)..(97): n is a, c, g, or t
  misc_feature (99)..(118): n is a, c, g, or t
  misc_feature (147)..(159): n is a, c, g, or t
  misc_feature (162)..(175): n is a, c, g, or t
  misc_feature (209)..(235): n is a, c, g, or t
  misc_feature (295)..(344): n is a, c, g, or t
  misc_feature (400)..(438): n is a, c, g, or t
  misc_feature (453)..(476): n is a, c, g, or t
  misc_feature (554)..(572): n is a, c, g, or t
  misc_feature (586)..(605): n is a, c, g, or t
  misc_feature (623)..(639): n is a, c, g, or t
  misc_feature (641)..(668): n is a, c, g, or t
attttaaaataatagaatatctttcactaaaagtaaagaacaacctctatttactgctagttaattagcattgtgacnnnnnnnnnnnnnnnnnnnngnnnnnnnnnnnnnnnnnnnnaccttgctgcatcagaggatcatcacccnnnnnnnnnnnnnccnnnnnnnnnnnnnncaaaacagctaaaaaattagaatttttattgtcnnnnnnnnnnnnnnnnnnnnnnnnnnnccctgaaatgttattctgtcctcacatatatctacttctttaagaactaaatcaacttcnnnnnnnnnnnnnnnnnnnnnnnnnnnnnnnnnnnnnnnnnnnnnnnnnncctatttttacggatgagcttcccaatacacctctattaaaatccactctttcacnnnnnnnnnnnnnnnnnnnnnnnnnnnnnnnnnnnnnnnccatcatttatcccnnnnnnnnnnnnnnnnnnnnnnnntataaactccttattacaatataaatttacattatttaaatttagtactgctgataatattactatcacaccattgcnnnnnnnnnnnnnnnnnnncggccccactaacnnnnnnnnnnnnnnnnnnnnctcacctgtctattaccnnnnnnnnnnnnnnnnncnnnnnnnnnnnnnnnnnnnnnnnnnnnncaccttgaatggccgcgggattttgaccgcgctaaggtaccataatcattagccctcttattcgaagctggaatgaacgcctggatgacaaccacactgtctttatt

SEQ ID NO: 11377 - DNA, 160 bp, Diabrotica virgifera
  misc_feature (2)..(31): n is a, c, g, or t
  misc_feature (33)..(56): n is a, c, g, or t
  misc_feature (58)..(87): n is a, c, g, or t
  misc_feature (91)..(154): n is a, c, g, or t
cnnnnnnnnnnnnnnnnnnnnnnnnnnnnnncnnnnnnnnnnnnnnnnnnnnnnnncnnnnnnnnnnnnnnnnnnnnnnnnnnnnnncgcnnnnnnnnnnnnnnnnnnnnnnnnnnnnnnnnnnnnnnnnnnnnnnnnnnnnnnnnnnnnnnnntttttt

SEQ ID NO: 11378 - DNA, 718 bp, Diabrotica virgifera
  misc_feature (65)..(89): n is a, c, g, or t
gcgcgagatatatgaaactttatacttaatctgttgggattagagcaggaatggtaggaacttcnnnnnnnnnnnnnnnnnnnnnnnnnttaggaaggcccggatcgttaattggaaatgaccaaatttataatgatattggtacagctcatggattaattataatctataatatagtattgccaattataagtggtggtaatggaaatagacgtggacccataatatatgattgctcccgatataacattccctctaatacataatataagatttagattgctgcccccgactcttgttattataactatctttaactaataaactggagcaataacaagatcattaacagaacgaaatttaaatacatcaatatatgatccaaatgaagaaggggatccgattctctatcataaaggatccagattttacggacatcctgaatgatacatcataattctaccaagattgggatcaatatctcatacagtgagggaagagagaagaaaaacaagaccgttagaaacttgacgaataacatatgatacaatcagcgaatgactcacacgttctactgctggagctcaacatataaggacagcagcaatggacgttgatacccgaggttatatcacctcagcaactagaatcattgctggaccaactgcaataagagcatctagatgagtagctacttatcatggaactactattacat

SEQ ID NO: 11379 - DNA, 743 bp, Diabrotica virgifera
attatttttgagggtgccaaatgcttaactttgagtataaactttcagattacagtgtctagagagtagtggcgaccgaagctgccaggatgatctaaagtgtattattcgctgatgacactacacttatagcattaaacgagctcgaaatgtttgatctcctgcgaagagttgtgtacgaaatgaataaagatgactctgtaacatcaataaagatgacacaaaataatgatgatacatatattccacactattaaactgactaaaatgcatacaggaatagcaaatatatggacaggatttggctatctcgcctctcaaattactatcaatcgtaactgagaagaacaacctcggatactcattgatattgcaataattccatgagtcacctaactaaagattacaaagaccgagctatctctcataatatcacgatgaaagtgtggaatgcccctgtattctattatttctataccttgtagagacttgaacttgctccaattattgatacctatagagatgtgctggagaagaatgctgctaataccttgaacatctcatacgacaaacgtttccattctaaatcaactcgagattaattgaaggatgaccacaagatgacttctactaattctgcaattattctcacacgcgcctctcagaggtgactacagtttgaagagattaattgtttctgcaatcgttcggtcgacaacatcaagaggacgatcaccgactat

SEQ ID NO: 11380 - DNA, 777 bp, Diabrotica virgifera
gagctatatgatagacgcctgtggattttattatagattaattaaaatagtagatgctcaacgtggaagaacatgaactacagcccaatgcgtagaaatatgaacatagggtatcaatttatgactgtagtcattatgagaaagcaatatgaaatcgcattccgtcacaattaaactttgataaaaagtcacaatgaggttactacacggcacctttgatttgctgtggttctgctatctaattttcaactactagaaatccaccttcaaatccagtgggaaattcaaatccacagagaagagtacttccagcctattttactacaaatttagctcttcctgacacaagtacctgtggttttcagaaatctgatgagaactataatagtaaaggacttatttatggacgagaaaagaccgagttgaaatatttcccttggatggccttattaagttactgaacgagatacgaaacaactaagtgtgcttgtgtaggtacactaattagtcacatatatatcttgacagctgcgcattgtgatacaggcgaggattcaaccgctgttggactacttacgatacgtctaattgggtgaacatgactagtctagagatatagactgtgattcgaatgtaaattgaaacgagaaagctgtaattactgatattgacagagtcatgttccttgagtagcatgacactactgacagatctagtccctatgacattgctgtcttactcctaaatcccaggattacctatacagacttcattaga

SEQ ID NO: 11381 - DNA, 228 bp, Diabrotica virgifera
  misc_feature (35)..(73): n is a, c, g, or t
  misc_feature (93)..(106): n is a, c, g, or t
  misc_feature (109)..(131): n is a, c, g, or t
  misc_feature (139)..(161): n is a, c, g, or t
  misc_feature (191)..(222): n is a, c, g, or t
ctccttcacgcgtccgttaccttagggataacagnnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11382 - DNA, 685 bp, Diabrotica virgifera
cgtaaatatatgtaagcgacaggatcaatatcattaatctgcactagcgagcgtagtgacatattcatcggcagacaatatagtaaataggttggaagaatcagtctatttatacaagagcattactagagtgcttgctcggctgacgacgtaatagtaacacactctattccatactagccactcctactatcgccatcgacatatgttaccagcaaaagctatcgatatggtcaacataagctacctattgtcgtcaggaggttatagcaaaaggacacccattacacaaacaatatgccgagctcccgagagatacctacacaaggttgatattcactagaaaaatcctatcaaaatgactgataaatgattactaccagctcacaaataccctatagatttctgtatgctcgcaaatgctttatggatccgaaaggtaattcgatgaaacaactccaatatcaccccatgagcaatatcgtacgttgtaggaagatattgaatgctcgataaatctgaatggcgatattatgcgaaattctcttgatcctcattacagccatttgatgcacgatcttcgtgctcaaatctcaactcttgctcctcccgatgatgttcatgctatggattatactgctctggtaagaccaatcatctgatatcataatcacgataatttcct

SEQ ID NO: 11383 - DNA, 447 bp, Diabrotica virgifera
gaatcacaggattatagggctcaaaaaccaattcagacaacagtacatctttatgccgaatacgtacacagactctatcatcttcgcgacacccatcaattactatagtgaatatataaataacatctagttctccacgccttgtccgactgtgaaacccaaacgctattcaaatatttccgaaaacggtgaagacgttatcatatcagaactttcaataaattgggaatacatcctaaccgcactagatcaacacatcaatagtgtatctccgaattcgccattagaatactgtgtattcctacatgccttgcatttatgtcatcacagaacactacagataaattatctaaaataaggccataacataattccagtcagagaatcaagtatcatgcgcatttgaaatatgtgtgaataaatctcatgcacgtgaccgtacaagat

SEQ ID NO: 11384 - DNA, 799 bp, Diabrotica virgifera
  misc_feature (2)..(798): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11385 - DNA, 731 bp, Diabrotica virgifera
  misc_feature (21)..(44): n is a, c, g, or t
  misc_feature (152)..(171): n is a, c, g, or t
  misc_feature (203)..(222): n is a, c, g, or t
  misc_feature (682)..(699): n is a, c, g, or t
ccccttctcacgcgtccgacnnnnnnnnnnnnnnnnnnnnnnnnccatttgttaggagcagtaggaaaaattgtattcaatgatggatacttagggattgcgacagaacattttatttctataaaagaaccatgtattttttgaaccttgcnnnnnnnnnnnnnnnnnnnngtagttatgtattgatgacttgctaatttccnnnnnnnnnnnnnnnnnnnntattatggtaaaatcaatattctaaacaattatcctgaaatgcaccggtacccgtttataaatatatcccatcttttgggaccttaatcaccgtaagttattaacgatatctatataattagatattcctgcttatctagtactctacacttttacggatgagcttatgaaatatgactcctattagaacctcatattatctgtagacacttatgcttaatcattttcatatcccaaaataccttgttatatatgtctatatatcattattactattttgatataaatttcttattaaagatatcaaacttggagactatttgggtttcctagtcatgaccgtactctcatccacagattgaatatttacataaaatatatacctcttaccagaggaatgcctacacctttgtctcacctgtgcattaaaagcatgtctttgtgcattacatcacagagnnnnnnnnnnnnnnnnnngatttgaacggacgcaccattctgaccgtgct

SEQ ID NO: 11386 - DNA, 630 bp, Diabrotica virgifera
cttaaacgagtatacctgattcaccctgctggtaaaatgacgaaagaataatcgagggaccacgacgttgaagctctagacgttaccactgcagccggtatgagtgcaggagctttcttcgaagatgacgaaacccgattacaaatcccaactctccctacaccaatatcggaatctttcgacatggcagcccaggtaccaaaagatattttgtcagacattgctactccaattgaataactatccacacaatgaataactacaatggcctccacttccctaccctctgaaatggtatcccaacactctggctttttgctccacttgctgtccatgcaattcttaaaatagttcaacctgctacacaacttacatctaatttatctgatatcaaaataattaagatgcttgaaggctacggtagaacataccgaactaccacaatgaatgtatttccctcaaacatcttcacatgtctctttaccaacaaagattgggaattctatagtactcttcatacggtgctatatatcacctccaaaaacacatatggaccactctgtcattgttactgattacgctgatatggatagagtattattgaacgacaaactatatattatgaatatt

SEQ ID NO: 11387 - DNA, 818 bp, Diabrotica virgifera
  misc_feature (48)..(74): n is a, c, g, or t
cctttttccaccgcgtccggtattatccatcatttggtgttgttattnnnnnnnnnnnnnnnnnnnnnnnnnnnaatataattcaaacggcgaggactattatggcgacaaaagaaaaggtggagaagagtcgattaaaagagattctgaggctgctggcgacaacgaagaaaacacatcaagccaaagagcaagcgaatatgtcaaagaattgttagcggaaaagctatcgattgatcaacataagctacctaatgccgttaggttattacaacaagaggtcaccaagacacaatcgataggccgagctcccgtgagagacataaaatatgttgatatttacagggaaaaaccgatcaaagttactgttaaggtattagtacctgttcgggaataccctaagtttaattttgttggaaaacttttgggaccgaaaggaaattctatgaaacggctccaggaagaaaccatgtgcaagatggccgttttaggaagaggatcaatgaaagatagagctaaagaggatgagttgagaaattctcttgatcccaaatacagccatttgatggacgatcttcatgtagaaatctcacctcttggtcctccagctgaggctcatgcaagggtagcttttgctctggcagaggtcacaaaatatcttataccacatagcaacgataatattcggcaagagcaattgagagagatgcaattattttccgatagagaaatgatacccgagccacgaagacctcctccacctcatcacataagaccatctaatccgatatcccgaggactccctccacctcatgcaa

SEQ ID NO: 11388 - DNA, 649 bp, Diabrotica virgifera
  misc_feature (58)..(86): n is a, c, g, or t
ccctgcgtcatgaaaccaaaagattttgaaactaacgtatgtgtttcagtattctgcnnnnnnnnnnnnnnnnnnnnnnnnnnnnnttcgaccctacatccagtcatcacttaccattaaactgattaaaaacaggaataggaccataaattagtccatctagattttgattagtcccctctggttggaatgatttatggataaagaatattattacattagataaagagttggtagtcttgactgttgactacatatctcaagggagagcattaccatttatctcacttatcattttattctcatttattaattcatcttggattattcccgtaattataactgcaacaagacatataactttaacatgatcaatacttataccattatggatgagactcattattaatggatgaatcagtgagactattcctctattagctcagtgagtgcctcaaggaactcctccgctgtttccaccatgattagtaggcaatgagactatcggaaatgcaattcgcgctggaccattagcattacgtatgactgcatgaattatcgctagagacgttgcactaactcttttaggacatactggaccaatagcatcactctagatatgagatagccgaagtattgactatatgtt

SEQ ID NO: 11389 - DNA, 845 bp, Diabrotica virgifera
  misc_feature (424)..(439): n is a, c, g, or t
ccgtaaacgcgtccgctttcttttcccggtgtcctttattacggagagatattacataattgcctattgcattgtatatatgaattctttctttgtatattattcactactttactccttgtcaccacaatatcattcgcgttatattggcattttttatgcgtattgcattacgaatataccactgcctaaagtctccttacatcctacaggccagatgaaaatatattaaacctactgaatgaaccttttccgcttcaacatagtattgaatataattttctgtcaacacaacatcatccgaaccctcggaactgttaaacacgttataaaatcaacaagccgaactaaaccgagtgctagatactattgtatcgcctgtcgaaaaatacgctaactttcggagcctacgttgcctacagannnnnnnnnnnnnnnnccattgcatcaccagggggtattaaccctccccgttgcgatgccactgtgcacctctatacacttagacccttacccctcagacaccttatcacttaccgtactctattctctatcctctaaataaactaccccacttagattttagctacaactatctatataaattcttaaccctatctaataaaaagataacagataatgtaggggatacttcaaatttaacccaccttcgcttgtgtggactggatctaagagaactaccagctagatatattgattgtcttactgcattgaaaggtctatctctagcagataatgaattcgaactcatccctacagatccttacaccgtggaacatctgtacttatccgataatcaattcactttcatctcacctatatat

SEQ ID NO: 11390 - DNA, 673 bp, Diabrotica virgifera
  misc_feature (43)..(63): n is a, c, g, or t
  misc_feature (410)..(429): n is a, c, g, or t
ctttacttgtccgtttttttttctccaacccttcattccagcnnnnnnnnnnnnnnnnnnnnnttatatgactcttgtcgaaagaacaaggatatatgcttcttgtaagaaatagagaatcgaaatataccaaaatgatggtttcctatgaagatgattcattatgaggcatcttcccttcactagtatctctactctaaaaagtaagatagtcgtgacttacaatagcaaaaatgattttttcatggatctgcatatagtctctgagcttactaagttcgctcacatctgcattactgatatgaacaaacctataggccacacgtgattaacagaagattaaagctctgtcatcacaccttctgcaacatattcctggtgattactgaaaactgttcagtactattcannnnnnnnnnnnnnnnnnnnatggtaaagacatagcagaagtcgccatatcaggatggacaccataagtacacctacattatatggatccatcccagctgtagtctcgttgtactcttctgctacttaccactgtcgtcgttttagtctcccgatatggcgacaaccacaccgttgctgtactctgtaagtcactctcttcgccactccatgctccgattgatcttgagaccgccgtgatttggttaactacctgataaaaatt

SEQ ID NO: 11391 - DNA, 799 bp, Diabrotica virgifera
ggatttttggggacgatggttatcaaatataaataaacaaatttgttatggcttttcctataaaagcacctaaaagtagccgtgcaccttcaaaactttcctggatgtttttattttcttttatatagaagtagtttagtattaacgaaacaaattaatagatggaaatcacatcaaccatagtgccatactctgaatctacaattcatagttgactggagaattaatttcagtccgtaacacaatttttggaggaaatgcaaagtaattctaaagaaggagggaggaggtacagtttgggacccccaaatgggcaactgccttacttgcttcaaggagcccacgcagacggccctggacgacccaataactcataaaaataaagaagtatctcgatgtcatctaaatataatctaaataccatcaacctcaattagaaatgactgaagcccagctgtatccagcaccgagtcatgtaccagctcccactgcccctccagagacgattctaagtaatggaaaccatttgtccgctccaccagaagtgacaaccacaacaattagccgtctttatccgtctagtcgaagaacttattctaaatccgccccgatcatgggtacctcagagagcaaaccttccgaaactaagctaattaatctttttgagcagtacaaggataattgcgacgatagcattctggcagaaggtattgagcaattctgccaagatctacagatatctcctgatgatttcaagattttagtactagcttggaaacttaatgccgaacagatgtgc

SEQ ID NO: 11392 - DNA, 586 bp, Diabrotica virgifera
  misc_feature (292)..(313): n is a, c, g, or t
  misc_feature (342)..(366): n is a, c, g, or t
gggggggtaaggagaagagaggctcccctttctacaggcataggacaaatatctgaacttaatagaagaaaaatcatgggtgagagtcagcacattgtggatatgacaaccccgccagagctttcacgtatttgacggcgggacacggaggcccctttatgttagaatacgaaacttatatctatgaattttcctcgctttgaacgcgaaggctatccctgtagcagaactcacgctatacgagaggatgattacgtatattttgaatgtacaacttatctcacaaaaaacnnnnnnnnnnnnnnnnnnnnnnccatccgaagaaagaccccaatctataannnnnnnnnnnnnnnnnnnnnnnnntcggtataaacagactctctagaataaccataaagtgcctctttagaagactctattgcgagggaaatatatttacataggcgttcttaaactggcccatcgactgtatggaagatatcattatctacgatatctttatctttactcgatggatatatctacatagtcacctttacgaccgtagctcttctgggtacttactgattgtcacgatttttac

SEQ ID NO: 11393 - DNA, 739 bp, Diabrotica virgifera
  misc_feature (19)..(192): n is a, c, g, or t
  misc_feature (194)..(297): n is a, c, g, or t
  misc_feature (308)..(466): n is a, c, g, or t
  misc_feature (468)..(490): n is a, c, g, or t
  misc_feature (492)..(519): n is a, c, g, or t
  misc_feature (536)..(555): n is a, c, g, or t
  misc_feature (580)..(611): n is a, c, g, or t
  misc_feature (693)..(727): n is a, c, g, or t
tgttaattaggtattgtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnncnnnnnnnnnnnnnnnnnnnnnnnnnnnnataataagggaattcannnnnnnnnnnnnnnnnnnnctattagaaacatgtctatttgtgnnnnnnnnnnnnnnnnnnnnnnnnnnnnnnnngtttggatgcgcgcggtattttgaccgcgctgtggtagcataatcattagcctttttattggacgctggattgcatggttgnnnnnnnnnnnnnnnnnnnnnnnnnnnnnnnnnnngtattttatttt

SEQ ID NO: 11394 - DNA, 655 bp, Diabrotica virgifera
cttatgtataatcgctgtctaactacgatttatatagtgcactcaatatatcgcacaggtattttgttctgaactgacactatcttttggatgtctctaactgctactgacttaaataagactcaatgactagcctgatatatatagttttttatttcttagatcattatgatcaaatatttggaaacgattaccttaaagattagagttcattacaatttaactcccagagaagaatcagatggagctcctctcatatttaacagtgacgactcaatcaaattttatattatcaactttattacatcgatcttgttgacccatacatagaaaaacaatatgtaaggtatgaaggaggcatcacaatgcaatctacagaccgtacattaaacgataatatcgaatcctagtaagagaaatcgaataatgttctttttcagcctgttgattcacaagaacagatgctattgcgtatgtaaatataagagcactcgcctgacgactgatcacttggaacggacgcgactttatgcaccgcgtccttgtaacactcatcctgagccattattattcacatctctggtgaaggccttcttatagataaaactgctttaattctactcaattattatatgtacttaataagcttttaagc

SEQ ID NO: 11395 - DNA, 272 bp, Diabrotica virgifera
ggacagtggctctccagtactcactttctccagcaccatgttgtccttatgtacaatatcaagttttatatactcatagtaaattatagtttaaaaattgaatagatacattaaggacaccataggtaatttgaatagcttttttgtacatttttgtacgattttaaatttttatatctatacttacatatttatgtgttttaattttgtacaaatgtattgttcaaatacttttgtggaatgttaaataaagttaaaggatgaacaacttc

SEQ ID NO: 11396 - DNA, 594 bp, Diabrotica virgifera
  misc_feature (6)..(438): n is a, c, g, or t
  misc_feature (447)..(515): n is a, c, g, or t
  misc_feature (517)..(546): n is a, c, g, or t
  misc_feature (548)..(563): n is a, c, g, or t
aatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattatnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnngnnnnnnnnnnnnnnnncaatgaatggctggatgaaatagaaactgtc

SEQ ID NO: 11397 - DNA, 749 bp, Diabrotica virgifera
  misc_feature (238)..(258): n is a, c, g, or t
  misc_feature (337)..(356): n is a, c, g, or t
  misc_feature (421)..(469): n is a, c, g, or t
  misc_feature (609)..(629): n is a, c, g, or t
aaaaaagaagcttttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 11398 - DNA, 649 bp, Diabrotica virgifera
  misc_feature (187)..(205): n is a, c, g, or t
ctctctcacgcgcccgcgaatttataggacgctgtatatctgcgattttcccgctgcactaaatgttttgcgtaattagttctgtactgaactgtcacgctcttttggatgtatctaacttcgtctgacttaaataaaactcattgattagccttacatataaaatttgtcatttcctgtatcatcnnnnnnnnnnnnnnnnnnncacgatctaccttaatagcagaagtttattactattaaattctcatatatgaatcagatgtagctcctctcatatttcaccgtgacaccacaattgtttctgatattatcattttgattacatatctcttgctcatccatacatgaattacaaattttaaaggttttgaaccctcgatcacattctcatctacatatcgttcatttaatcactatatataagcctcgtaaacagattataacatgttcttctgagctcgttattctaaaccttggttagtgcatgaaatataacagacacgtctgatgcctgatcacatgggatggacgcgtctttttgaccgcatctattgtacaactcgtccttgtccattattgttctaatcgctaataaacgccttcttattggtaaaactgctttgattctctcaacgacgatttttat

SEQ ID NO: 11399 - DNA, 807 bp, Diabrotica virgifera
  misc_feature (43)..(88): n is a, c, g, or t
  misc_feature (276)..(295): n is a, c, g, or t
  misc_feature (329)..(391): n is a, c, g, or t
  misc_feature (403)..(495): n is a, c, g, or t
  misc_feature (497)..(533): n is a, c, g, or t
  misc_feature (536)..(561): n is a, c, g, or t
  misc_feature (578)..(612): n is a, c, g, or t
  misc_feature (622)..(640): n is a, c, g, or t
  misc_feature (642)..(656): n is a, c, g, or t
  misc_feature (658)..(674): n is a, c, g, or t
  misc_feature (676)..(704): n is a, c, g, or t
  misc_feature (706)..(752): n is a, c, g, or t
  misc_feature (768)..(794): n is a, c, g, or t
cctgcgggccccgccccggacccccgccctctacccacgcgcnnnnnnnnnnnnnnnnnnnnnnnnnnnnnnnnnnnnnnnnnnnnnngtttagtaaatgtcaataaaaattttgtttaatgacagttaattcgtattcgtgagagaatattttctttttctaaaagaacacctgattttttgtacctggcgtatccgggattattaattactcaccatatctctattattttcgaatgtacaagagctaaaaacctaaaatttttatcgtaaacnnnnnnnnnnnnnnnnnnnncttgtaatcgaaatcgttattcatttttaaatcnnnnnnnnnnnnnnnnnnnnnnnnnnnnnnnnnnnnnnnnnnnnnnnnnnnnnnnnnnnnnnnctttatatcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnccnnnnnnnnnnnnnnnnnnnnnnnnnnccaaatttatatcatcnnnnnnnnnnnnnnnnnnnnnnnnnnnnnnnnnnnaattgcctcnnnnnnnnnnnnnnnnnnnannnnnnnnnnnnnnntnnnnnnnnnnnnnnnnncnnnnnnnnnnnnnnnnnnnnnnnnnnnnncnnnnnnnnnnnnnnnnnnnnnnnnnnnnnnnnnnnnnnnnnnnnnnncttgaccgcgctaatnnnnnnnnnnnnnnnnnnnnnnnnnnnatagctggaatga

SEQ ID NO: 11400 - DNA, 856 bp, Diabrotica virgifera
  misc_feature (535)..(556): n is a, c, g, or t
cgcctcccgcgcagtaccaggtgcataatttttttcatgcttatatttctataagggaagatatatttgtggtaaaaattgtctttctactgcttaatattctagttggtggaggaacggtgttcatatgcaaatccctttgtaatctactaaaacaaaaagggtatggggtacctgtgatatctcgaatgccatgcattcacaggatatcatgtgaacgaattacaactaatctgtgacttccaaaagataccaaagcatttgtgaatctatctggtcaaaatgttatggacatatcaagaatatggacatgcaggaattcaaacagaatgtatttcattctagagtaaatactacaaaaacattatcctctttaatccataagacacatgaaaagcctaatgtttttgttaccatatcaggagttggggcctacaagccaagcacgacatcataatatactgaagatagtgtcgtacaaccatttgactttttttctggattatgtcgagactgggagaatgctgcacaattnnnnnnnnnnnnnnnnnnnnnnagattatctactattcgaagtggtgtctatttaggtagagatggtggaatgataaaacaattgtatctcccattctttttgggattggggggtccagttggcagtggttctcagtttatgccatggattcatattgatgacctaacacatttgatcctgtttgctattgaaaatcccatagtggatgtcatattaaatggtgttgctgctaaaccatgtaccaacctgtaaattttctaaggcatttgccaaggcgttgaaaagacctgctatatttcctgtacaaacttttgttttaat

SEQ ID NO: 11401 - DNA, 282 bp, Diabrotica virgifera
  misc_feature (50)..(66): n is a, c, g, or t
gttctggaagattatcatctggccactcaaaagtagtaaagcttggcagnnnnnnnnnnnnnnnnntatctttgtactcgaatttctgtttgctcgattctggatcaaatcctccttcaacgccaattgctaaacgggtgattttcttttctggaccatctccctgtggtggtgactgaatctcaaacttttctctttttaaatgcaaaaataaatattactggctacattcttttctaggcttgatttactaattgaggtttatattaagaaagttttttt

SEQ ID NO: 11402 - DNA, 673 bp, Diabrotica virgifera
aggatttaatatacatgaaatatcgctcactagatgttcacagaggcccatgataaacatcctcactcaacaaatcttcaactctcgtggaacccccaccgtcgaggacgaactcgacaacgatttgcaaatagaccttagcatgctgtacctgccgaatccagtactgccaaccacaaggctcttaaacgccctgactacgtaccggaaaagtaccactactaaggagtcatatctgccaacaacaacatcaattccctaatctcaccggaacagcacaaatgatggcgatacaggatcgcacggaaaaaaacttaacctcccatggaaatgctctacgaaacccaaagctaataccaaccgcttccccattctcactggattatgtatctgaccatcgccaaatacgtaatccacaaaaagaaagtacctgcgcacacacaattgactattctggctcatgactaatacaacaacttggccgatcctgcctaccctatggtagatgagatgtcgcactatggtagctcgtaagatacgccaaatgtcatgatcctaacttcagtagctgacaacatcccacaactcatgcgcaggacactaacgctctgccatcgcctctatatatatctacatgataaattcagcttgaactctacagctgcatgggaag

SEQ ID NO: 11403 - DNA, 67 bp, Diabrotica virgifera
  misc_feature (6)..(24): n is a, c, g, or t
  misc_feature (26)..(64): n is a, c, g, or t
cattannnnnnnnnnnnnnnnnnngnnnnnnnnnnnnnnnnnnnnnnnnnnnnnnnnnnnnnnnggg

SEQ ID NO: 11404 - DNA, 805 bp, Diabrotica virgifera
  misc_feature (77)..(95): n is a, c, g, or t
  misc_feature (276)..(308): n is a, c, g, or t
  misc_feature (322)..(346): n is a, c, g, or t
  misc_feature (377)..(402): n is a, c, g, or t
  misc_feature (437)..(457): n is a, c, g, or t
  misc_feature (506)..(537): n is a, c, g, or t
  misc_feature (557)..(587): n is a, c, g, or t
  misc_feature (594)..(630): n is a, c, g, or t
  misc_feature (650)..(680): n is a, c, g, or t
  misc_feature (710)..(747): n is a, c, g, or t
  misc_feature (749)..(770): n is a, c, g, or t
  misc_feature (772)..(797): n is a, c, g, or t
ggaaaggtgggacccctggaaggacccggcccggattccccggctccttccaacccgcccgaaccttatttatatcnnnnnnnnnnnnnnnnnnngatcaaatgcgataataaaaattgatacctgaaagttaaataaaaattgatagataatattttatctatattataaaaacatgtacttctttgaaccttgtgcatcatgtaatattaatccgtaattatacatttattattctctcttttattaaagataatattttaaaactattattgnnnnnnnnnnnnnnnnnnnnnnnnnnnnnnnnngtaatgatattcgnnnnnnnnnnnnnnnnnnnnnnnnnggaaatacattctatttattccttaataacnnnnnnnnnnnnnnnnnnnnnnnnnncatcaatattaacatatttttacggatgactttannnnnnnnnnnnnnnnnnnnnctaatttttccataaaaatcacgattaaaacttctcatatttcatcacnnnnnnnnnnnnnnnnnnnnnnnnnnnnnnnnctatttctaatacccttccnnnnnnnnnnnnnnnnnnnnnnnnnnnnnnncactacnnnnnnnnnnnnnnnnnnnnnnnnnnnnnnnnnnnnncaaaaatatatacgtttacnnnnnnnnnnnnnnnnnnnnnnnnnnnnnnncttattaaacacatgtcttcttgcattacnnnnnnnnnnnnnnnnnnnnnnnnnnnnnnnnnnnnnntnnnnnnnnnnnnnnnnnnnnnncnnnnnnnnnnnnnnnnnnnnnnnnnngaaagctg

SEQ ID NO: 11405 - DNA, 594 bp, Diabrotica virgifera
  misc_feature (20)..(45): n is a, c, g, or t
  misc_feature (72)..(111): n is a, c, g, or t
  misc_feature (130)..(148): n is a, c, g, or t
  misc_feature (150)..(177): n is a, c, g, or t
  misc_feature (189)..(295): n is a, c, g, or t
  misc_feature (306)..(363): n is a, c, g, or t
  misc_feature (380)..(416): n is a, c, g, or t
  misc_feature (418)..(433): n is a, c, g, or t
  misc_feature (491)..(503): n is a, c, g, or t
  misc_feature (505)..(543): n is a, c, g, or t
  misc_feature (561)..(591): n is a, c, g, or t
aatcatggtatatattaagnnnnnnnnnnnnnnnnnnnnnnnnnngatttaatatagctaagaaattagagnnnnnnnnnnnnnnnnnnnnnnnnnnnnnnnnnnnnnnnnttgaaatgatattcggtcnnnnnnnnnnnnnnnnnnngnnnnnnnnnnnnnnnnnnnnnnnnnnnngatatgtttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatgttatnnnnnnnnnnnnnnnnnnnnnnnnnnnnnnnnnnnnnnnnnnnnnnnnnnnnnnnnnncacatataaatttacgnnnnnnnnnnnnnnnnnnnnnnnnnnnnnnnnnnnnncnnnnnnnnnnnnnnnncataaatatatatgattaatacaggaattcgacgacattattttcacctggttattgnnnnnnnnnnnnnannnnnnnnnnnnnnnnnnnnnnnnnnnnnnnnnnnnnnncgaatggtctcggcatcnnnnnnnnnnnnnnnnnnnnnnnnnnnnnnnatg

SEQ ID NO: 11406 - DNA, 750 bp, Diabrotica virgifera
  misc_feature (506)..(520): n is a, c, g, or t
aacaaatacgatcttgtcttcttgtactttgtatacgaaaatgtacacgattctagtggttacttcttaggtaacttgtcctctggaggagcacattcggaacgacctccctctgctattgatacccacttgatttactccgtaacctggacggccgctgacttcattataattgtctttgaacgtatattcactgtaatgggtggctgcgtaaacagaatcgtccaacttaacaactgtggatgatgtatatcgtgttatctggagtatcatattctaagtattctttattcgtacccccgccgcattctctttcattattctacaataactagacgatggtatattggccgatcctaacaacactcctcttgtacccgcctgtgtcattgcacatagtgaatgcactgttagtctggtatacttctcatatcccttcatatactgtccgtaggcatttcgatgatttaatgtgcacgtaatattatcaaaatcatctacaatannnnnnnnnnnnnnntagccatagtctccataaccctatgtgccttgagccgtcttcatgacagctatctcctcactgtatcagtgttactaggtgtagctgttgtatatgtacatgatcaacaaaatctcaaacttgattgagtaatttgtttgatcattgctacaggaatcgagcctcatcatcaacactctaatctatgattcctaggaaatattgaagcatatacgatgatatattcttct

SEQ ID NO: 11407 - DNA, 797 bp, Diabrotica virgifera
  misc_feature (342)..(362): n is a, c, g, or t
gtaccttttatgtattagaagcgaaacatttctcccaaagcatggatgaagatctaattgaaaggtgtatatgccccccggccatccaccgtttcttttttatagaaaaaaactttatttttagtaccttgcgtatcaaacaaacaaaagtatgccctcacctacttagaattctcaaatttagaaaagctaaaaataaataatttctatggaaaaataaaaacttacaataactattctgcaagagaaatgggatgctattactatatgaatatactgtttgatattcataccaacttatctatattgattaacgataatttgacattcacctatttaccnnnnnnnnnnnnnnnnnnnnnctctgcatgagactaaaaatccaatctgaaccaaattgaattccaatctagaagacacgagatgaacgtaccatcttatacccatgtcgccaacatctatttctatgacaccatactattataaattgacacatctattattctaaactacattaagatcattctgaattcttatggatgatcacagtaggataaattaattgcgtgtatatacagataatataggttaacgtcatccagtaccctttcatattgtgcacgtgattatgataatcgtgacgtattggctactatgttaagtatcgcctcattactgataagggagctagggccttcgattccctcccgagatgagagagagtcaacttgtctattgctgatgagagacacaagaggatagcagccagaacaaattaaatgtaatgattgattaca

SEQ ID NO: 11408 - DNA, 756 bp, Diabrotica virgifera
  misc_feature (21)..(46): n is a, c, g, or t
cggcccttctccccccccggnnnnnnnnnnnnnnnnnnnnnnnnnngttgtagattgaagacattgttgtggtgcaaattctaatgaaacatgtattcaggagttgccggcggtaataaatcatacagatgtgtataaccacatgtgtacgcattaattaagtaaacacataatcccgtgaaagatgtttccgaaatggaaatctatgaattattgacatggacaaaaaaaacataaacacatcatcatatgagagaatcacatacagaaaacgtacgcatcagaaatgctgataataatcaactatgcctgatccccactaacacaatttactgtgacggacatcttgttggaccccaatatgactacatctgcgtgaactacatggacatagagacatataatgaaaccaatgataatggattcatctataccaaatactaaactggcatacaacgtataatactaatccttctacccaaaaaaagtcaaatccttgaccctaacaatgctcaatgatgcagcataatcatacttacgaaagaatgccaccgccttctgtcatcacagctctctgcatatttcattgactcacatcgtgaagctaccgaatatgatatgaccattgctgcactccatgtattgcgtattattattgatctcgccgctgctgtcatccactatgatctacactataatggacattgtgtaagaaatatccacataatctatctgatatgttgctactatttgatg

SEQ ID NO: 11409 - DNA, 130 bp, Diabrotica virgifera
  misc_feature (4)..(54): n is a, c, g, or t
  misc_feature (105)..(123): n is a, c, g, or t
gacnnnnnnnnnnnnnnnnnnnnnnnnnnnnnnnnnnnnnnnnnnnnnnnnnnncgttgttttagtatcaaatttatttatataatcaattcatttagtttgagnnnnnnnnnnnnnnnnnnnctttttt

SEQ ID NO: 11410 - DNA, 775 bp, Diabrotica virgifera
  misc_feature (533)..(550): n is a, c, g, or t
catccatccctccgcgctttgcagcaaaagaagtaaccagacacgaaactggaggcaatgttgttatgagctgttctgtttacagtgatagaaaatattctcttttggtagctggacaaaaaagtgagtgtcaattgtacaaactgaatcctagactactcgaggaagtggaaaatatctggtaataatactcatctcaggcaacggaatacaaaaaacaaagaagttacagatgacaacaaaaacgtgacaaaagagttatattttgatgttaatgcaataaaaaatgttcaaactgactttaatgggagtgaaccattatcgaggatggtaaaaattaatcatgatgggacattattagctacaggtgatacaaatggagatgtacaaatatggaaatttcctagtatgcaacctctatttattcttaaggcacatacaaaagaaatagacgatatagattttagtatgtttgacaattatgtgattaccatagccaaagatggtttagcaatattgtgggattgtatgannnnnnnnnnnnnnnnnnaactaacatggaatcagccaggatcaaaatatttatataaacgatgaaaatgtggcgtaatagagatgactagacgagaaatgtgcactatatacaatatccaatcctatatgagtagctaaaaaacaaaaatcctatctccagcaatggatacctgatgaaaacatactgataatgtgtatagaatatgatgagagtttggcagctatagctgttcgtgatgat

SEQ ID NO: 11411 - DNA, 823 bp, Diabrotica virgifera
  misc_feature (140)..(159): n is a, c, g, or t
  misc_feature (697)..(718): n is a, c, g, or t
tgcaatctttgaaacaggaaaaaacaaaagactgcaaactgcaattttactggtgtagatgctgaaactaacaaaaatgataggatccgtggagctagtgcagatgtcttagtgtgtgtatataattaattacacagccnnnnnnnnnnnnnnnnnnnncttgctgccgaaaaaaatcaactgattttagttaattcatctgtgctgattccaaaaataaaaacatttcctttgtatcagctctagttttcgagataggtataacatacttatcaaatacttaaatattcttacatttctgtatattccaccactataattgcaatatgtttataaacaaacttaacaaattctaagacaaatgggcaaatgaacaaaaggcctattttggtggtaatttaggagatcaagataaatcctgagctccacatgtagtgtgcaaaacttgtattgaaaacttgtgacagtgagtggacgaaaggacaacgaaaatgtttaaatttggttttccaatggtatggagggaaccaaaaatcattttgacgattggtatttctgtcttgtgaatataaagggcattaatcgtcacaatcgatatacgtgaacatatcctaacctggattcagcaataagaccagttccacatcagcttgagcagatacccatttcaatatttagcagcctacctatgttaccnnnnnnnnnnnnnnnnnnnnnntttgacgaactgcagactaatagatttgagcaagacgacagtgattttgaaggcgattcaacacgtcctgagcgctttactcaggaagagctaagtgatcttatc

SEQ ID NO: 11412 - DNA, 663 bp, Diabrotica virgifera
  misc_feature (403)..(422): n is a, c, g, or t
aaattgctggagaatgtactactactacttacgaacttattacaatattgaaatctgtggagttgcgcatatagtatacaagactattatgatatatctacttatacgattatataacgctccatagtctccatcaattctctgtagaagaagaatgtaagaactttatattagtatatgaatatgcttttacggcttaaatatatgaaatatatgaagaaatgcataacactcattatagtatctatctatcaaaaaatcaacgtaataatactattaactttttaaactgatgagagaatagtaccttagatagtcgaagctgagttatcacttattgttaaaaggaaatatattatccaaaactcccatctgatggaagaggataatatctggttgtacnnnnnnnnnnnnnnnnnnnngacaaatttactcttatcacataaaaatgactctatttaaattaagtaatgactgatcaatattagtattaccgaattgtatcttctatgacaaaacatatagcgctattaaaggatataatacaaataattttcacctgaatatcacaaacatgtaattttgtatcactactctagactcgatagcccacagatcaatttgaatgggcgtctcattttgaccgtgataaggttgcataat

SEQ ID NO: 11413 - DNA, 540 bp, Diabrotica virgifera
  misc_feature (2)..(389): n is a, c, g, or t
  misc_feature (396)..(442): n is a, c, g, or t
  misc_feature (454)..(469): n is a, c, g, or t
  misc_feature (471)..(499): n is a, c, g, or t
  misc_feature (509)..(528): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttatnnnnnnnnnnnnnnnnnnnnnnnnnnnnnnnnnnnnnnnnnnnnnnncaaattattacnnnnnnnnnnnnnnnncnnnnnnnnnnnnnnnnnnnnnnnnnnnnncttggcggtnnnnnnnnnnnnnnnnnnnnctattttttata

SEQ ID NO: 11414 - DNA, 126 bp, Diabrotica virgifera
  misc_feature (2)..(57): n is a, c, g, or t
  misc_feature (64)..(125): n is a, c, g, or t
cnnnnnnnnnnnnnnnnnnnnnnnnnnnnnnnnnnnnnnnnnnnnnnnnnnnnnnnncggggtnnnnnnnnnnnnnnnnnnnnnnnnnnnnnnnnnnnnnnnnnnnnnnnnnnnnnnnnnnnnnnc

SEQ ID NO: 11415 - DNA, 95 bp, Diabrotica virgifera
  misc_feature (17)..(94): n is a, c, g, or t
agcttacatttttttannnnnnnnnnnnnnnnnnnnnnnnnnnnnnnnnnnnnnnnnnnnnnnnnnnnnnnnnnnnnnnnnnnnnnnnnnnnnnc

SEQ ID NO: 11416 - DNA, 858 bp, Diabrotica virgifera
  misc_feature (2)..(30): n is a, c, g, or t
  misc_feature (37)..(52): n is a, c, g, or t
  misc_feature (54)..(98): n is a, c, g, or t
  misc_feature (105)..(217): n is a, c, g, or t
  misc_feature (228)..(605): n is a, c, g, or t
  misc_feature (607)..(827): n is a, c, g, or t
  misc_feature (830)..(848): n is a, c, g, or t
cnnnnnnnnnnnnnnnnnnnnnnnnnnnnncttaacnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnngttttttagt

SEQ ID NO: 11417 - DNA, 619 bp, Diabrotica virgifera
attgtttccccctcacttcctccctaaagtgagtcggtgatttcgaacaataattctaaccggatttaacaattgtcagctcggatattataaatgttgaagttgaacactttagacctttggcatggaatttctgtgctattatcctacaactcaacatatcataatatatgcgtttgtaatcgacatacatacccaacaaatgtcccgcgcaataactgcgacattgcccataagaatatctccctctgattatcggaattagcacaacttagacgcagaatgtgcaacagcaagaactgtccataatgcattacaccaacttgctaaccctccactcttctaatagtcctctatgaaaaggtcatgactgtgacaccacatggttgaaaatgtgccacagttgaatacgttccaaaacaggtatattacttgattcattgtatacagtggaaaaaaaatcggcttactcgcattaggcgctatcgcgtaatcagctctgtctggcttacttctatgagccttaacatcacattttacgagaccacctctgcttcactccatcaattttatccagcatacatatggtgagaatgctataaactactatgagtatact

SEQ ID NO: 11418 - DNA, 64 bp, Diabrotica virgifera
  misc_feature (5)..(5): n is a, c, g, or t
  misc_feature (11)..(63): n is a, c, g, or t
agtanaaagcnnnnnnnnnnnnnnnnnnnnnnnnnnnnnnnnnnnnnnnnnnnnnnnnnnnnnt

SEQ ID NO: 11419 - DNA, 680 bp, Diabrotica virgifera
  misc_feature (34)..(54): n is a, c, g, or t
cgccgcgccccacccgcccgaccatattggcacnnnnnnnnnnnnnnnnnnnnnaccgagccggttcgcccatctacttgcatgattactattaatacgaccagaactatgaacgtccggatatctaattggaaatgaccgaattcgtatcgtctgtgttactactcatgaatttattatcattttttttatagttatacctagtataattggtgggtttgcaaattgaattgtacacttaatacttggtgctccctatatgctctttcctcatataaataatatctcattttggttgctttccccgactcttttatcacttgttattctaaatgatagaaaacaaggggaagtggtacaggaagaccaatttacccgtctctgtattcttagatttcccgtgacggtccatcactatatttatctatttttacagtatctttggatggtatgtcttccattttaggagattttaattgtattacatcaataatgactatgcttcctcttgtaattgtctttgctcaagtactgctatttggttgcgctgctgcaatatacaacattccttcttctattatctctacctatctatatctgtagctattcctgtatacttttctgatgcatatgtgttccatcattttttgatcctcctagtgaaggtgatactgttctct

SEQ ID NO: 11420 - DNA, 56 bp, Diabrotica virgifera
  misc_feature (2)..(29): n is a, c, g, or t
cnnnnnnnnnnnnnnnnnnnnnnnnnnnnataattaccttagggataacagcgtaa

SEQ ID NO: 11421 - DNA, 929 bp, Diabrotica virgifera
  misc_feature (2)..(386): n is a, c, g, or t
  misc_feature (388)..(751): n is a, c, g, or t
  misc_feature (767)..(786): n is a, c, g, or t
  misc_feature (798)..(816): n is a, c, g, or t
  misc_feature (819)..(892): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaggattggatggnnnnnnnnnnnnnnnnnnnngatttataaagnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnngatttattcatatgataagtttattgtattgggggtg

SEQ ID NO: 11422 - DNA, 815 bp, Diabrotica virgifera
  misc_feature (11)..(45): n is a, c, g, or t
  misc_feature (53)..(166): n is a, c, g, or t
  misc_feature (176)..(774): n is a, c, g, or t
  misc_feature (780)..(808): n is a, c, g, or t
cgtgagagaannnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttannnnnnnnnnnnnnnnnnnnnnnnnnnnnatttatt

SEQ ID NO: 11423 - DNA, 619 bp, Diabrotica virgifera
cgcgaccacccagcgcccgccccccacccgcgcggccaaaacgcaaaatgaagcagactcctatagctaaagggacgggatcatacatctgctgaaccaaaaatcttgaccgccgccaaaagtattatacaaaacggaaccgaatggtgatacggtactctatgataataggttgcaactatgatcctgccacccaaagaagcccaattactgaataaatacctgaacaaccatcctctgcttacaggacattagggaactacacgctatgtacacatgtgaactatgcgtaactactgacattcccacactcttctcgactatgaaaaaaatgccttttcaccatctccttgcaaatatacgaactccgatggcattatcaactcccggtgcgaacaaagaggtcacgatacgactgaatgattaagagatttacctgagttgactgaaggaaataacggacacactgaatctattacgaaacacaccctatcgggagacaacacatctaacatgccggtacctgatctggaatcaactatctatacaggaattactctccctgaatacttccgtgatatagaaccacagcgtaaccacaatgactgcctggacatca

SEQ ID NO: 11424 - DNA, 942 bp, Diabrotica virgifera
  misc_feature (2)..(24): n is a, c, g, or t
  misc_feature (235)..(350): n is a, c, g, or t
  misc_feature (352)..(390): n is a, c, g, or t
  misc_feature (396)..(559): n is a, c, g, or t
  misc_feature (569)..(585): n is a, c, g, or t
  misc_feature (587)..(621): n is a, c, g, or t
  misc_feature (623)..(654): n is a, c, g, or t
  misc_feature (668)..(687): n is a, c, g, or t
  misc_feature (696)..(714): n is a, c, g, or t
  misc_feature (741)..(758): n is a, c, g, or t
  misc_feature (761)..(834): n is a, c, g, or t
  misc_feature (836)..(849): n is a, c, g, or t
  misc_feature (869)..(890): n is a, c, g, or t
annnnnnnnnnnnnnnnnnnnnnngaaccggcccggaatccccgcctcttttccacgccccccgcttcgcgtatcacgcgcgattattcgaatctaatcaatatagtatgacttatactatatcttttcacaaattctaaaatgatgctatacaacaattcaaaatttgtttatttggtaacaatcaaaatatatttacaataatgttttattcgtatatgaaatctttattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaataaagcnnnnnnnnnnnnnnnnncnnnnnnnnnnnnnnnnnnnnnnnnnnnnnnnnnnncnnnnnnnnnnnnnnnnnnnnnnnnnnnnnnnnaaatgtccgcggannnnnnnnnnnnnnnnnnnnccataatcnnnnnnnnnnnnnnnnnnntctggaatgaacgcttggatgaaaccnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnncnnnnnnnnnnnnnncttttatagtattaaattcnnnnnnnnnnnnnnnnnnnnnncttgacgcgattaaaaataaatgtatcttttgttatcttattatattaatta

SEQ ID NO: 11425 - DNA, 757 bp, Diabrotica virgifera
  misc_feature (12)..(31): n is a, c, g, or t
  misc_feature (41)..(68): n is a, c, g, or t
  misc_feature (70)..(430): n is a, c, g, or t
  misc_feature (432)..(512): n is a, c, g, or t
  misc_feature (514)..(572): n is a, c, g, or t
  misc_feature (592)..(642): n is a, c, g, or t
  misc_feature (646)..(664): n is a, c, g, or t
  misc_feature (688)..(720): n is a, c, g, or t
atttattttagnnnnnnnnnnnnnnnnnnnngaaaagtagnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnagtttaataagggaattcgnnnnnnnnnnnnnnnnnnnnnnnnnnnnnnnnnnnnnnnnnnnnnnnnnnngtgnnnnnnnnnnnnnnnnnnngtaatttgaatgtccgcaggatgnnnnnnnnnnnnnnnnnnnnnnnnnnnnnnnnngtatattgatagctggaatgaatggttggatgaaagg

SEQ ID NO: 11426 - DNA, 592 bp, Diabrotica virgifera
cgcggggagatggaacatcgccggcgaaatggcgataatttgatcgttccctcacctacgcgtgatggcgaaaaaggcgcgccatacgctcacaatgttagcagaccgtcacggtatatatggagacaaggaaacctatggacaattactaggactgtgtggaccgttggtttcgaggaacccatagagctagcctatagtatactcgtgtagagtccgtgcgctacacttcaagcgaaatattagctccatgcagatacaaatagaggacactgtcaggaggggtatttgactgggattgcacgtactgtctaagaacatacgaaagtgtcctaaggccagctacagaaaccgacagaaacctcctgctgaataattggtcgtcctgtctcagggattcaatataaataacgcgagaatgagacgtcttgaaatcttctgatacatcctaatatattatattaactggacagaattttactaggtcatgattgataatgcactggcgttacccgactttgtcgtctagaagaacatcctccgtttatcaaatgtagaagtaaccaatatgcccgcatacgatttcccttcc

SEQ ID NO: 11427 - DNA, 887 bp, Diabrotica virgifera
agcagaatgataaaggatgtgcatgttttgattacaactaatgattatttttagcgttctaattcagaggattcagtttatacatctgtacagaatggtcaaaacgatatgaataaaaaacagttttttaagagttggaagttggggcagaagattgcgtttatttcgggtgtagcattattcatcattctacttctcatatttttggcaatatgggtaatatttcctctagtatttatgaattccatatcagtacaaaggttcttcatattctttaattttcgagatccgaagaatcccgaattcaacaatcctcaaaaatatggcatgaccggggtagtaaatttctatataaccaccaaagatctgatagacggctctctagtaagcatcggagcttggctgttggtacaagaaaatcagatacaatctacaaaaatcgcaggtcaggatgacaaaacagcgagtgaaatcattagaaatacaaagagtccaattgcaatatatctgcatggtgttgagtgtaacagaataaagccataagaaacgtacgaggttttgaggaagcactttttggtcatttcactgcaccacagaggatatggtgattccggtccagataaaccaccaacagaactaagaattgttggtgatacatcccaggtatttcaatggatccgagctttaacagacaacgatatttacgtatgaggccattcgttaggaacagctttaagcactcactcagtcaaaaggctcgagggacaaagtatcgtaccatccggactaattctagaatctccgtttactaccatagaggaggaaatgcctagcaccgcgttaggaaagatattttcttggatgccatggttcgcagcgactgtact

SEQ ID NO: 11428 - DNA, 261 bp, Diabrotica virgifera
  misc_feature (2)..(43): n is a, c, g, or t
  misc_feature (49)..(71): n is a, c, g, or t
gnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 11429 - DNA, 716 bp, Diabrotica virgifera
cccacgcgtccaatttggatttattccctaataatagaatattctttcagttattgtaaggaagaatcttatttattgagcagtaaatagtattgcgaaagaataatttatctttataaagagacgaatgtatcccggggagccgtgtggatcatggataattaattactacttatatattggtgctattcaaatccacaagagctaataccttcaaattttgattgcaaaaaaactgttacacatggtgctcactgtagtgcaatgttattcacatctaagcatatccacttttttactcatagcaattaaatccattgatgacccatgtatctctgattacttcccttttctattattgctagttaatatttgttggtttgagctaaaaaatctgaaactatgaataatcacttatctactcgaaattctgattatcacttctcgcatgcttacaatatctcctcataaatctccatatatcattaaatacattgctgatatattgttcaaaacaattatatgtgcctgattatttcatagtagtactgccgatcttatgcttatttgccagttgaacaatgtaaaaaatataaaaatgaacccttactgaattcgacatcatatttgtgcaccgggatacacataatctgcccgctggtgaaggataccgactcgcgactgccctctgactatccccattgctcgcagaatta

SEQ ID NO: 11430 - DNA, 568 bp, Diabrotica virgifera
  misc_feature (115)..(143): n is a, c, g, or t
  misc_feature (226)..(244): n is a, c, g, or t
gatattatgagccagctgtatttccggtgatttagttatacatgaagagtatagaaaatcattatctgaataagattatatgattagcaacttgtgtatccctggtgatgaaggnnnnnnnnnnnnnnnnnnnnnnnnnnnnntcaagtgcctgataaatgcaaaatataaatgtgaagtatagattggaaaaaattttataccaattgtaatgttatgaaattgnnnnnnnnnnnnnnnnnnnccaagatactcaagactgatagaatagcaagttgtctcagtgtgtatggataacatattcaatgagaatgagatataattacgcatcagcccactggataattactatgaaaattgaatctttctgcgtctcagatcttacaaaagttcgaaaattttagccccacggtattatgttgtatatatacttcactacatctatatttagttaatttatgaagaatgtacatccataggaaaaaaacttttcaatagcttaagatacctgcaaaatccatatgccgatttggaagctccatcttgtggatataatagtaaaaccatg

SEQ ID NO: 11431 - DNA, 693 bp, Diabrotica virgifera
  misc_feature (2)..(192): n is a, c, g, or t
  misc_feature (194)..(256): n is a, c, g, or t
  misc_feature (258)..(439): n is a, c, g, or t
  misc_feature (446)..(483): n is a, c, g, or t
  misc_feature (503)..(516): n is a, c, g, or t
  misc_feature (519)..(541): n is a, c, g, or t
  misc_feature (549)..(571): n is a, c, g, or t
  misc_feature (601)..(632): n is a, c, g, or t
  misc_feature (646)..(675): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcaatgttggatnnnnnnnnnnnnnnggnnnnnnnnnnnnnnnnnnnnnnntgttcgannnnnnnnnnnnnnnnnnnnnnnagtataaaccggtgtgagccaggttggttnnnnnnnnnnnnnnnnnnnnnnnnnnnnnnnngaaaggaccagatnnnnnnnnnnnnnnnnnnnnnnnnnnnnnnatcaaaaaaaagataaaa

SEQ ID NO: 11432 - DNA, 884 bp, Diabrotica virgifera
ccacgccgtgcaccgtaccgcggccggccctgtctcccggcccgctccacgcgatccgcatttacactcagacctcttggacaggcaaagcgggaagtgaataagggagcgagactatactgttgtcgcgttacattcctttcttgtgatgacatacggaaatgagttgtgaggagagtggcgaagaactgatgagaacacctcactcacgtctatatcatatttcgggcaatatttccgtcaacggatagcagatagtggcaaaagtagagtataaatctggcttgatacgcatgtatcacaaatgaacgacgagccccctgttaaaatatctgtgactcttatatatgagcgacagatgcgcgcaatgtgataaatacttttccaaaaaatgacaactaacatttggcgtgcataggaaaatgattatttacatttaaaaaatttgaatgatgaaaaattgaatctcaaaataaaattgaatttaaacagatttattatgatgatcatgtatgttgccatctgaatattatgaggacttaacttccttggatgcctgagaattattttccattttaaaatttatttcattgatatcttattgaggtattaatacgactttatcttgatttatactgactagatcgacgattatgatattttgtaaaggtattgtaatgcgcagcatattcctaggaggatagctcgagacataatgccgaacatctaagatatcctatggggcagattcctgctgtattgaaaaaagggtgtgcaaattagtatccactaatgctgactatgctgtttttgaatcaaagagtctgcgaattaataacgactgacgctgactgtgctgataattatagaaaggttgttaatta

SEQ ID NO: 11433 - DNA, 553 bp, Diabrotica virgifera
  misc_feature (304)..(328): n is a, c, g, or t
acgcgcgcgaattaatttaatccaaaaattttttacgcactcccagtataaatgataatgttaatgttgaatgggttgcatatgagagttaattttaaatgaagtaaaaaaacacagaaattcatactcactttaatttattttacttcgactttcggtttcacatctgtcagttactctttcgtgtattcgatattcgacttatttcaattgcttaagacgggtcctgtcacattaatagttgaaggtaagaatatatgattctatattaaaagtaatgtggatttttaacggactgccacannnnnnnnnnnnnnnnnnnnnnnnncatattaatttgtaagattttaactataatatttcttgagacatctctgaaataattttttagagatgatttcttttatgtaattattatttagttttagataactcataattcatatttctaaattatcaattgatatataatttattattacttgtttatatatacgtaacagtaggcctttccttttcaatattacttctatttttttcagctgtcgtaatt

SEQ ID NO: 11434 - DNA, 513 bp, Diabrotica virgifera
ataccaatctcgcataagatggctagctgatcttactagtgcactcgagaccgatgaacgaatggatcattaacaatatatctctgctgcgtaggcatgggcttgttgacccccggctgattagagcacgatacaacgaacaattgctcggccaatactggaatatatctcacagtataactgaaaagacggatccctcccctggtacacaaccgagattgacattcatcgtatttaccacaacacaatctattgacaaagatctatatgctagggaccatgacattaaagttatatcatccgcccccagtaccgactgatctaggcctgctaccatatttgtaagtgatctcacctctgaatagagtgatgatgtcatctgaactactatctcacgattggatccatatagatttgaatgcatccaaacccaaatacaacgaatgattctgctcataactgtgtctccaacacaagtgatagagttatcctgctgctatgaaagaccattat

SEQ ID NO: 11435 - DNA, 443 bp, Diabrotica virgifera
  misc_feature (38)..(38): n is a, c, g, or t
ggtgttaatcatcgtatgcgaatgcagactgaccgaanaatggcgaccagacgttacgcatcacatgaagattgttatgacattttatagttaaaggacgacttttcgatatccctggtaacacgcgtcggctgaaaatgtcacagactccttaagagtagcctatactgtagaaaacaccaacggccatgcagcggcctattagaggccaaaattgtctgatcgaatgataagcggccataaagtataggaccattgcaatacacaacccatactcggtgaaaggcgtgcctcaagaatacatcactatggatgatcattgcattaatcggaaatcatcgtgatttaacactcatccgtaagcagggcataactaaaagtctcccatgccttgacatctaatctgaatggcctctatggtgtgatgacttacactttctatt

SEQ ID NO: 11436 - DNA, 453 bp, Diabrotica virgifera
gaagaaattccatacggtccttacccggtcatgccttcaaaaatcttcagaataaaaaactgatcatctaccttagcagaaaccttataaccactctatcaccaaacatatttgcagatttaaagcaatgtagccaaatatggctggatagaaacgagatacgagacatacacccaaataccttttctcaaatagaatttcttgaggtattattcttgtcaggtaacttcttgagcagtgtgccaaaagatcttcttaaaaatttgaaaaatgatttagtaaccctagatttggcacataatattaatctgacgtgtcttgattatgaaattgttaaaagagtgaagttgactaatttggtaaaaattaacaagttgaattgtgactgtataaaaactttaaaacataaacttgttagtgcaaacaaaagttatgaaataaattctgattgtt

SEQ ID NO: 11437 - DNA, 171 bp, Diabrotica virgifera
  misc_feature (7)..(44): n is a, c, g, or t
  misc_feature (79)..(101): n is a, c, g, or t
  misc_feature (109)..(130): n is a, c, g, or t
taacagnnnnnnnnnnnnnnnnnnnnnnnnnnnnnnnnnnnnnntgcgacctcgatgttggattaaagtttatattggnnnnnnnnnnnnnnnnnnnnnnntgttcgannnnnnnnnnnnnnnnnnnnnnagttaaaccggtgtgagccaggttggtttctatctttaatt

SEQ ID NO: 11438 - DNA, 673 bp, Diabrotica virgifera
  misc_feature (2)..(65): n is a, c, g, or t
  misc_feature (72)..(120): n is a, c, g, or t
  misc_feature (122)..(238): n is a, c, g, or t
  misc_feature (240)..(268): n is a, c, g, or t
  misc_feature (270)..(292): n is a, c, g, or t
  misc_feature (306)..(339): n is a, c, g, or t
  misc_feature (347)..(368): n is a, c, g, or t
  misc_feature (376)..(416): n is a, c, g, or t
  misc_feature (418)..(444): n is a, c, g, or t
  misc_feature (446)..(484): n is a, c, g, or t
  misc_feature (529)..(547): n is a, c, g, or t
  misc_feature (564)..(604): n is a, c, g, or t
annnnnnnnnnnnnnnnnnnnnnnnnnnnnnnnnnnnnnnnnnnnnnnnnnnnnnnnnnnnnnnnaatcaannnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnngnnnnnnnnnnnnnnnnnnnnnnnggatgagcttaagnnnnnnnnnnnnnnnnnnnnnnnnnnnnnnnnnngaattaannnnnnnnnnnnnnnnnnnnnngaatatgnnnnnnnnnnnnnnnnnnnnnnnnnnnnnnnnnnnnnnnnngnnnnnnnnnnnnnnnnnnnnnnnnnnngnnnnnnnnnnnnnnnnnnnnnnnnnnnnnnnnnnnnnnngttgtatatctattaaaaatatatacgtttagtaaaggaattcgnnnnnnnnnnnnnnnnnnnattattaaaaacgtgannnnnnnnnnnnnnnnnnnnnnnnnnnnnnnnnnnnnnnnngttgtgatgctcgcggtatattgaccgagctaaggtagcataagcattacttatttgattgaaagctgt

SEQ ID NO: 11439 - DNA, 860 bp, Diabrotica virgifera
  misc_feature (2)..(67): n is a, c, g, or t
  misc_feature (69)..(176): n is a, c, g, or t
  misc_feature (180)..(355): n is a, c, g, or t
  misc_feature (357)..(610): n is a, c, g, or t
  misc_feature (612)..(631): n is a, c, g, or t
  misc_feature (633)..(663): n is a, c, g, or t
  misc_feature (684)..(724): n is a, c, g, or t
  misc_feature (726)..(754): n is a, c, g, or t
  misc_feature (756)..(790): n is a, c, g, or t
  misc_feature (803)..(831): n is a, c, g, or t
gnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnngnnnnnnnnnnnnnnnnnnnnnnnnnnnnnnncagggttggatgataaaaatnnnnnnnnnnnnnnnnnnnnnnnnnnnnnnnnnnnnnnnnngnnnnnnnnnnnnnnnnnnnnnnnnnnnnntnnnnnnnnnnnnnnnnnnnnnnnnnnnnnnnnnnngtttttagtatcnnnnnnnnnnnnnnnnnnnnnnnnnnnnncttcgcggtgattaaagaataaaattcac

SEQ ID NO: 11440 - DNA, 801 bp, Diabrotica virgifera
  misc_feature (304)..(325): n is a, c, g, or t
  misc_feature (345)..(396): n is a, c, g, or t
  misc_feature (403)..(442): n is a, c, g, or t
  misc_feature (461)..(489): n is a, c, g, or t
  misc_feature (504)..(524): n is a, c, g, or t
  misc_feature (526)..(559): n is a, c, g, or t
  misc_feature (577)..(606): n is a, c, g, or t
  misc_feature (647)..(665): n is a, c, g, or t
  misc_feature (688)..(722): n is a, c, g, or t
  misc_feature (724)..(740): n is a, c, g, or t
tctctctatagagagagctcgtgtacacgctctgcagtgccccggccgcgaatacccgcggcctctctacacgcgccgcgaattaatttattccaaaaatttttttgctcacccaatataaatgataatgttaatgttgaatgtattgcatatgagagataatttaatatgaaataaaaaaacacataaatacatactcactttattttatttaccttctacatccggtatcaatctgtcattaacacttgtttgtaatctacttactacttatttctatttgcttaagacgtttcctgtcacnnnnnnnnnnnnnnnnnnnnnntcgtaatgatatgttattcnnnnnnnnnnnnnnnnnnnnnnnnnnnnnnnnnnnnnnnnnnnnnnnnnnnntacatcnnnnnnnnnnnnnnnnnnnnnnnnnnnnnnnnnnnnnnnncttagggatgatcttaacnnnnnnnnnnnnnnnnnnnnnnnnnnnnnctatacatattacgnnnnnnnnnnnnnnnnnnnnncnnnnnnnnnnnnnnnnnnnnnnnnnnnnnnnnnncttattatttatcaatcnnnnnnnnnnnnnnnnnnnnnnnnnnnnnngctttattaatgatgattacattagtattataaaattgtannnnnnnnnnnnnnnnnnngcgttaataaacgaattctgctnnnnnnnnnnnnnnnnnnnnnnnnnnnnnnnnnnncnnnnnnnnnnnnnnnnncctcgtctgcccactgattcatttatatgcccgcggtattatgaccgtgctaatgtagcat

SEQ ID NO: 11441 - DNA, 874 bp, Diabrotica virgifera
  misc_feature (10)..(93): n is a, c, g, or t
  misc_feature (96)..(109): n is a, c, g, or t
  misc_feature (114)..(627): n is a, c, g, or t
  misc_feature (634)..(671): n is a, c, g, or t
  misc_feature (691)..(704): n is a, c, g, or t
  misc_feature (707)..(729): n is a, c, g, or t
  misc_feature (737)..(759): n is a, c, g, or t
  misc_feature (789)..(820): n is a, c, g, or t
  misc_feature (827)..(867): n is a, c, g, or t
aaataataannnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnagtttat

SEQ ID NO: 11442 - DNA, 63 bp, Diabrotica virgifera
  misc_feature (4)..(62): n is a, c, g, or t
gggnnnnnnnnnnnnnnnnnnnnnnnnnnnnnnnnnnnnnnnnnnnnnnnnnnnnnnnnnnng

SEQ ID NO: 11443 - DNA, 721 bp, Diabrotica virgifera
cgaatatgatgaaggtcatgctttgtgtgataataaatacattctctagttccccaaattacaaatcctatattatacaggggacccttagcgtaaagagacataaagtttcagcgatcattttcttgatgattatattttagggaacctaacctataaagctaatatagttctaaaataataatgggcatattcagcaaacacaacaccatttattacaaagaacagccatgatatctgatggaagaagacgatgccaattgatatgcgttgcaccccaagaacagaccattatttaaagcagaacctatacataaattttatgccacttatatcctattttacatcttgcgaataatccacttactgccttgcaattttttcataacacctgatgattatggtatgtgcaactttagaaatgtaatgcgctttactaatataagagatgctccccctagaagatcacctcttcaagcagaattcacatcgtaccttacattaacttcatgttactcacatttgtggtgtcttatcctcaatacaggcagtagtcaaagagtatcactatgtaacagagtgctgtgatcccttagttgtatgatgcctttaatgatgataccgctgatattcgtgaacatcaatactgatagtgggcaacgatgggtacttgtaataacactgatgacaaactatatgctgaacgtctttggccctatct

SEQ ID NO: 11444 - DNA, 825 bp, Diabrotica virgifera
  misc_feature (54)..(72): n is a, c, g, or t
  misc_feature (74)..(142): n is a, c, g, or t
  misc_feature (148)..(179): n is a, c, g, or t
  misc_feature (181)..(207): n is a, c, g, or t
  misc_feature (259)..(281): n is a, c, g, or t
  misc_feature (307)..(383): n is a, c, g, or t
  misc_feature (385)..(399): n is a, c, g, or t
  misc_feature (409)..(438): n is a, c, g, or t
  misc_feature (484)..(524): n is a, c, g, or t
  misc_feature (526)..(571): n is a, c, g, or t
  misc_feature (653)..(675): n is a, c, g, or t
  misc_feature (714)..(810): n is a, c, g, or t
tcctataaggaagctgcccgcctgcacgcaccgcggccgtgccctcccgcgctnnnnnnnnnnnnnnnnnnncnnnnnnnnnnnnnnnnnnnnnnnnnnnnnnnnnnnnnnnnnnnnnnnnnnnnnnnnnnnnnnnnnnnnncgcgcnnnnnnnnnnnnnnnnnnnnnnnnnnnnnnnncnnnnnnnnnnnnnnnnnnnnnnnnnnncttcattcatccctatatctttattattttcccatttaacagagctaaaacnnnnnnnnnnnnnnnnnnnnnnncatcttttcaataatttttttccacnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnttattactcnnnnnnnnnnnnnnnnnnnnnnnnnnnnnncaccttttattaccctttcatttttacataaacattacgattaacnnnnnnnnnnnnnnnnnnnnnnnnnnnnnnnnnnnnnnnnncnnnnnnnnnnnnnnnnnnnnnnnnnnnnnnnnnnnnnnnnnnnnnncattatttaactctaccaatgatgatactattagtattcaaaaattgtctatttagtaaaaatatctccgtttaataaagcnnnnnnnnnnnnnnnnnnnnnnncgcttattacaaacatgtctctctgtattaaatatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtggatgaacact

SEQ ID NO: 11445 - DNA, 200 bp, Diabrotica virgifera
  misc_feature (7)..(44): n is a, c, g, or t
  misc_feature (57)..(57): n is a, c, g, or t
  misc_feature (79)..(101): n is a, c, g, or t
  misc_feature (109)..(131): n is a, c, g, or t
  misc_feature (134)..(134): n is a, c, g, or t
  misc_feature (166)..(166): n is a, c, g, or t
  misc_feature (173)..(192): n is a, c, g, or t
taacagnnnnnnnnnnnnnnnnnnnnnnnnnnnnnnnnnnnnnntgcgacctcgatngtggattaagtttataattggnnnnnnnnnnnnnnnnnnnnnnntgttcgannnnnnnnnnnnnnnnnnnnnnnagnttaaaccggtgtgagcccagttggtttctatncttaaannnnnnnnnnnnnnnnnnnngaaaggga

SEQ ID NO: 11446 - DNA, 843 bp, Diabrotica virgifera
  misc_feature (56)..(76): n is a, c, g, or t
  misc_feature (82)..(120): n is a, c, g, or t
  misc_feature (134)..(156): n is a, c, g, or t
  misc_feature (273)..(304): n is a, c, g, or t
  misc_feature (311)..(331): n is a, c, g, or t
  misc_feature (333)..(396): n is a, c, g, or t
  misc_feature (440)..(460): n is a, c, g, or t
  misc_feature (487)..(530): n is a, c, g, or t
  misc_feature (532)..(567): n is a, c, g, or t
  misc_feature (578)..(612): n is a, c, g, or t
  misc_feature (614)..(629): n is a, c, g, or t
  misc_feature (703)..(724): n is a, c, g, or t
  misc_feature (733)..(763): n is a, c, g, or t
  misc_feature (775)..(798): n is a, c, g, or t
  misc_feature (805)..(839): n is a, c, g, or t
cgcctccccggaccggcacccggacctcccgtgcccctccttccccgccccctccnnnnnnnnnnnnnnnnnnnnnctctcnnnnnnnnnnnnnnnnnnnnnnnnnnnnnnnnnnnnnnngaattagtattgcnnnnnnnnnnnnnnnnnnnnnnncaagaacaatttcactctgtgcccctagtgtaccaggaataataaataattattgatatccttattatttccgtattaaaaagagctaaaaactgaaaatttatattgcaaaatacnnnnnnnnnnnnnnnnnnnnnnnnnnnnnnnncattcgnnnnnnnnnnnnnnnnnnnnncnnnnnnnnnnnnnnnnnnnnnnnnnnnnnnnnnnnnnnnnnnnnnnnnnnnnnnnnnnnnnnnncattaaatattcctaggcatgagcttcaaaatacaatttcattnnnnnnnnnnnnnnnnnnnnnaattaggatcaacaattttcatattcnnnnnnnnnnnnnnnnnnnnnnnnnnnnnnnnnnnnnnnnnnnncnnnnnnnnnnnnnnnnnnnnnnnnnnnnnnnnnnnnccaaatttatnnnnnnnnnnnnnnnnnnnnnnnnnnnnnnnnnnncnnnnnnnnnnnnnnnnggtttcataacggaattcccccacatttttttcacctgtctatcaaaatcatgtctatttgtctccagtatccnnnnnnnnnnnnnnnnnnnnnnctttgaacnnnnnnnnnnnnnnnnnnnnnnnnnnnnnnncatatcattacnnnnnnnnnnnnnnnnnnnnnnnncggttgnnnnnnnnnnnnnnnnnnnnnnnnnnnnnnnnnnncaat

SEQ ID NO: 11447 - DNA, 628 bp, Diabrotica virgifera
cgcggacccacgcaaaccgcaagtgcgcccttctggtactaaactgcgatggaaatggcctgccatacgctgcagatgcgaccatccgcgtgatgttactatgtgaccgaaagaagtttatggtgcttccgcttataacatcctgataaaagtgcctgagtccttcatgaccagtatgacctccaaaatcaacctacgctaaccctttcttttggtcactcccctgtccaatgaccttagaggagcacccccctcatgcgcactctaataagaacctgaaattatatgtacctctacatactactgcactgttcccaacaaatctactcattgttctcactatccttactccgaaccacaactacaggaatacgctcatcaagatcttacttagatgactatctcctcacatacaatcggtgaatatcatcttgactattctgcgagtatgcaggataccacaaaactaacgcattgaaccttcctacaccaaagtgtcattcaaacataaactatgtgagtccacatcgttaggataagactgatgacgcggtgacatgtaactgacggaaatacacggaaataccagcagagaatctgcaatatgaaatagaacgacattgaagct

SEQ ID NO: 11448 - DNA, 883 bp, Diabrotica virgifera
  misc_feature (121)..(142): n is a, c, g, or t
  misc_feature (278)..(326): n is a, c, g, or t
  misc_feature (489)..(507): n is a, c, g, or t
  misc_feature (791)..(791): n is a, c, g, or t
gatgataatattggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactnnnnnnnnnnnnnnnnnnnctaaagctcagagtgttactggactatatgtaatagtagttccatgataagtagctaatcatctaaatactttaattccagttggtacagcaataattatagttgctgaggtaaaataagctcgggtatcaacatccattccaactgtaaatatatgatgagctcaaacaataaaacctaataagccaattgctattatagcataaattattcctaaagtaccaaaagcttctttttttcttctctcttgcctaacaatatgagaaattaatccaaatccctgntaaaattaaaatatatacttcaggatgaccaaaaaatcaaataaatgttgatagagaattggatcccctccaccagctggatcaaaaatgat

SEQ ID NO: 11449 - DNA, 681 bp, Diabrotica virgifera
cccacgcgtccggattaaagttaataatatagctgctacacctattattcatcttttcgctatttagttaattgatcctacgaaaatttataatttcctatgaatcagcgtgaggtcatacggattatccatcgaaccgttattagaataacatacatatataatataataacgatcgtgtaggacattttaacaaatagacgtcattaagcaagaatgcttaaggagaagctttatgttttatttggttttgcgacattcttttgctttaatgttataggacaataccattaagtgtatgatgaatgcttatctgaacaaaggtatatcggtgtattaaaatatctcaataactgccgaagagcctcacataacataaagaaggacatatatccaacggatatttgaggatatgacgtaacactagtattactgagtagatgaccatcgagacaaccataacatattattatataataccgcccattattgcctgacatcctccacaagtaataactcctatcccaaaccgagttgctagtcagcctggcgataatgtccatgtaatgcgtcaagtatattctcaatatgcatatggcaagaatgtgagtcctaccttgtaagaaataactgcattttcgtatatattgtatcagtccaattactacgctgcgtctgatt

SEQ ID NO: 11450 - DNA, 622 bp, Diabrotica virgifera
  misc_feature (81)..(109): n is a, c, g, or t
  misc_feature (150)..(168): n is a, c, g, or t
  misc_feature (192)..(232): n is a, c, g, or t
  misc_feature (557)..(577): n is a, c, g, or t
cgccccctcccccctaatccgtactctccctactctctttttatgaaacgttttatctcatgatatctaactgtctctcgnnnnnnnnnnnnnnnnnnnnnnnnnnnnnctctatcacgctttccttctcgtttccttgtttatcacggnnnnnnnnnnnnnnnnnnncattagctcctgaccaaaaacaannnnnnnnnnnnnnnnnnnnnnnnnnnnnnnnnnnnnnnnnaacaaactggtgagggggggacctattgagcgggctgcacagaaaaactcccgaaaaaaaaccactaccgtcatccctacttacccaacccaaagaatcaaaaatacggcgggccaagagaaatacaacaaagaaaaaacaagaaggggcaaaaaaaaatggagaaatcggaaaaaaccacccccgccccataggcacggccgggggggaaagaggggccgccccccccccactataaccacataattatcacaccaccatttgggcctccggcaaaaaaaaaagggacataaaacgagacggagaaaaaagcgctacctgcgcnnnnnnnnnnnnnnnnnnnnnttggatgaaaagaacaaagggagggggcggcgcaacaacacgcag

SEQ ID NO: 11451 - DNA, 908 bp, Diabrotica virgifera
  misc_feature (823)..(823): n is a, c, g, or t
cgagatcttgaagttacgtaaacattgggtcgtgatggacgccttctcagaagaactcagtcccccaggatatataattcaaacgaagaaataaataacaattggaaaagaaaatctgtttgtcgtgtcgaaaatggacgtcgtcgccgtagggacgccgatcatctaggtattgatatgcttgaagctttcggcctttgcgtttgcggttgcaacagattgcggcattgaaaagagccgattggaagaaaaaaatcggcgggcatttcctagtgagagcaactgaacaactaaaaaaccttgaaaacagtattgtataatcgaacggagctgcagatttgtttattagtgatgtcttcttgtgcttgtgataccggtggatgatgtgatttgtatttcagttttcagcgggaattattttacagacaaatatgagaaaaatctttggaatacagatatggttttttcttctaaatcttctcttatatttatttcaatacgcaaaaggagcagttatgccgccgccctgggcaaatccaaaactaaacccatgtgcctcgcatcctcttggatggcaactactattttggccgccagatggaaaatgctacaaaatatttcaggttggtcatccttgcccgagcggtatggaactaacgccatctcttagcaaatccgggaagaacttatccgccgaatgtaaatgtgtaccccaaactgctcaatcagcaacaaacggtgtctgttatccgctgtttagcgcaggtccctgtaatgagggtttttattttggacctgatacaaaatacaaaagtgaaaactncaaaagacaatggggcacatgtaagcagataaagtcatggtctaaagagaacgaaatctactgggcccaagacggaaaatgctac

SEQ ID NO: 11452 - DNA, 151 bp, Diabrotica virgifera
  misc_feature (2)..(54): n is a, c, g, or t
  misc_feature (57)..(72): n is a, c, g, or t
  misc_feature (74)..(145): n is a, c, g, or t
cnnnnnnnnnnnnnnnnnnnnnnnnnnnnnnnnnnnnnnnnnnnnnnnnnnnnncannnnnnnnnnnnnnnngnnnnnnnnnnnnnnnnnnnnnnnnnnnnnnnnnnnnnnnnnnnnnnnnnnnnnnnnnnnnnnnnnnnnnnnngggggg

SEQ ID NO: 11453 - DNA, 868 bp, Diabrotica virgifera
  misc_feature (494)..(513): n is a, c, g, or t
  misc_feature (766)..(785): n is a, c, g, or t
  misc_feature (849)..(867): n is a, c, g, or t
gtgactccaaaaagtagtgcacaacaaaaaccaagagtactaataactcaagaggatatgatgaacgagatattccagaaactggacaccgaaaaggatgtggctaaaatagagtggctattggtgagctatttgacttcactttcggagtgtagcatactaacccaatataacttgaatgaactcctagtgacttgtttggccagacaaaagaaattcaccgtacttcaacaaatgcttcagtacggagtcatttctgactccaaatctttggcatgtcttttactctctttaggaaacatgcacccgggcacctcccaaatggcgctggacatgctaacaagattggacgcgaaagaagaaatccaggaagtgttgttgagcgaaggtcaaattctgacagctttaaaactagcggacaacgctgctaatcctaggaagtttttgacagctgcggaacaagatggagatgtcactcttcaacatagcgttcnnnnnnnnnnnnnnnnnnnncctgaatttgaggctgttttccaaaaagatgagcgattgtcaaactttatccaacaatacaactccatatttgacagaagtagtaattaaatctagtggacattttatttagaagcttttcatttataagaataaaatattgtctccaaatataaagactggaagaatcattgtacgtaaaagaggtctagaactttgcagtaatgacaaattaggtaattttatttatagccaatttttctatatacttagnnnnnnnnnnnnnnnnnnnngtgaaatatatagctttatatatttataaacataaagatacacttatttattgtaaacagatgnnnnnnnnnnnnnnnnnnng

SEQ ID NO: 11454 - DNA, 719 bp, Diabrotica virgifera
  misc_feature (2)..(15): n is a, c, g, or t
  misc_feature (20)..(519): n is a, c, g, or t
  misc_feature (526)..(563): n is a, c, g, or t
  misc_feature (583)..(596): n is a, c, g, or t
  misc_feature (599)..(621): n is a, c, g, or t
  misc_feature (629)..(651): n is a, c, g, or t
  misc_feature (681)..(712): n is a, c, g, or t
cnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagga

SEQ ID NO: 11455 - DNA, 502 bp, Diabrotica virgifera
  misc_feature (148)..(170): n is a, c, g, or t
cccccctctaagggcgcggcacaagaacagaacagtcagagacctcatccttgcccaagagaacaacacaggaggaactggcggaaaaccgaacacagggaacaagatgtatatctatattatgtcataatgttcagttgtttttaannnnnnnnnnnnnnnnnnnnnnntcacagatattactagtgtgagttgacacatgtcctgtaccaattaaacagtcgatgcatgaggatttggtatcatagatttttgctgtttgtataaatcccctgaacagcgatgggcttattgccctcattaggcatacgatccgataaaggcatgaatatttaaatcccttacttggatgaagctgcccatatactgacaatatcagagagggtcgatgatcatgcattttcatttacgaccagtgactttcgatgctttgaaacaattgccatactgtggaagggatgtgtgaagttatattacgctcaatttgccaataaaatttctc

SEQ ID NO: 11456 - DNA, 533 bp, Diabrotica virgifera
cccctcaccgcgcccgccacgcgaccgcggacggggccgcctttcacgaagcgcacccgggagggcaggaggtaacaacgcagcccgggacccgccgaaagagacaccgctgtctacggcaacaatgactaacattacagtagtttagcggcacggcccactcctgatttgagcaccacatttgcggccgactcggtcacgaggtcggaacttatctcacaatgaattttcccaatttgtatacatgtgtgaatagtcgacagcctgtgggacataactgttttgagatcgagccagctccccgagggctagtcaaagacattctcaaggcgttgtcaatcatgatcaatgcgtgcaagctcgatgctgtgagcgaggcaacggtcgtcgtaccctgcgttcccttatgctcaccatgatgaaaaagataccaacctctcgactgagataatcctccctgttgacaatgatgaatccttttcgctggagattgaggacaagatcacctcttcccccccagctacctccaaaca

SEQ ID NO: 11457 - DNA, 652 bp, Diabrotica virgifera
actgcatatcgatgaaagattatttcttctttctttaaacacataacagtactgctcgaccaacacttcttggtgtagaccgctcagttcatataaaatgaaaatgaaactctcaccgactctatgggattccagcaggaaaacctaataattgttacacgtatctattacaagatttaagaaattctcaagagatccaaacactataacgcaaatgatccatgttgagtaaccacttagaactagaaaggcaatcgaccgtacttatatcgaagtttcaaataaccaaaactataaccatatatgataatcatactagatattttccgtacattatgtatgatctcttgacgacatcatatactacagccttcttaacaaaatccaattgtaatttgattctgaactcattaatgaaaccatatacgatatcatctgagactatgatcttatacaccgtgtactatgaattattgactttgtccccacccaaggattaaatacatcatcttcaatacattggactatatgaatatggaatatcccatgatgaaaatgtacaatctggaatctacagatacaggaacctcgaccaagatttgctccagcactattctcctctcaaacatttccatactcttcttgaacaaat

SEQ ID NO: 11458 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11459 - DNA, 839 bp, Diabrotica virgifera
  misc_feature (41)..(60): n is a, c, g, or t
  misc_feature (80)..(108): n is a, c, g, or t
  misc_feature (125)..(175): n is a, c, g, or t
  misc_feature (190)..(262): n is a, c, g, or t
  misc_feature (302)..(330): n is a, c, g, or t
  misc_feature (351)..(367): n is a, c, g, or t
  misc_feature (369)..(399): n is a, c, g, or t
  misc_feature (442)..(459): n is a, c, g, or t
  misc_feature (485)..(511): n is a, c, g, or t
  misc_feature (553)..(581): n is a, c, g, or t
  misc_feature (598)..(618): n is a, c, g, or t
  misc_feature (658)..(684): n is a, c, g, or t
  misc_feature (688)..(720): n is a, c, g, or t
  misc_feature (722)..(745): n is a, c, g, or t
  misc_feature (747)..(761): n is a, c, g, or t
caccgccgccaggccctcccgccgtccacccacgcccgccnnnnnnnnnnnnnnnnnnnncatatcttattagtaaaagnnnnnnnnnnnnnnnnnnnnnnnnnnnnncttagtattgtgcgacnnnnnnnnnnnnnnnnnnnnnnnnnnnnnnnnnnnnnnnnnnnnnnnnnnncgggattatcaatcnnnnnnnnnnnnnnnnnnnnnnnnnnnnnnnnnnnnnnnnnnnnnnnnnnnnnnnnnnnnnnnnnnnnnnnnnctacataatttctttgcaatgcaatgctattcgtttttcnnnnnnnnnnnnnnnnnnnnnnnnnnnnncaactttatttattaccaacnnnnnnnnnnnnnnnnncnnnnnnnnnnnnnnnnnnnnnnnnnnnnnnncatgatcttccaaataaaactttattaaaatccaatttttacnnnnnnnnnnnnnnnnnnaaatcttcatattctaaaatatgccnnnnnnnnnnnnnnnnnnnnnnnnnnnctatccttcataacctttatattcacctatacatttacatcnnnnnnnnnnnnnnnnnnnnnnnnnnnnnctattcacacattgccnnnnnnnnnnnnnnnnnnnnngctaataaaggaactcttcctcatttttttcacctgcccnnnnnnnnnnnnnnnnnnnnnnnnnnncacnnnnnnnnnnnnnnnnnnnnnnnnnnnnnnnnnannnnnnnnnnnnnnnnnnnnnnnncnnnnnnnnnnnnnnnacctttcattgaccgctgtaatgaacggttcgatgaataactatactgtctttattatatttataatgaattctattt

SEQ ID NO: 11460 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (173)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggtttctatctttaannnnnnnnnnnnnnnnnnnnngaaaggac

SEQ ID NO: 11461 - DNA, 392 bp, Diabrotica virgifera
gtcaagttgcaaatacgattacctgatggttcaagtctgacacagacgtttggggccaaggaaccactttctgcagtgagagtttttgtggaaatgaaaagaaacagcccagatgaccagtttcacctaatgacaagttttcccaaaaaagtatttgacaatgaagattatgataaacctttggattctcttggattggccccctcggcagtgctcatagttaagaaaaattgaagtgtctagtctacattctaataaggtgttctgttcttgtaaattatttcaattatacactaccgtttttcatcttcacggatcaaaataaatttgctactttacaattaagacgactaattaattttaaattggtattataataatgttattctttc

SEQ ID NO: 11462 - DNA, 133 bp, Diabrotica virgifera
  misc_feature (2)..(71): n is a, c, g, or t
  misc_feature (73)..(121): n is a, c, g, or t
cnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnngaagcttacatt

SEQ ID NO: 11463 - DNA, 859 bp, Diabrotica virgifera
  misc_feature (789)..(815): n is a, c, g, or t
tggcgttttacaatgtcacaagtaactgcagattttgaacaatatttggagagatacttacagggctcctcgaaacttgcaattttgctagattatgatggtaccttgacacctatcgtggctcatccagatctagcagtaattcccccagaagcaaaaaatgttcttgaaatgttgtcgcaaatcccagaaatatttgttgctattatatcgggtagaggggtaacgaatgttaaaaaattggttggtattgactctattacatatgctggaaatcatggactggaagtcatctatccagacggttccaaatacgaccaccaacttccatctaatttcgaggaccaagtttaaagaactaatagccaagttacaagaaaaactgggaagagaaggtgcttggatagaaaacaaaggtgccagtctaacttttcattttagagaagcaccagcacacttaagggaagaaatggaaagagaagctaccaaaattatagaggcagcaaatttcaaatcttcaaaggcacatatggctgtagaggcaagaccaaaagttgattggaataagggaagcgtggcgctcttgcttttggagcagaaatacagaaagaactggaacaaagaggccaaggtgatatttgttggtgatgatacaactgatgaagatgctatgaaggctttgaaagggaatgcggctctgtttagaattgctaagccttgtgctgatacaaatgctgataaaattatttcgtctactgaagatacactaaaaatactgaaaatagctcnnnnnnnnnnnnnnnnnnnnnnnnnnncattgatgtatacatatatgtgattacaataatatatatgtaca

SEQ ID NO: 11464 - DNA, 718 bp, Diabrotica virgifera
  misc_feature (2)..(717): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11465 - DNA, 658 bp, Diabrotica virgifera
ccccttttcgcgcccgcctgttttatcattacaagatccgcccttacttgaggtgagggatggcgagttagtagataacaacgtagtctgggaggagaataatgagataccactgttaaagaatataatgcctaacatcatgggaattaggggttcgtcccatctaaatttggccctaataatttgtcgaccgacttggaatcgatttgggaaaatttctcacgaagaatttctcccacatgtaaacatgtgtggagattggacagtccgtgagacgcgtcgatgttacattgaccagtcacgtcgagctgtagtaaaagacaaccttatggagattgttaattatgatcaatgcctgtaaaatctattctgcgagccaaggaacggaagtcaaaccctgtttcccttatgcacgacaagataaaaaggatatcaacatctcgcgtgagaatcaactccatgttgataattggaaatctattgtctggaatttgacgagaagagcacctttttccgccaagctcgtatcaatcatgctggctggtgtgggagcctaccacatattgaccatggatctccactcatctcaaatacatggcttctttgccactcccgtatataattcgaatgccgagccggctgtgatgaaatgtatcat

SEQ ID NO: 11466 - DNA, 947 bp, Diabrotica virgifera
  misc_feature (343)..(368): n is a, c, g, or t
  misc_feature (433)..(454): n is a, c, g, or t
  misc_feature (578)..(600): n is a, c, g, or t
gttgttcaatgttttttaaccactttcttggcacttggagccttgttagttcgcttgggaaattctttgtgacatccttaaatcgtgtaccgaatttcattgaaatcgatctaaatgttgcataataagtttgcaatctaaatgtttttaaaaaagttcaaattttttaaaatctttgtgaacaaaaagtagaccatttagaggtctgctactttttttacatgtagaggggtgctctacctatctagtgcactttgtagaattggagtcggattgtttgggggacctcggcaatgttttgaatttagaaacagttttttggcttgtaaacaaatagctttgnnnnnnnnnnnnnnnnnnnnnnnnnngcaatgcaaataattcaaaccggtttaatttaacttaaactttcaaattctgtcagcagaattgnnnnnnnnnnnnnnnnnnnnnncgttattcgcgttcaaaaattgcaatttctcgattttttgaaagttccaccgcgtttatctcgaaaactatgcatcctacgaaaaaaacttgtaagaacattgtttgcttagaattacccaagnnnnnnnnnnnnnnnnnnnnnnnttttgcgaaaaatcgatgttatgtaattcctcaagttctttgtttataacaatcttatcgacatccggatcaactgttaaccaaaaaattcgtgttctacgggtcaaaatacataaaaaaacttgggtaagtccatctaaataaaggagcccgtagcaccccctcctggccacagcactaatttgtttgtgagccggaggattgttaataactttggaacattgccgaggctgcttagatggtccgatttcgattttttaaagtgcgttggataggtggagtacttctttgtatgtggggagagtgacagatctttttatgctctggtttttcttgtgcaagatttc

SEQ ID NO: 11467 - DNA, 767 bp, Diabrotica virgifera
  misc_feature (70)..(90): n is a, c, g, or t
aggcaccggccccggaattcccgcctctcacgcgcgcgcgataagggaggaagagaaaaaagaacgtttnnnnnnnnnnnnnnnnnnnnncacatgggggaacgcagcatggaacaaccaccgaagccacaagaggaccacaatgaatacaccgtatctactcctgctactgcattatgatgcagatacgtacggtacccaaagacccaccaactatgacacaacctatcatgctgcacactgcagccagccaaggaacttatgctgctgaaggaaccactgcaactcccgcctatgagtatggatatggatcaaacaactgcaaaacctgcttcctatgccactacttatacacacagaactacttcacattatgcacaacaagcaataaaatttcagtcagctgctgacactgctgcggtcgtggacaagcattctgcacagaacacggccacataccagcccactgcaacaacttaccagactacctacccccaaccagctgctgcacagactacaatagctgctcaacctacaacacaagccaaacagactaattctaccacaacataatcatgatacgatgctgccctgtattcagcagctaccatgtatgtagcccaacagccaggcactgcccaacataaagctgtcggctgttaaaactacaagaaaccagccatctgtgcgataactgtaagaccaaaggcacccccaaaacctcaacagtagtactattgtgatgattgtaatatcagatgtgctgg

SEQ ID NO: 11468 - DNA, 532 bp, Diabrotica virgifera
  misc_feature (33)..(33): n is a, c, g, or t
  misc_feature (123)..(141): n is a, c, g, or t
  misc_feature (152)..(191): n is a, c, g, or t
  misc_feature (197)..(228): n is a, c, g, or t
  misc_feature (301)..(323): n is a, c, g, or t
  misc_feature (326)..(362): n is a, c, g, or t
  misc_feature (433)..(450): n is a, c, g, or t
cggtctagaagggcgaccttttttgtatttatnataatttaccctttatagtaaatatatgttataatttggatggtgaaagtgaatgagtaaaagttgagaaaatttatattatagaccaannnnnnnnnnnnnnnnnnnaagaagtgtgnnnnnnnnnnnnnnnnnnnnnnnnnnnnnnnnnnnnnnnnttatgnnnnnnnnnnnnnnnnnnnnnnnnnnnnnnnngaataatagatgatttttattagattgttgaaggggtatgattttatgtatgatatattttggaaagatttgnnnnnnnnnnnnnnnnnnnnnnnggnnnnnnnnnnnnnnnnnnnnnnnnnnnnnnnnnnnnngatatagattttgggggaggagtagattaaagatcattgttttatgttatagatgttgtaaaaataatagnnnnnnnnnnnnnnnnnnttaaaatagttgggatattgatagaatatatgattataagtattagttaaaagtaaggtagtaaaataaaaatatgaattat

SEQ ID NO: 11469 - DNA, 857 bp, Diabrotica virgifera
  misc_feature (709)..(726): n is a, c, g, or t
ctattatagatataaatttaagagaatatggatctgaattacttgaagtaatcgacaatgccagcggagttaagcctgaaaactttgagtcattaaccttaaaacattatacttcaaaaatacgcgagttcgacgatttacaatcattagggacacttggttttagaggggaagctttaagttctttgtgtgcattatcagacttagtggttatcactaggcatgaattatctgaatgtggaaccaaaattatatatgatagaaacggcaaaattgttgagcaaacaccactagccagaggaaaaggtactactgttacattaaccaaactcttttcaacgttaccagtgagacgcaaggagttaatgaagaacttaaaaaaggaatttaataaaatgtgtcaaatgttatatgcgtattgtttggtatccaaaagtgttaaattcacgtgtacaaatactctctcttctggttcaaagaacacagttgtagctaccgatggcaaagatacaattcgagacaatattataaacgtttttggttccaaacagatatcatcattaatagacgtaacactggtccctccaacagaggagattctaacagaatttggaataaaacaatttctagatgaacctttaccgtttgatttagagtttttaatttctagcgttatccacggctcgggtagaagtgctaatgatcgacnnnnnnnnnnnnnnnnnnccagaccttgtgagccttccaaaattatgaagttagttaacgaggtatataaatcttacaattctcatcagtatccgtttgtgtatttaatatttctacaaagtcgatatttgtggacgtcaacataactc

SEQ ID NO: 11470 - DNA, 1039 bp, Diabrotica virgifera
  misc_feature (419)..(442): n is a, c, g, or t
  misc_feature (605)..(622): n is a, c, g, or t
  misc_feature (631)..(650): n is a, c, g, or t
  misc_feature (808)..(832): n is a, c, g, or t
  misc_feature (928)..(945): n is a, c, g, or t
  misc_feature (951)..(968): n is a, c, g, or t
  misc_feature (976)..(1008): n is a, c, g, or t
cacgatggttcaagataataaaataagtaacaatttggtgtatcaactcgtatatacagaaatcaaagagggagatgacgtaacgtgtagaattgaataaaaaaggatgacatatttatattctgggcccaaatttggatagtgcaatgaatatgtaataattttatttaaccttatactcgtaggatattgaaaaatattattattgtttctacagatagtggagtatgtttatcctgatgtggtggtgtaaatgtttatttctattatttataggaaatataaaaaagatatcttttcaccatacatttgtaaataaatataatcacgttatattaatagatgattgttaccgggagctgagcagtaccgtctcatggttaatttattgttattagaaattaatctggaaattttgnnnnnnnnnnnnnnnnnnnnnnnnggatatcttatatgtatagaacgaatgattcattaatacgctattaaataatatactaccattattaatatccattattcatatacgcttatttagttgagatggcatatttacagctgttctctctaactttatcaagacgagttataaatgaatatattannnnnnnnnnnnnnnnnncaaaagtgnnnnnnnnnnnnnnnnnnnntagctgctgatcagtgttgcaagtccccagaacaatgaatgaggaggcggcgacaatcctggaagaaacatttatattttttcgagcatgtgatgtaataaagcacgctggaatgtaagaaatctataaactttcttagttttttgtcaatgaaaccnnnnnnnnnnnnnnnnnnnnnnnnngttccttacgaaattttttaacacttttaggtaaacacatatatgacaccaagtttgtgattgggtatggagaattcttcttatcttaattttagnnnnnnnnnnnnnnnnnnaggagnnnnnnnnnnnnnnnnnntaaaaagnnnnnnnnnnnnnnnnnnnnnnnnnnnnnnnnngtaaaactcattaataacccaattaagcccc

SEQ ID NO: 11471 - DNA, 767 bp, Diabrotica virgifera
tctctatataggaaagatgtgcacgcctcgcacgtaccccgtgcgcgaataccccctctctattcacgcgcccgaaggtcaaaaaaggtgtgtgaatatataagttcattgtgcgaatatagtggacctctttgttcgattcagaaggataagatatctccacaatgccacatcgataacatataaaaaaaatccttccatttcaactcgaccaagaacatctataaaattattcaccctacgaaaacttggatactatgcatatctttacagcctaaatatgaactgaaagatcaccgcccatccgcagctggatctaaccattgatatgtgaaatctgacctgctccccctacttgatgtgtctccaaaaataactagttgtaataacttcatataaagatatatgtattgctgttcaccccatacaataccttaaaactcgtacatactttttgaaacacgatcaaaatcattgaaagtagtgtatgtgtccggacacaccaactacaacctatatatataacatatctatggaaaatacattaatctcgcttggaaagaagtagaaagcatgcccctccactttcattgatgctactaacatcagctcagatagttgttttgaatcgccattaaaccaacagaccacgacacattggccataacatccctaaatctaacgtatcttatatcacacatacatagcctatcatcaacttgcacgctataacatcctgaccaaaactatcactgtatgaactatta

SEQ ID NO: 11472 - DNA, 901 bp, Diabrotica virgifera
  misc_feature (5)..(894): n is a, c, g, or t
cgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatat

SEQ ID NO: 11473 - DNA, 826 bp, Diabrotica virgifera
  misc_feature (3)..(42): n is a, c, g, or t
  misc_feature (44)..(615): n is a, c, g, or t
  misc_feature (617)..(817): n is a, c, g, or t
ccnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagc

SEQ ID NO: 11474 - DNA, 602 bp, Diabrotica virgifera
cttctaattgaaataggaagtccttcatatatatcctgaatgagaattctagattgaagtgtgcagaattatcgtaaagaaaaaccaatggtgatcttaccaactatgctccagatgaaattatgatatagtactcaaagcaggttgataagagacaaaaaaacaaccaaacatcgtctgcttacacaaaaaaaggtataacaaagctattactgcatgtgtaatgagcgccactattgacccatcgccaatcttgcaaacgaggaaaacctgtatttctgaaaactatatcgaatattccggattccgacatgattagccaaggccaatgcgcagaatgaggaaaaaaatagacggtaagatatgagagatctatctgatataaactgaacagaatgaatgggcagagtgaaagtatttggaacagctccttattcgcgagacaactcatcttacagtggaagcacctgatcacgaatcaacgatatatactggtattacaccttcgtgtaaaattatcagggttgaaaaacaacctaaacaatacaggcttattacgctattaaaatgacttcaccttttagaaaatatatctgaagctg

SEQ ID NO: 11475 - DNA, 202 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaaggac

SEQ ID NO: 11476 - DNA, 868 bp, Diabrotica virgifera
  misc_feature (47)..(69): n is a, c, g, or t
gggacacttaaacataggaaatctttcttaattatttgaatatatannnnnnnnnnnnnnnnnnnnnnnatttgcctatagagactggtcgaaatgctgtgataactggaggtactagaggaattggtgtggaagtaataaaaatgttattgaaatgtgatattaatgtaattatgggctgtagaaatataaaacaaggtgaattattactccaaaattttagagatgaagggattaaaactggaaacattgacattattaatttagatataagtgttatggactcagtaagaaattttgctaaatctgttaaagagaaatactcagtaatacattacttaatcaataatgctggaataatgtttggaccatatattgaaaccagagatggctatgaatctcagttttctacaaattacttaggacactttttattgacacatttgctgctaccacttcttaaggcaggtggcacaaaagagaagaaagcaagaattgttaatgtttcttcttgtgctcattttgtttttggagatattaactttgaggatattaataacaggcatcactatatatctggtgtagcttacgcacagtcaaaaatggctcagatattgtttacaaaatatttggatgcaatccttgagaaacaaaaaataaatgtgcaggttcatgcagttcatcctggactttgtcatactgatttgttcaatggcacaaatttgaaaaagtgcgctcctctgatacctgcctttagtgttcagagtcctgaaaaaggtgcaacaccccatctgtatgcttgcgtgtcaccatacattgaagaaaaaggtggtacttacatcagtaaattgcaaaaatagttcctgct

SEQ ID NO: 11477 - DNA, 75 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttggattaaagtttataa

SEQ ID NO: 11478 - DNA, 511 bp, Diabrotica virgifera
  misc_feature (274)..(296): n is a, c, g, or t
  misc_feature (478)..(496): n is a, c, g, or t
cgacaaaaagggaggaccgcgctagagaggacgacgggggaaccgaaaaagaccatcagacgttaggaatagaaaactttatcgcttttgtatcttctgcgtatgggggaaattatcgtataatacagttgttggtaatttgaaaatgtaatccgtataagaactaaaaggcctatgagtccgtgaaatctcctatatagttggtagtaattgaaacgtaacatgtctgtagagctattttatttataaaaacctagtagtagatttacatatnnnnnnnnnnnnnnnnnnnnnnncattcaggcatgactagtaggatatatggattcggatcagcgtaactagggacagatatagataatattattattcgtaattgaaaggagaagcgaacaacatgatatgaacgtatgtgagtagttattgttgtacattgatgcttagtaattgttaatcaagtgtctcttaaaaaatatgnnnnnnnnnnnnnnnnnnnactatgatgataatt

SEQ ID NO: 11479 - DNA, 836 bp, Diabrotica virgifera
  misc_feature (5)..(174): n is a, c, g, or t
  misc_feature (176)..(727): n is a, c, g, or t
  misc_feature (733)..(835): n is a, c, g, or t
agagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 11480 - DNA, 675 bp, Diabrotica virgifera
  misc_feature (37)..(58): n is a, c, g, or t
  misc_feature (346)..(358): n is a, c, g, or t
  misc_feature (360)..(373): n is a, c, g, or t
  misc_feature (418)..(437): n is a, c, g, or t
  misc_feature (441)..(470): n is a, c, g, or t
  misc_feature (599)..(616): n is a, c, g, or t
  misc_feature (634)..(667): n is a, c, g, or t
tatttattttccaatatgaccccttttttaccaaccnnnnnnnnnnnnnnnnnnnnnncgatcgttaattagccttgtgacacactcttttatttttatacacaaactttcttttttgcacctcgtgtctcacggcttatccattcacacttatctctttcttattttccaatttaaaaccgctaaacaattaaaatctctcttgtaacctcaaatcttttacataatttttttgtaacgaactgctattcctttttcaatatatccccttttttacgaaataaattaaacttatttactcaccctatctttatacttcactattttcatattattaatattcccnnnnnnnnnnnnncnnnnnnnnnnnnnncttttattaaaatccactttttaactaaacattcggatcacaacnnnnnnnnnnnnnnnnnnnnctcnnnnnnnnnnnnnnnnnnnnnnnnnnnnnncttttataaatttctcattacaatataacttcaaattcttcaaatttattaatgctgatactctcagtattcaaacattctatattcagcaaaactatataggtttaatacaggaattcggccacatcnnnnnnnnnnnnnnnnnncaaacctgtctttttgcnnnnnnnnnnnnnnnnnnnnnnnnnnnnnnnnnnctttgaat

SEQ ID NO: 11481 - DNA, 765 bp, Diabrotica virgifera
ccacgcgcgcgtcgagtagtcattaacatatcgaaccttcattcttaatttttggacattgttaaggaatggtaggaactttcttcagaattttggtacgacctgaattaagatacggccgatatctttcctcgtattgtaaccctttatattgttattcgatactcgtgcctgatatttatgacatttattgctatagtgattcctattatacttgtgggacttgctacttgtcctgttgccttaatattcgtagctccgcatatcgatttccctcaaataaataatatgcccctttgcttgcttgccgcgactcatttattttgattatttttctacaccttaattaggggggttgtccccgcctgaattcattactcccttctgtactcaaacaccgcccatgtccgcctctccgtatccttatctattttcttatcccctctagctggtatgtctttattctacttgatatctactttattacaacttgacttcatcttcgaccaatacgaataatcttagatcgatcacctctatttgtatgacctgtctccattaccgttcctcttcttctattatctttaccagctatagctggatctatgtacaatattattaccagattatatttccaatacatcattatttgatactattgtggcagggcatcccattctctatcaacatttattctcatatttagctcatcatgacctcatatatcttacttttaccagtatctctattaatctctcatatcgt

SEQ ID NO: 11482 - DNA, 769 bp, Diabrotica virgifera
  misc_feature (2)..(739): n is a, c, g, or t
  misc_feature (741)..(741): n is a, c, g, or t
  misc_feature (743)..(768): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncngnnnnnnnnnnnnnnnnnnnnnnnnnng

SEQ ID NO: 11483 - DNA, 782 bp, Diabrotica virgifera
  misc_feature (105)..(124): n is a, c, g, or t
  misc_feature (164)..(184): n is a, c, g, or t
  misc_feature (273)..(290): n is a, c, g, or t
  misc_feature (321)..(340): n is a, c, g, or t
  misc_feature (458)..(475): n is a, c, g, or t
  misc_feature (510)..(533): n is a, c, g, or t
  misc_feature (723)..(748): n is a, c, g, or t
ggaaaggtgggacccccggaaggacccggcccgaattccccgctccttcccccccgcccgatatttataaatgaaaatatattactacatctttaagcaatcgcnnnnnnnnnnnnnnnnnnnngatagatattaaatatatgtcagagaatatattacttctnnnnnnnnnnnnnnnnnnnnnctgaccttgaggatcgggtaatattatccaatcttcatatatatattacttcctaattaaaactagatacaaaattctcatttttatcnnnnnnnnnnnnnnnnnnctaattttaccgcaatgaaatgatattcacnnnnnnnnnnnnnnnnnnnnacaagacaaaaaccacttttattaatcatctctatatatatcatcaacaattttcatatgattactactaaatactttatagggatgatagttaataatacttattctattaaaatcnnnnnnnnnnnnnnnnnntatacgattaaaacttttcatactttaaaatatgnnnnnnnnnnnnnnnnnnnnnnnncatttttattctttatactatttctattaaaatatataatttagtattatcataatatatagatatatgactgatgaatgattatttatctaattaaattgctatattctattataaatatataggattactaactgaattctacaacattaatttcacctgactattacacatatgtctctctgtatcnnnnnnnnnnnnnnnnnnnnnnnnnncttataatcaatgaccgcgcaattctgaccgtga

SEQ ID NO: 11484 - DNA, 715 bp, Diabrotica virgifera
  misc_feature (34)..(52): n is a, c, g, or t
  misc_feature (54)..(232): n is a, c, g, or t
  misc_feature (234)..(274): n is a, c, g, or t
  misc_feature (291)..(333): n is a, c, g, or t
  misc_feature (335)..(350): n is a, c, g, or t
  misc_feature (367)..(396): n is a, c, g, or t
  misc_feature (412)..(442): n is a, c, g, or t
  misc_feature (444)..(463): n is a, c, g, or t
  misc_feature (477)..(498): n is a, c, g, or t
  misc_feature (500)..(516): n is a, c, g, or t
  misc_feature (518)..(533): n is a, c, g, or t
attttataatactaaaatatttttgactaaaagnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnncaactaaattaaattgnnnnnnnnnnnnnnnnnnnnnnnnnnnnnnnnnnnnnnnnnnngnnnnnnnnnnnnnnnnggtatgatcttataacnnnnnnnnnnnnnnnnnnnnnnnnnnnnnngaagattaggattatnnnnnnnnnnnnnnnnnnnnnnnnnnnnnnngnnnnnnnnnnnnnnnnnnnngtatttgttatagnnnnnnnnnnnnnnnnnnnnnncnnnnnnnnnnnnnnnnnannnnnnnnnnnnnnnnccattattctattggatatttattatgaatatataggcatactaaaggtattccgcaacattgttttctcctgtgtattgaaaacatgtctatctgtattacatataacgtctcgcctggctactgattagtttcagtgtacgcggtatgttgaccgcgctaaggtattatctgcatctgtt

SEQ ID NO: 11485 - DNA, 52 bp, Diabrotica virgifera
  misc_feature (13)..(47): n is a, c, g, or t
aagtttttagtannnnnnnnnnnnnnnnnnnnnnnnnnnnnnnnnnngtgat

SEQ ID NO: 11486 - DNA, 723 bp, Diabrotica virgifera
  misc_feature (19)..(40): n is a, c, g, or t
gatttgaatttattttctnnnnnnnnnnnnnnnnnnnnnntaaggagagaaaaattactctttaatgataagtaaaatagtatagggacaaactattttatttttataagacaaaaacctattttttgctccttgtgtatctaggaataatcaattaataattacttatctatcattatccaataatgaacatgtatgaaatgaacctcttaattgaagaatatacctttatcaataattattctgaaacgaaaagctattagcttcttaatatatctaacttctacaaaaatctgcttattctatttattaaatgtatatttattgccacatattcctatattatctttaataaaaactttacacgtaagaacttcaagactagatcttattacaacttaatttttaaataagcatccagatatgaaaacttcatactataatacacgaaattctttataccatatatatgatcctcctctattctctataaatattattccaaatgcttcctacatatactactgagatagtgaagctgactatgatgatgaattccataacgtacactaaaccaatgtagatccgctaattactgagatgtcatccaccatattgtcccctgaacaatacatctctgaattcttgtatatcatatatggtgtccacatgacactgaacctgtcgaatgtacacgggatattgaccgtgatgatgtactat

SEQ ID NO: 11487 - DNA, 817 bp, Diabrotica virgifera
  misc_feature (82)..(107): n is a, c, g, or t
  misc_feature (734)..(754): n is a, c, g, or t
  misc_feature (783)..(783): n is a, c, g, or t
catacataaattttattaattattctacaatataacgaagttgataatctataaggctaatattatacttcctatacatacnnnnnnnnnnnnnnnnnnnnnnnnnntatctacttataagtatgtgttatgaatgtacttataagtacgtgctaagaatattcgataaaggtatattctaagaataaacttttacgaatattccgagttactacgtacacgcatgtactcggtatattcggtacgagaatatactttaaagtatatgcaaagaacatgaaatttagaatattttttaaggtacatgctatgcttgtactaaaaagaatatactccgacgaatgttggtagtatatgcttagaacatgatacgaacatcattgttatgtgggttttaataagtcctacacgtaaaacatgtcaaatgacaggaattatattggtggtaaatagcattctaatttttgcatgagattttaatgaaagggtaacaaatcaattggaagttttctccgacaaaatacatgggacgttccacaattaaaacttccccctgttcagtgttcccatacatcaaagtttgtctgactagacaccgttaagctattaataagttttcggcttgctgttgataaactttttttggtacacgggatccaggcctatctgcttcttacctaatatataggaagcttttcggcatctaacccattttggaaatgttcagaaaatcnnnnnnnnnnnnnnnnnnnnnatgaactaaatgaaaatttattggtcggntgtttttgttgagtggttattgtaaaaatatttt

SEQ ID NO: 11488 - DNA, 579 bp, Diabrotica virgifera
ccccgtagctccacttatactccttggtccacaaaaccttttccctcctacatgtttcattaagaaacaaattaaagtatgacctcaccatcaacgaaatcccaaaaatatgaatgataagactaattacactcctcgcaaaaccaccaacatgacacaacctatactgcttgatgtatgaatgatataactacacaaaacaatggcgaattcttacatgttatgtatcactactcacgcacattcgtcattgaccgtattacccctctagaatgcaaaatacaatctctgtaaactaccaacagaccaatctgcatctcacggactttcattcttgcagacccatcatgaactccccatcctataccctgacacagatatctacttgtatgacatgattgaattgaaaaatgcctcttctagtattctaaactacattataatctaatctggaaactaatcaatgatcattgtattaagaaatttgattgtgtgtgtacataaatctatctggaacgttatcctgcatcctttgatattgtgcatgttcgatatgctagtgctcatgtatttgctact

SEQ ID NO: 11489 - DNA, 837 bp, Diabrotica virgifera
  misc_feature (46)..(60): n is a, c, g, or t
  misc_feature (62)..(77): n is a, c, g, or t
ctacttcaaaagtcgttctcaaaaaataaattattttgttgtatgnnnnnnnnnnnnnnncnnnnnnnnnnnnnnnnctaattatccagcgtaattatccaggataattatgctggatatagaagatccattcttctaatctattatacaacttaatgagtactaaatacgttcttctcataaagtaccagacttaaaatgatttactaattttaccgcgaacaagctaatattactttaaaatatgtttattttgacgtttcgatttccactttggaaactcttctcaaaatatatcatcaacatatctcaggtgcattcttctaataactttattggatgatagtttatttgcttatacgaaatgaactttaacttgagaagcctatcagaaaaaaatcttgtaatcttaatgtgtcttagtgtaaatcataggagaaacccacgaaaagtgtcttgatactatgtcaacagtgtaaatattttgttttgcatttttataaagttggcaatgttggtatttgcgttttgtgacttcttcttttattattggtaatcaaatcttactttgttctacggagaaaatttatcaacaccagtgcgcatccaaatctcaaatacaaagtgaatttggtcagactgtattatctaataatcttgaagttctcgtatcattaggtgatggtgatttagcgtctttaattcgcgtaatggcgatagtcacttctaatttaacttgtttggcgttgttttatggtgttctgtacctctttaatctttttgcacatagaaatcatcatgtttgcattgcagtgttacgatttcccgaaaatttct

SEQ ID NO: 11490 - DNA, 154 bp, Diabrotica virgifera
  misc_feature (2)..(150): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttg

SEQ ID NO: 11491 - DNA, 582 bp, Diabrotica virgifera
  misc_feature (14)..(40): n is a, c, g, or t
  misc_feature (84)..(101): n is a, c, g, or t
  misc_feature (242)..(266): n is a, c, g, or t
  misc_feature (377)..(394): n is a, c, g, or t
  misc_feature (435)..(456): n is a, c, g, or t
cccctttcacgccnnnnnnnnnnnnnnnnnnnnnnnnnnnccctctcttcatttacaaagaataagatattttttagtacaagnnnnnnnnnnnnnnnnnngatgatgcgttagttactatgtgtgagagaactcttttgtttcccatacaagaaaaagtacatcttcttggaccttgccggatcgccggagtatcaagctgataaccatatattctatgactctcgaaccaaaaagagctnnnnnnnnnnnnnnnnnnnnnnnnnccaaatattttagataattttctgcgtcatgaagacgcctccgatctgtaaatatatctaaccttttaagacatactttagatttctttattaacaatacattaataatcnnnnnnnnnnnnnnnnnncatatctaatatttctagggatccgcgtcaccacccaattnnnnnnnnnnnnnnnnnnnnnncaagcatgaggagtaaacattatcatatcgcaaaatatgctattattaacttttatatataatcactatgatttagtagaagcacttgattttgcaatgaatttaaaatacttgaattcagccaac

SEQ ID NO: 11492 - DNA, 758 bp, Diabrotica virgifera
  misc_feature (19)..(44): n is a, c, g, or t
  misc_feature (49)..(84): n is a, c, g, or t
  misc_feature (86)..(147): n is a, c, g, or t
  misc_feature (149)..(382): n is a, c, g, or t
  misc_feature (387)..(532): n is a, c, g, or t
  misc_feature (535)..(573): n is a, c, g, or t
  misc_feature (575)..(682): n is a, c, g, or t
  misc_feature (692)..(757): n is a, c, g, or t
cccccatccccgccccccnnnnnnnnnnnnnnnnnnnnnnnnnnctatnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncannnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgaatggtnnnnnnnnnnnnnnnnnnnnnnnnnnnnnnnnnnnnnnnnnnnnnnnnnnnnnnnnnnnnnnnnnna

SEQ ID NO: 11493 - DNA, 84 bp, Diabrotica virgifera
  misc_feature (11)..(31): n is a, c, g, or t
  misc_feature (58)..(83): n is a, c, g, or t
ctcacgttagnnnnnnnnnnnnnnnnnnnnngacgagacgaccctatagagtttatgnnnnnnnnnnnnnnnnnnnnnnnnnnc

SEQ ID NO: 11494 - DNA, 537 bp, Diabrotica virgifera
  misc_feature (11)..(11): n is a, c, g, or t
  misc_feature (21)..(38): n is a, c, g, or t
cttccgggcgnccggaggagnnnnnnnnnnnnnnnnnncccttttaacacgacaagaaaggacagaaagaccaaacggaaacaagaacgacgaacacagaaaaacggcgaaattccaaaacaaaaccagagacactggcaagaagacaacaaagacgcagagagaccaaacggacaccccaggccgaggcagggaacacgagacccaacaacaagcagcagcagcagaggaacaacggaggaaaacggggaggagccgagacaacaacggccaccgcggccaaaaaaacagaagacacgagaaaacgaaaaacaaatacgaacaaaaaggaagccggaaagccacaaaaacagaaaaaaaagacagaaaaccaggacgagacgacagaagcacattgacaaggtgcatgattatgccatattgaataggataatcaagcctgatgagaggtccaagcaggcatatagcatacgcttagtgatcggttatagttgtagataaaatatccatctataaatttggaatatacaaatgttt

SEQ ID NO: 11495 - DNA, 83 bp, Diabrotica virgifera
  misc_feature (9)..(9): n is a, c, g, or t
  misc_feature (19)..(19): n is a, c, g, or t
  misc_feature (29)..(80): n is a, c, g, or t
taagaattntatttttaangtaaaaagcnnnnnnnnnnnnnnnnnnnnnnnnnnnnnnnnnnnnnnnnnnnnnnnnnnnnaat

SEQ ID NO: 11496 - DNA, 524 bp, Diabrotica virgifera
  misc_feature (3)..(31): n is a, c, g, or t
  misc_feature (85)..(103): n is a, c, g, or t
  misc_feature (440)..(457): n is a, c, g, or t
ccnnnnnnnnnnnnnnnnnnnnnnnnnnnnngctacgagcaaagcttactgttatttaatgatagataattacaattgagagagnnnnnnnnnnnnnnnnnnnctctaaattaattccttgaaactagagaatcacgcataattaattaacaactatatatttattatactcgacttgaaaagagctatcaaaataaaatgtttattgacaataacaataaaaaatatgtataccgaatagaaatgatatacgcatataagtatctctagtatcttaacagatcttctagccttatttatatctcatatatttatagttaactatttctatattattcatattatagatttatatccatctacttcaaaccaatatgttattaacatctattacttgatcaaaacttctgataaacaacattaaaattataaaatacgtnnnnnnnnnnnnnnnnnncttattgttcttcttatctatagaccgtttgctacacatgaatgtcaacaattatgatttcatctcg

SEQ ID NO: 11497 - DNA, 673 bp, Diabrotica virgifera
  misc_feature (119)..(138): n is a, c, g, or t
tcctctcccacccgtccgcaactttatacttgacttaatggaaatagactatgaatggttcgaactccttctttattttataatctagtagtaatgaagagggtccggacctctaatannnnnnnnnnnnnnnnnnnntgtaattgttacagatcatgcaataattatcaactcctccatcttaatacctattatacttgacgatcacgacaacccacttgtatcataaacatgtgccgctttccataaaatcttcccactattcaataccatttgatactgcttgcttcccccctctctttaattattcttataataaacgatacaataacgggtgcatgtgccctgcatgcccagtttactcgcctccgacatttcctactgccctcggaccccaatcataaaatacaactacctatagattacctttagatcttatctcttcaatataagcagaattacatttcattacaacagaaattattctctgacccccaggctaaaccttatatcaaatacccctatttgccccagtcggctaaattacaacaatccttcttctattatctctaccctatatatatagacctataacactattattaacatatcgagattaagatacatcatattttgatacacatggagaaagacatccaattctctatcatca

SEQ ID NO: 11498 - DNA, 658 bp, Diabrotica virgifera
  misc_feature (471)..(484): n is a, c, g, or t
  misc_feature (487)..(499): n is a, c, g, or t
cccctccacgcgtccgcaaggaagttggagaactactcaaggaacaagaatctagcggaaggcttattgcagcaatatcagaatccaaggaagttggagaactactcaaggaacaagaatctagaggtaggcttattgcagcaatatgtgctgccccattatcgctcaaagctcatggaattgctaaaggaaagaacttgacctcatatcctagtgttaaaaaagatttattggatggcagtgaaaggttatcagtataaagaagataaagtggttgtggatgataaattaataacgagcagaggacctggaactgctttcgattttgggttggcattaatcgagaagcttgtaggaaaagaaaaagctaaggaagtaactaacgcaatgcttgtatcatggtaaactattttttaatgatttaaaacattttacggtttatgttatcaattaagaaatgcaatgttaatnnnnnnnnnnnnnnatnnnnnnnnnnnnntatatcaaagaacactacaaatatagaccacctccgaactgcttacgatcaccgtaaaagtacacgcctacgcctacaaatcattcaatgtacgttctgttgggcgcccccctcaaggggaccacgtttttaaacccccggattgatgtcattattttt

SEQ ID NO: 11499 - DNA, 721 bp, Diabrotica virgifera
  misc_feature (10)..(57): n is a, c, g, or t
  misc_feature (67)..(79): n is a, c, g, or t
  misc_feature (81)..(95): n is a, c, g, or t
  misc_feature (97)..(145): n is a, c, g, or t
  misc_feature (272)..(294): n is a, c, g, or t
  misc_feature (301)..(336): n is a, c, g, or t
  misc_feature (367)..(381): n is a, c, g, or t
  misc_feature (383)..(395): n is a, c, g, or t
  misc_feature (440)..(461): n is a, c, g, or t
  misc_feature (464)..(504): n is a, c, g, or t
  misc_feature (560)..(579): n is a, c, g, or t
  misc_feature (581)..(596): n is a, c, g, or t
tttttactcnnnnnnnnnnnnnnnnnnnnnnnnnnnnnnnnnnnnnnnnnnnnnnnnatttaatgcnnnnnnnnnnnnncnnnnnnnnnnnnnnncnnnnnnnnnnnnnnnnnnnnnnnnnnnnnnnnnnnnnnnnnnnnnnnnncatcaatcaacccttctatatttattattttcccatttaacagagctaaaacattaattattttctattcgtataaatacacatacttttaaaatagatttattctcccactgcaaatgtttattannnnnnnnnnnnnnnnnnnnnnnctaagcnnnnnnnnnnnnnnnnnnnnnnnnnnnnnnnnnnnncccaaatattttcatattattaatactcacnnnnnnnnnnnnnnncnnnnnnnnnnnnnctttattaaaacccaatttttaaatcaaaatcaggactaaaaacnnnnnnnnnnnnnnnnnnnnnnccnnnnnnnnnnnnnnnnnnnnnnnnnnnnnnnnnnnnnnnnncttatcataatataactctatattatccacatttagctccgccgatcatattaccnnnnnnnnnnnnnnnnnnnncnnnnnnnnnnnnnnnnctaactcaaaggacattcgccaaccttttttccacctgtttattcacaacatcgtctttttgtatcacatataaagcctcccctgcccactgattcattcgatcgaccgcgctattttgaccgtg

SEQ ID NO: 11500 - DNA, 857 bp, Diabrotica virgifera
  misc_feature (50)..(69): n is a, c, g, or t
tatcttgcttgtgatgcaagtgacactggtgtgtgtggtgtttaatttcnnnnnnnnnnnnnnnnnnnncatcctattgcttacttcagcaaaactttaactagagcttagcgaaagtacacaactactgagaaagaatttttagcaattttgctttcaattgaaaaatttcgatgctatattgacggtagtgataactttactgtgattacagatcacgagatcactcatcattgcagtggttatacagcatgaagaatccttctcctagaattgctagatggataatgaaactgtcttgtcacaaatttattgtagtagctgattcactttcaagaattcctgaagcatctctgttgaatcaagtttctctgttgaatttgtctgatttaaaaacagatgcttggtatcttggtaatagttacagataatagtgatttatatcctgcctttaaggttcaagataatgttctttacaaacatgttttttctaaatttaaattttctgattctactccagaatggaaaatttttgttcctgctccacataagaaggaaataattttgcatatgtatcatgattatcctacagcttctcatttaggtgtctttaaaaccctttctaggaattcagaactttattactggcctaaaatgagaccttttgttgtgaactatgttcataaatgtaaagtttgtgcttcttgtaagcctagtaacttacctccagctggttttataggacaatatcgtgatacttggtccgtatcctacatctaaaagtgtaaatcgctttctttttgttgttgttgactgatttacaaagtttatgtttgtacatcctttgcctaatgcta

SEQ ID NO: 11501 - DNA, 495 bp, Diabrotica virgifera
  misc_feature (94)..(111): n is a, c, g, or t
  misc_feature (291)..(306): n is a, c, g, or t
ccggaattggatgtctagaatttaaccctcctttatgaacatagagatttataaaggtagtaaactgtatcgttgaaaaaaccatggcatgtcnnnnnnnnnnnnnnnnnngggtggttctttctagatggatcacaaggtttagagtacttgtgacctgcgaccgatacagctctttttatactagccagcctaaagtctcttcgctagtccgcccttacgcaacgtgaaagactagtaaaattcttgtcgtgacccaaattaatgacattgttgtctatctcgaaaggnnnnnnnnnnnnnnnnaacctaaagatcctaagaaatcgccctactgaaatgtggcacgacctgaatagaactagggacgcattctgtattagaacatgaacttagctcgggtgcggcgcatacacgcaactggactgttacacttgtctatacccaagcgtgcgctcctataaatttcatcccatcctaaagatctaagacatg

SEQ ID NO: 11502 - DNA, 665 bp, Diabrotica virgifera
  misc_feature (19)..(44): n is a, c, g, or t
  misc_feature (46)..(64): n is a, c, g, or t
  misc_feature (67)..(85): n is a, c, g, or t
  misc_feature (89)..(106): n is a, c, g, or t
  misc_feature (121)..(150): n is a, c, g, or t
  misc_feature (171)..(197): n is a, c, g, or t
  misc_feature (207)..(221): n is a, c, g, or t
  misc_feature (223)..(243): n is a, c, g, or t
  misc_feature (258)..(283): n is a, c, g, or t
  misc_feature (358)..(395): n is a, c, g, or t
  misc_feature (397)..(413): n is a, c, g, or t
  misc_feature (417)..(449): n is a, c, g, or t
  misc_feature (614)..(635): n is a, c, g, or t
  misc_feature (637)..(650): n is a, c, g, or t
ggagtagagaaaagtttgnnnnnnnnnnnnnnnnnnnnnnnnnnannnnnnnnnnnnnnnnnnnatnnnnnnnnnnnnnnnnnnnggcnnnnnnnnnnnnnnnnnngtattagttaatagnnnnnnnnnnnnnnnnnnnnnnnnnnnnnncagctaaaaagttagaattgnnnnnnnnnnnnnnnnnnnnnnnnnnngttgtttgcnnnnnnnnnnnnnnncnnnnnnnnnnnnnnnnnnnnngtaagaaatacacgnnnnnnnnnnnnnnnnnnnnnnnnnngaattaaatatggttatatgattaatattgaatatttttacggatgaggttaacaataaaagtccatgaaggttnnnnnnnnnnnnnnnnnnnnnnnnnnnnnnnnnnnnnngnnnnnnnnnnnnnnnnngtgnnnnnnnnnnnnnnnnnnnnnnnnnnnnnnnnnattctttatgaaaatacaaagatagattatccaaatttggtagtgatgacaatattacaattatcctactgcatatatattaacaatatataggtgtagcaatggaattcgacaacattattttcacctgtatatttcatacatgtctctttgtgttggaagagnnnnnnnnnnnnnnnnnnnnnntnnnnnnnnnnnnnncaatctggaccatgc

SEQ ID NO: 11503 - DNA, 894 bp, Diabrotica virgifera
  misc_feature (708)..(708): n is a, c, g, or t
ggaatttctgggaatacagttgttttcttgtttatgtaatcttcaagtcatacatttcttctgtaaaaaaaatttgaagtaaaaatgttgaaacaacaggtattcacaagatgtcttgtacctaccgttctggcagccgtagccacagataccaaagagaaagctgtatctgacaataaaattgatccaaaactgtgtaggccaagtgaactaccattatacacacctgatcctatccataatgttaaacaaattgatgatagtgaaagcaatcaacttgaagaagcaataagggctaccaggttgaaattagttgagattaacaaagaagtcgaagcttataagagggtaggagttgaacagtttgagaaaggaaaagatgaattagattgggttgtaaattacctaagacaagaagataacactctgccaaaagtaggtgccataggaattggtggtctaaccggtcttatatttggtctcaggggtggttttatcaagaaaactgtttatgctgctgtaggtgctctgggtatatcagctgtatgttatcccaaagaagcatccgagtattctcaagtggcactaaccgaaggcaaaaaatatgcagtagtagcatataacttcgttcatggagtgaaaaaagatgatccaccattagaacttccttctctgcctaaattgccaactagcttagatgaggcttgngaatccgtgaaatcattcgtttcatctgattcatctgaaaagacaccagaaaaaagtaaagatcaacaataaaaggtagccatcttgacgtaatgtggtgatttatcatacatcagccactgaagtaatgcaactgtacatattttaaaagtaaattataccgatattgttttgtttttgtattat

SEQ ID NO: 11504 - DNA, 456 bp, Diabrotica virgifera
cccacgcgtgcgctcacgcgaggtaccttttttgggatttattgaatatgatggttagggcctcggaggtttttatgttgtgattaaagaactgaaatattaaagaaatgggaattatgattgcctgcaagtatgggtagtacattgaattcgtatgagaagtaataattattaattctatattcgcgtctggtaccgactgctgcatcatgtggtctgagagccgtgcctctttgtagatcttgacatccatggacaaaccaggggctgattcgccgcccccgctgtggatgacttatcgcacagaccgctatccctgtgaggctggattaaaagaacgatctttctacgaagtactttccccgcggccacttcccaagagatctcgttaggcgtacatccagatgatcgaggacgacgagtagaaacttacatgtgagcatgttgatacgctat

SEQ ID NO: 11505 - DNA, 709 bp, Diabrotica virgifera
  misc_feature (15)..(703): n is a, c, g, or t
cagaaatatgagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacataa

SEQ ID NO: 11506 - DNA, 557 bp, Diabrotica virgifera
cccacgcgcgcgcggacgctggggatagaatgaacaactgtaaatgacgatattgttaaaaagcgagaatttgcgaatctctatgtacaacttaacccaacgcaaaaaggagatccccgggaacccctcatttaaacatcacttgattgaaacaagaaaactggatgtatatcaagataaagctcgtgtccaacgaatggacacgcctatgtgaaagttactctgaaaattggactgctgataaagaacatgattctaattcgatcttccgagtccttccttgacacacggaatgccatacatgacccactcttactgggcacccaacgaggaacaccatctacatatataggaggacctcctaaagaaaatgttactcccatctattactgaacatgaaactacataataataacccttgtatcatcctaaaaaacgctcactcatgtacctctcccctaatcatctgcctgtgaatgtggtgttaccaatggtgaatatgcgatgcaagcgaactaaatgagatatcgactatgatgaactgtaatctcaactgc

SEQ ID NO: 11507 - DNA, 718 bp, Diabrotica virgifera
  misc_feature (197)..(215): n is a, c, g, or t
  misc_feature (217)..(232): n is a, c, g, or t
  misc_feature (435)..(448): n is a, c, g, or t
  misc_feature (451)..(466): n is a, c, g, or t
  misc_feature (486)..(505): n is a, c, g, or t
  misc_feature (610)..(629): n is a, c, g, or t
  misc_feature (635)..(657): n is a, c, g, or t
ataataaaaaatgtttgagaagaagtaaagaaacactttatgttgccgataactgattaccattgtgagagaatatttctatttttatacagcacaaatgaattttttataccttctgtatcgcgaatactaaattaagaaccatatatgaattattttccaatctaagagacctaaaaagttaaaatcttcattgnnnnnnnnnnnnnnnnnnncnnnnnnnnnnnnnnnncaagaagtctgcctaaaatatatctaattcttcaatacacacattaactctatctactcacaatatctttatcaacacatatttgtatatgattactattagatattctttaactattaactaagaaccaaactactagttacatttaatcttatgataacagttaggatgaaaagtttgcatatataaagatatgtgattannnnnnnnnnnnnnccnnnnnnnnnnnnnnnngataaagatattaccatacnnnnnnnnnnnnnnnnnnnnctttatgaatggtgatcatatcaatactatataaatgaatattcaataacaatctatctggtacataaaccaattcggcctcatacttttcacctgatgattacnnnnnnnnnnnnnnnnnnnnatatcnnnnnnnnnnnnnnnnnnnnnnnctttgaatgaccacgtgattttcaccgtgctcagacatcataatcatacttttttctattc

SEQ ID NO: 11508 - DNA, 123 bp, Diabrotica virgifera
  misc_feature (4)..(105): n is a, c, g, or t
ctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattaataagtgttttta

SEQ ID NO: 11509 - DNA, 212 bp, Diabrotica virgifera
  misc_feature (20)..(57): n is a, c, g, or t
  misc_feature (77)..(90): n is a, c, g, or t
  misc_feature (93)..(115): n is a, c, g, or t
  misc_feature (123)..(145): n is a, c, g, or t
  misc_feature (175)..(206): n is a, c, g, or t
attaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11510 - DNA, 637 bp, Diabrotica virgifera
cctccttcaggcgcccgccggcgcgcccgccggaggagcaaaacctttagaggaccaggaaacgaagcagaagacaacggagacgacgacggcgacgacaaacgcggagcgaagagtccaccgctatttccagccgtatacggaggtgtgcgctattatgtgtggaaatatgtgcaagactcagaacgggatgtggaatatggttgaggctaaaggaaacctggaattgaactatgcgttatgtaacgtctaatggctgcacataagactgggagttactcgatgggaagatatcgggggtaatacgtcggggagactttcgcccatcctatataccctctttggaacaacatatgggataaaaagctatatcggacgactaacctgatgaatgatgttatagataaagttgttatgtctgtgacgattgctgcggtatctacaatggcagatctactgaaatctcaacttggaaagaagcttcaagaagtgatctaagtacattcaatttctaagtatggagtacaagaacaacgacaatgtctagctgagtcatatattgaggtcctagaaacagaactgatggcacggattctggggtagtcttggggcgctactttgtaggagagattcttgt

SEQ ID NO: 11511 - DNA, 88 bp, Diabrotica virgifera
  misc_feature (12)..(83): n is a, c, g, or t
ctttataaagannnnnnnnnnnnnnnnnnnnnnnnnnnnnnnnnnnnnnnnnnnnnnnnnnnnnnnnnnnnnnnnnnnnnnnngtaag

SEQ ID NO: 11512 - DNA, 221 bp, Diabrotica virgifera
  misc_feature (2)..(209): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttaaaaagcta

SEQ ID NO: 11513 - DNA, 104 bp, Diabrotica virgifera
  misc_feature (6)..(80): n is a, c, g, or t
  misc_feature (89)..(103): n is a, c, g, or t
agcttnnnnnnnnnnnnnnnnnnnnnnnnnnnnnnnnnnnnnnnnnnnnnnnnnnnnnnnnnnnnnnnnnnnnnnnnnnnattatatannnnnnnnnnnnnnng

SEQ ID NO: 11514 - DNA, 716 bp, Diabrotica virgifera
  misc_feature (10)..(109): n is a, c, g, or t
  misc_feature (117)..(184): n is a, c, g, or t
  misc_feature (196)..(214): n is a, c, g, or t
  misc_feature (217)..(472): n is a, c, g, or t
  misc_feature (483)..(499): n is a, c, g, or t
  misc_feature (501)..(517): n is a, c, g, or t
  misc_feature (555)..(599): n is a, c, g, or t
  misc_feature (659)..(678): n is a, c, g, or t
  misc_feature (694)..(713): n is a, c, g, or t
ataattagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttatnnnnnnnnnnnnnnnnnnnnnnnnnnnnnnnnnnnnnnnnnnnnnnnnnnnnnnnnnnnnnnnnnnnngattcgatttgnnnnnnnnnnnnnnnnnnntcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgattataatnnnnnnnnnnnnnnnnngnnnnnnnnnnnnnnnnntggaattcggctacatttttttcacctgattattaacnnnnnnnnnnnnnnnnnnnnnnnnnnnnnnnnnnnnnnnnnnnnnctaatgtgaatggacgcggtattatgaccgtgctatggtagcctagtcattagattatannnnnnnnnnnnnnnnnnnngggtggatgagaaagnnnnnnnnnnnnnnnnnnnnata

SEQ ID NO: 11515 - DNA, 648 bp, Diabrotica virgifera
ccccttccacgcgcccggcatttagtatattatataaaacccccttaaggaaaccggtcagatgttagctggacattggtagaaatcaaattgtatcccaattatgtccagtattcttctgatgaaaaatgcatctaacaccacgtttgccgaatatgatcacactgaccgcggattcctaagaatgaatgattatgaaagcaaagactcgagcagaaaagacgcacccttgtccattatctcacctaggaacccttgaatcatgaatacggaacgtagagcgatcctaccggaacttatacacatccgaaaaggaaaattgtacggaaaatacacacttgcagacacacacgatgcaagatatataaatactgcatctcgaacaagaagtcaatcaagattccttgactcagagaatcaaagagggtcgtggtagaatatccaaagggtcaagaactgacaaggtgaaaacgataagaagctggaggaaaggagcagaaaccttacaaattcattgtatcggagtacaataccaacgacaagatatgcagctcatacacataactcctagaatcttcaatgaaagcacaagttcgaagatactcatgtggccctactttcaggcaataacttgactggcaaatgact

SEQ ID NO: 11516 - DNA, 836 bp, Diabrotica virgifera
  misc_feature (16)..(52): n is a, c, g, or t
  misc_feature (55)..(68): n is a, c, g, or t
  misc_feature (73)..(116): n is a, c, g, or t
  misc_feature (118)..(637): n is a, c, g, or t
  misc_feature (717)..(739): n is a, c, g, or t
  misc_feature (799)..(827): n is a, c, g, or t
ccttccaggcgtccgnnnnnnnnnnnnnnnnnnnnnnnnnnnnnnnnnnnnnacnnnnnnnnnnnnnnttacnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagagttcagatcgataatagagattgcgacctcgatgttggattaaagcttataattggnnnnnnnnnnnnnnnnnnnnnnntgttcgacttttatgattttacatgatctgagtttaaaccggtgtgagccaggttggttnnnnnnnnnnnnnnnnnnnnnnnnnnnnngacgaaagg

SEQ ID NO: 11517 - DNA, 902 bp, Diabrotica virgifera
  misc_feature (214)..(231): n is a, c, g, or t
  misc_feature (321)..(338): n is a, c, g, or t
tgaaatgttgtttcggaataaaaaattatcggtctcataatatgttcaattacatccttctgatggaaaaaaatatttgaagatttttctcaaattatggacaccaacaacattttcatttataactcttttatttttaatttgacgaagaaaagttattcttcataaaaagctcttcatggtctaagatttatgatgtatcatcatatatccnnnnnnnnnnnnnnnnnncgaggtatataaaaaatatgaatttcgatcaagagtaaagtacccttatagttcacaacatttaaattagaatgatataattgcacattnnnnnnnnnnnnnnnnnnctaagcaacttttcataatagcaattttccatattatgaattaaaatacgtaaataaacaaagttttcgttatgataatgctcgcattttcagcttgttagtattgtatttaattacagagtaatttccacatactaatatatttctcaatttgggctctgtaccgccattctttattatattacgaatatgtgtgccaagtatctcgacaaaatattcaaaattacagccgcaatcttggaacgcgtttgttgctacctgttgattgctactgtagtctctaaatagaaatcattaaatattttaagaatgttactctaatttatttactggtagaatgtgtagattttgatgtatttaatgtatttcaaacaaaaaaccaaaatgtttcttagggaaaaacttttaccatgtaataatattttatgttcagagataaattactatgtaatttaaatgctcaacaaatgtttttttctttggtgttcgtgttcccaatcggagttccacttgccattttttattcttgttgtgttgaatttgtcaaacttaaccaaaaaccat

SEQ ID NO: 11518 - DNA, 908 bp, Diabrotica virgifera
  misc_feature (869)..(869): n is a, c, g, or t
  misc_feature (884)..(884): n is a, c, g, or t
cggaaatctgtacggaaagaagataggaacagcaacaatgagcgcagctaagatccaagctacaataagttcaaaattcgaactggaaggatcattaggtagtcttcaggtgcttgatttaaccccggaaggccagatacaccaaagcatattaagcgtcggaagcgatccaaattcagacaactcacatttactttacaccatttcagatgaagataaaactgcatttaaatttagattagtgaaaactgaagagaaagacgctctggatgttatgattcgtatggcctctgtatggtacacgcattccccttattttatcctggaactacaatcgtgcgcgtctgaattcaagcagtacctgtcaaatttagcgaaaaccataagaacagccgccaccgatatggctttaggacttgtgcacgtcagaaccgaagcattagcacagtctttaaatctgagcaaaaatcttccaaattcagtgtatagcagcgcagtgtcgataagtgaaaactttactccaacgaggagaagatctgcgagtacttctgccaaagattcgatgatttctacgccaactagtcctaacgacgacagtgatttaatattaaacgttaatttagatgttgagttggacagtcctgttatagtgttacccctaagcaacaccagcactgaagtattcgttgcacacttgggtaaaattactgttaacaacaagtatacagatgaagttcgaatacactccgtccattaccgaatcgagtggtataacatcgatgttaaagacatgaatatatactctttggacattaaaacaaggagagtactggactttaagtgtataaagcccgaagtattttatattngcaaatatgacgcanaaccaattttgcacgacacgatat

SEQ ID NO: 11519 - DNA, 593 bp, Diabrotica virgifera
ctattgtttggtattgctctccagctcacatcgatccttttttggcccacacagaggatagaggttcaagatatacacatgttaattccagtggaagagatgccgccctccagaaatcttacgattattgctccacctgagagaaaatatggcacatattgattgggatgcatggccacgcaccaaatgactgaagaagtgcaccttctagatcgagtattagctgataaagctgaataaatccaacttctttgggctcgatttcaaagtgtattgaaccatgtttctaaggagtacaaacagctcattggagaggaagttgcggagactgttatggaagatgatcaagagccggatcgaagacaagaaagagtgatgagtcgacaccaaataatgattatgtctggtgcccaaatacaagagacatggttcaagaaatatcgataatgcctttggcccaaagacatatattgctgactgttttgaaatttactcttataactgtttccatatgaatatagacagctacagctttttaacagaattgtctcatattattaaaataaacactcatcggtcactcactgaactgg

SEQ ID NO: 11520 - DNA, 53 bp, Diabrotica virgifera
  misc_feature (28)..(28): n is a, c, g, or t
ccctcagaggcccccgctatcctcagcncatgaagagagacaccttcaaaagg

SEQ ID NO: 11521 - DNA, 357 bp, Diabrotica virgifera
  misc_feature (2)..(124): n is a, c, g, or t
  misc_feature (172)..(192): n is a, c, g, or t
  misc_feature (194)..(215): n is a, c, g, or t
  misc_feature (217)..(231): n is a, c, g, or t
  misc_feature (245)..(263): n is a, c, g, or t
  misc_feature (309)..(322): n is a, c, g, or t
  misc_feature (325)..(340): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattataaaattgtatatttacgtaataatatataggtttagtaaatnnnnnnnnnnnnnnnnnnnnntnnnnnnnnnnnnnnnnnnnnnngnnnnnnnnnnnnnnngagtctcgcctgannnnnnnnnnnnnnnnnnntacacgtcattttgaccgtgctacagtattataatcattactttannnnnnnnnnnnnntgnnnnnnnnnnnnnnnntaataaaactgtcttta

SEQ ID NO: 11522 - DNA, 841 bp, Diabrotica virgifera
  misc_feature (8)..(43): n is a, c, g, or t
  misc_feature (51)..(68): n is a, c, g, or t
  misc_feature (76)..(96): n is a, c, g, or t
  misc_feature (126)..(193): n is a, c, g, or t
  misc_feature (195)..(207): n is a, c, g, or t
  misc_feature (258)..(277): n is a, c, g, or t
  misc_feature (288)..(319): n is a, c, g, or t
  misc_feature (322)..(350): n is a, c, g, or t
  misc_feature (358)..(398): n is a, c, g, or t
  misc_feature (406)..(419): n is a, c, g, or t
  misc_feature (421)..(451): n is a, c, g, or t
  misc_feature (489)..(507): n is a, c, g, or t
  misc_feature (535)..(586): n is a, c, g, or t
  misc_feature (596)..(635): n is a, c, g, or t
  misc_feature (699)..(726): n is a, c, g, or t
  misc_feature (739)..(800): n is a, c, g, or t
  misc_feature (817)..(836): n is a, c, g, or t
ctttaatnnnnnnnnnnnnnnnnnnnnnnnnnnnnnnnnnnnntgggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnnnnnnnnnnnnnnnnnnatttaagtttaaatagnnnnnnnnnnnnnnnnnnnntaaat

SEQ ID NO: 11523 - DNA, 849 bp, Diabrotica virgifera
  misc_feature (314)..(329): n is a, c, g, or t
  misc_feature (783)..(783): n is a, c, g, or t
  misc_feature (826)..(826): n is a, c, g, or t
cagtggaggaattaaacaatttaagggaagtagaaaatctgtacaataataatttatttaggctccaaattacagaactcttaaatgaagttaagataaaggctaaaagaaagactaagttgacccagtggttaacactatttaatggcactctagaatcgataccagctaataaattaacactggctgaactagagaagttagtaaagaaggcaaaacagaaaaagaagaaaggatgtctaccacttttattaagaattaccacttataaaagaatatttgaaactgatcaggatgtgaacttatttctcgannnnnnnnnnnnnnnncagtgttttggtttgtatgaaaataattgtttaccaggccccaatttatcattaaatataaacgtagtaatgccccaaagcgctttcttaataaaagactatttgaacaatcgatatttggtaaagaggtggtattatttattgtacgtagctgaatatttaaaacaaaagaggttagttgataacatagagattgtgtatcacgaaaacaatcatttgtgtccaataataaaactgcaacctaaggattgtgataaaacagatgttttcatatacgtttcgccacaaaatgaatcatttaagtgtaccagatttttaccagaacaaaacaatgttaaagttgatgtttttgaatgcgtagttgatatagatacattaaaaagctctcccacatttctgtacaacagtttactagcccatgatgtaactcttcatgataataacgaattcgttnaagaagttttaaaagatcatgaacatgttcaagatgcaattanattattgtgtatttggttaactc

SEQ ID NO: 11524 - DNA, 893 bp, Diabrotica virgifera
  misc_feature (3)..(16): n is a, c, g, or t
  misc_feature (21)..(568): n is a, c, g, or t
  misc_feature (575)..(612): n is a, c, g, or t
  misc_feature (632)..(645): n is a, c, g, or t
  misc_feature (648)..(670): n is a, c, g, or t
  misc_feature (678)..(700): n is a, c, g, or t
  misc_feature (730)..(761): n is a, c, g, or t
  misc_feature (768)..(808): n is a, c, g, or t
  misc_feature (824)..(891): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnggagtaccctaaaaannnnnnnnnnnnnnnnnnnnnnnnnnnnnnnnnnnnnnnnnnnnnnnnnnnnnnnnnnnnnnnnnnnngg

SEQ ID NO: 11525 - DNA, 828 bp, Diabrotica virgifera
  misc_feature (434)..(465): n is a, c, g, or t
  misc_feature (757)..(757): n is a, c, g, or t
  misc_feature (819)..(819): n is a, c, g, or t
aaatttaactcatggttttaaaagtattttggaaaattgtggtgtagcaaattacttaattgcctaattccaagacccattaatgcattgagtttaaatatctaatcatatttaggatggtttattgtctggaagctcattctaagtagattccgttttattaaagaactgttgaagggagcaagtgactctacaattacggaattgaaaaacactaggagtaaactcaagaggacaagaaaggactgatttatcttctcaaaatgaatattcgatgtgcaaaaccagaagatcttatgaacatgcagcactgcaatctgttatgtctaccagaaaactatcagatgaaatattacttttatcatggccttagttggccccaactaagttatgtagctgaagacgaaaaaggtaacatagttggttatgtcctnnnnnnnnnnnnnnnnnnnnnnnnnnnnnnnnagcatggtcacataacctccctggcagtgaagcgatcccacaggcgattagggctagcccagaaactgatggatcaagcttcagaagccatggtcgaatgttttgacgcaaaatatgtttcgctgcatgttcgtaaaagcaatcgcgccgctttaaatctatacaaaaactctttgaaatttgaaactgtcgaaattgagccaaaatattatgcagatggtgaagatgcatattccatgagacgagacttatctgaattcgctaagaaagttaaacctaagtctgagactanaaacgaagaatagtgtaattatttgtaatttttgtatttatagcgaatataatatacatatntaatattat

SEQ ID NO: 11526 - DNA, 544 bp, Diabrotica virgifera
  misc_feature (2)..(54): n is a, c, g, or t
  misc_feature (56)..(72): n is a, c, g, or t
  misc_feature (74)..(90): n is a, c, g, or t
  misc_feature (92)..(260): n is a, c, g, or t
  misc_feature (262)..(411): n is a, c, g, or t
  misc_feature (413)..(447): n is a, c, g, or t
  misc_feature (462)..(480): n is a, c, g, or t
gnnnnnnnnnnnnnnnnnnnnnnnnnnnnnnnnnnnnnnnnnnnnnnnnnnnnnannnnnnnnnnnnnnnnngnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnngtgatccaattttcnnnnnnnnnnnnnnnnnnnaccttactgatagctgcgtaattttattgaagagttcaaatcgataataaagattgcgacctcg

SEQ ID NO: 11527 - DNA, 115 bp, Diabrotica virgifera
  misc_feature (2)..(99): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttggggtggataaaa

SEQ ID NO: 11528 - DNA, 880 bp, Diabrotica virgifera
  misc_feature (116)..(134): n is a, c, g, or t
  misc_feature (344)..(365): n is a, c, g, or t
  misc_feature (856)..(856): n is a, c, g, or t
cgaaaaccacaacggaaccatagttcttcgtcccaataagcagcaaaaaaagaagaaaaacgttttacgcgatgcatgtaggatattataaaaatatgtatagtggtaatgcaatnnnnnnnnnnnnnnnnnnnggaaattattttgccatgtataataataagacattagaataggtatcatatttttgttgaatgtattttattgtcataacatttgatttcataagaataaacgaatataactaatagtggtgttaatatctttgagatctatctctatcacattgtgtaaatattcctcatatactgttttggagagttttcgattttctggtgttcacnnnnnnnnnnnnnnnnnnnnnnttcagtataggtatttttcttttatctctttcagtgtctttgttaacaatttcgtataaaagatcagaatcaaaattctgtaaatgacacacaaagagagcgctcataagttctgatacaggcgaaaaatattccatgttaatctgtcagtctttacattaaattgcgcatcttcttgatctagtggcgctacataccaaattgagccttgcaatctaattattttcccctaaatcataagttccatgactttcatctataagttctgccctgcgttaatcttatcttacagccttatatagatatgtgggagacacttaaaatatacaaatttcataaatataattttgtgcctctttctctatctttgtttatgatggttaaacttaatgtgatataggtcaaatattattctctgattagaataaatgttgctttttcaatgaaatcaaaagttacaagtatataatatgtatattttgccctaaggncactgatcgagtgctaatatattt

SEQ ID NO: 11529 - DNA, 823 bp, Diabrotica virgifera
  misc_feature (13)..(32): n is a, c, g, or t
  misc_feature (44)..(62): n is a, c, g, or t
  misc_feature (70)..(90): n is a, c, g, or t
  misc_feature (120)..(187): n is a, c, g, or t
  misc_feature (189)..(201): n is a, c, g, or t
  misc_feature (252)..(271): n is a, c, g, or t
  misc_feature (282)..(313): n is a, c, g, or t
  misc_feature (316)..(344): n is a, c, g, or t
  misc_feature (352)..(392): n is a, c, g, or t
  misc_feature (400)..(413): n is a, c, g, or t
  misc_feature (415)..(445): n is a, c, g, or t
  misc_feature (529)..(580): n is a, c, g, or t
  misc_feature (590)..(637): n is a, c, g, or t
  misc_feature (693)..(720): n is a, c, g, or t
  misc_feature (733)..(750): n is a, c, g, or t
  misc_feature (752)..(794): n is a, c, g, or t
ctctccctggccnnnnnnnnnnnnnnnnnnnnttatctgggacnnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnnnnnnnnnnnnnnnnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtactttaataattttatctagaggaaaattatataaatatggaatttannnnnnnnnnnnnnnnnnnnnnnnnnnnnnnnnnnnnnnnnnnnnnnnnnnnctattttctnnnnnnnnnnnnnnnnnnnnnnnnnnnnnnnnnnnnnnnnnnnnnnnnccagttttattattaattattggttgaggttatcaaccagaacgtttataggctgnnnnnnnnnnnnnnnnnnnnnnnnnnnnaatatcattaccnnnnnnnnnnnnnnnnnngnnnnnnnnnnnnnnnnnnnnnnnnnnnnnnnnnnnnnnnnnnnatttaagtttaaatagaatatttatatat

SEQ ID NO: 11530 - DNA, 747 bp, Diabrotica virgifera
cccattcccgcgtccgagcaaacaccgcgttcacgatgttataccgaccactatccatgcaagagagaacccaagaatattcagtgaggcacgacgacatattgtaaatatatgatatagagccactgttctctgtttcatatacagctaagctaaatattttcgcttgacctcctataactactatcttaacgttgtctcttatcggaggatgtattgaataggactaaaattatgtcttcaccaatcacagaaaaattgatattattgttgaggtaatacacctcgatatccaacatgatgctcgtgaatagattgcgcgtcctaccgtaccgaacaactgacatatctatggaggacagtctatatctatgctttgtatgagagtgagcaacagcatttaccacctatcatctatcattgtctgctgaacgagttctctatattgactactagcaaaactactgttgaagaacttctaaactcagactaaaaagaatctgaaataggtcgatctgataaactgttctttatgcccaataactgctgaatcgcgtttgagtcttgatgttaggaggatacataaacatcctgcatagacactgtaactaaccttggtaatgctgctttccatgacgtatttctatgacttcgccactgcgaactctataactcacaccgcttatacagatatgctattacatctgagactattcaactcacatatctattccaatctgccgcttt

SEQ ID NO: 11531 - DNA, 942 bp, Diabrotica virgifera
ctaaatataaattaatattattggccgattcatcttcaatttctaaatatggacatagacaatggaccagaggtgcctgtaccagtcagtggtacaggtgtggatattgaacagtccttcttgcaacagttcagttgtatggggacaacagacaaagatgaattgattcaacaactgcaaaagcttgttggcagccaacttaattactccacagctgcttttttcttggatatgaacaactggaatttacaagcagcaatttgctcatattttgatatagagtctccatgccctcttccatccatgaaattgatctcagatcctgtagcaagtgaacacacagatgtagaaccaaatgtcaggtttacaaaatcctggaacctagttaatagtggtacagagaagtggcctgcaaactgttatgctcaatgttcagatggtgataatttcggagctgatcgagtccctgtcccttctttagatccagaagagggatatcatttggctgtagatatggttagtcccacagtacctggcatatatcaaagtaaatggagaatgtgtacagacataggaacttattttggtgatccaatgtgggtgatagtaactgtagtagaagaaggcacagttgctttgacaaatcaactatctcattttaatgaattaggcgcactacctccccctactagtaactataatcccttttcaccacatcagatccatataggacacaatccggatacggcccctccagatgagaaagacacatccatgttttagtacctgcttaaactattttacagtgccacacttttaagagggagaatgcatttatgtgaatgaatagatgattaaatatattatagttaaaatacatattttgcaaaaagtataagagctcgctgaaagaagagtgattagatatagggtattcattta

SEQ ID NO: 11532 - DNA, 330 bp, Diabrotica virgifera
gtgtattatagggtaagtaaaatatattgttaattgacgaaaaaatatatttgatattagtgataccttacttgcgaaattttacagaatgttctatcactatttaagaaacatatttcttatggatctataccgatcaaggctcatctgatccgaatgatacaattcttaatatactatccccaaatcaataaactactagtatccctatcgaacttcaaatgggtcgcatcgagcatgggacatacacagtgattacatttgtacttactcaagtattgtcataggcagcgctattttatgcatcgcattggttaggaggagtaatca

SEQ ID NO: 11533 - DNA, 396 bp, Diabrotica virgifera
  misc_feature (2)..(234): n is a, c, g, or t
  misc_feature (236)..(311): n is a, c, g, or t
  misc_feature (313)..(392): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnctgt

SEQ ID NO: 11534 - DNA, 71 bp, Diabrotica virgifera
caattgaatgactacaatttaaccctccagctgaacacagatattcttaaaggtcttaatctttttcgttg

SEQ ID NO: 11535 - DNA, 965 bp, Diabrotica virgifera
  misc_feature (53)..(77): n is a, c, g, or t
  misc_feature (80)..(118): n is a, c, g, or t
  misc_feature (120)..(194): n is a, c, g, or t
  misc_feature (196)..(261): n is a, c, g, or t
  misc_feature (263)..(342): n is a, c, g, or t
  misc_feature (346)..(469): n is a, c, g, or t
  misc_feature (483)..(579): n is a, c, g, or t
  misc_feature (581)..(638): n is a, c, g, or t
  misc_feature (677)..(700): n is a, c, g, or t
  misc_feature (708)..(730): n is a, c, g, or t
  misc_feature (764)..(799): n is a, c, g, or t
  misc_feature (802)..(816): n is a, c, g, or t
  misc_feature (818)..(862): n is a, c, g, or t
  misc_feature (864)..(943): n is a, c, g, or t
gctgcgccgcctcgcaccacccctccggaccccccgcttcaacccacgcctcnnnnnnnnnnnnnnnnnnnnnnnnnccnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnntaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattaaaaatttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnctaaagcaattcggccacatttttttcacctgcttatcnnnnnnnnnnnnnnnnnnnnnnnncatcaacnnnnnnnnnnnnnnnnnnnnnnncgaatggccgcgctattctgaccgcgctaaggcnnnnnnnnnnnnnnnnnnnnnnnnnnnnnnnnnnnncgnnnnnnnnnnnnnnncnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnncttatatattaaatttatttaa

SEQ ID NO: 11536 - DNA, 447 bp, Diabrotica virgifera
  misc_feature (396)..(413): n is a, c, g, or t
ctggaccatgccatggatatttcaaccgtatggtggatttgatgctaccaaacttaaatgcttcccgtcatgagttatggaggatgcataggaaacatatattaatctttattgacatatgatctatgtatggatacttgcaatattgataaagattctataaccgaaactctcttctccactactttattgatacaaaatactcgtttgttagccaattgactgcattatttcccaatgttacatattgttagtctctgtagcgcctgatgtgtcctagggtacagagagaggtttaggatggtgaaacttccagctaccaatgatgttgcttgtctcttcgttatcttcctaagaagatgatgtttccttaaatcttgttactagagtcgttcnnnnnnnnnnnnnnnnnntatctattatatcaaaattaaaaatataggacgt

SEQ ID NO: 11537 - DNA, 665 bp, Diabrotica virgifera
ctaataataaatgaatattatctggactctccatataccatttataaccaagaagattaacgatgaataaaaagaagtctgcttatttttattgggacagagactgatcatagaaaaactgatattgatacatatatcatatatgattacaaaacacctagaacaaaagtatcaacaaatgtagaacaatagtcgcaaaacaacttagaatacacccacgctgataattgatcagtatataaaactaagaacatttacaatcaaattactcctctgattgagagataacaacaacatgtcaacttccatccctgcgatacatttaacatcacgccacaagagaaatcacatatgtaatacaatatgataagaactcaagaccctggtccctataacataaagtaacagaaattccctctgaataactggtatgactcgacgttaagatgggaccaaaccctatattgatggatcgcctgtaactttctcatactttgacgaggcataatctttatctgaagaaatgcataatctgatacaaactgggatctatcctctccaatccatactgtcgactaacaaatgaaactatcatggtcatgatatgtgtgcgatagaaagtgcaaacgacgatggctccgaagctataacattgcatctatcac

SEQ ID NO: 11538 - DNA, 602 bp, Diabrotica virgifera
acgcgccccgctaactatctgtataatattattagatcgtttcatcttacgtttcaacatctggacatagactatgtaccaaatagcgttgtatcatttcgtgtcacatagtatagcatatagaacatgacttcttgcaatagttcagatataatttaacaacacacagtgatgaattaatactgcacctgaaaaagcttgtcgaaatccaactaagttactcacacgactgatgttttcttgaaaataataatctgaaatttacctacttacgtctcttcttatatggatataaaatcacaatgacctcttccatccttgaaattgatctctgatcctgcaacaagttaacactcgtaagaaaatccgattcgtcactactaaccggaacttgatgcctagttaattatcgtactttacaactgaactactgactgacatgctctatgatcagatcgtaatcatatctatgcttacccacgcactctctcttctttgtatccacatgacctatatcatttggatgtatatatctgatagccactaggtacctgccatatctctcattacaagcagattgtgtccggacctatcaacgtatt

SEQ ID NO: 11539 - DNA, 706 bp, Diabrotica virgifera
  misc_feature (27)..(46): n is a, c, g, or t
  misc_feature (600)..(624): n is a, c, g, or t
gctaatattagaattaccgaaatgacnnnnnnnnnnnnnnnnnnnngaatatgaacgtaattatgaagcgtttttttcacctgtatattaacaagatgactatatagtttaagtacatcccctccatctgccctatgattaattggaatgaacgaaatatttttagcgagcataaagaaatgtagatcgtcattatattttattgaatcataaaaactaagcgccgatgaaaaagaaaactgccttctctttgtttatatggaattctatattaaatatttctaccttatattactttgacacactgtaacaccctcacaatgttactatacaatactctaaaaattatttttagtatcttatgactttatcttataacttgattacctcttccagattctgaaatcaattcaaattttattatatcattatcttatctaaaagttatgtgtgccaatatatttatgaactgaagatgaaattaccctaacattatccatgcctattaatcgcacgaggacacctgaactgtttcgaatgcgacctcgaagtaatataactattgatcattctgtgatgagatatactcattaaaactgnnnnnnnnnnnnnnnnnnnnnnnnnattgggtataaacgaccctgatgactcgacgaataccaccgttactacatctatatctacaacgacatcctgactaaatact

SEQ ID NO: 11540 - DNA, 760 bp, Diabrotica virgifera
  misc_feature (32)..(58): n is a, c, g, or t
ctttcctacgcgtccgaccgcgataactcatnnnnnnnnnnnnnnnnnnnnnnnnnnnttttttagtttaaaagtgtgtgatattagttttaagtgtatcgcataaatgaattattttatcataacaggaggactttggcgtatatgattatgcaatactcttattccaccagctaacattctcgtgcgtatatttcataggattttccaactccattacgaaccattttttcaattttaacacgcagggtatacgaattgcccgatatgagataattagaattagtggaatagaggaaaacccaccatacacacatgaattatcttttaatccctatatatcttttgatattaagcattttaattattcagcaacgtttgatagatcgccgtttttgattggtcgtaccatcagatcccgatgcatatttgacatatcttcaccgagaatgtgacaagtctgtacatccttatatattagatatggataacgaaatatatcatcaaactaaactatgcctcgacagcacagcggattactgaaaaaccaccgtgagacaactttttaatgagtctggactcagtgctatacgccatattgattataaagaaagctgcaaggtttggagcggaacttcatagctgcatcaaccctcttgtgatctccattaaacaatgtttgttaagcgatgtactaacaatttttgatacattccttgaattcatcgacgcatctcatagtttcttctgcgaccacaat

SEQ ID NO: 11541 - DNA, 856 bp, Diabrotica virgifera
  misc_feature (125)..(155): n is a, c, g, or t
  misc_feature (255)..(272): n is a, c, g, or t
  misc_feature (735)..(756): n is a, c, g, or t
cccacgcgtccgaaacgtagtaaccgatctttatgtacataatcaaaagttgcgaattttcctctaaaacatttcgataactatctgtatgttggttgtaaagtgggtttatgcaaggaaatacnnnnnnnnnnnnnnnnnnnnnnnnnnnnnnngtggtcgtggcaaattatacgtacaaaacggagtagcctgattacactaccactacattttatttatgtatccggctcgaaggaccaatgattagaggcnnnnnnnnnnnnnnnnnntcggcgaccttaagatgatggaaaccactgatagaaaactggcgacgactaacaataatttaaaaactgattaacctagaaggttagctgctacgaacattgtgaaagagatttagtttggcttatagtaccttatttataaattttgtaagacttttctctcgaattactatactgaacatgcaaaagtgtaacatgacctcacaacttattctctttcgcaaaaagacaatttaatcataggcgtggacgtatttttctctcacgaagtataatacagattttgaagtgagtagttcactagcatcatggttagagataagctagcggggaaagtatttcagatgtggcaatataaagaacagaatggatctgcgtctttgaatctgaaattctcgagcgactagagccggtgaagggtaataggtctttactactcggtagtgcccattcattgatttgnnnnnnnnnnnnnnnnnnnnnnatcatttacgtatagaaaacaaaatcataaattaggtttccttcctttctattaagtgtttctagaagacgtgttctgatttttgatacaactaaatgat

SEQ ID NO: 11542 - DNA, 879 bp, Diabrotica virgifera
  misc_feature (27)..(45): n is a, c, g, or t
  misc_feature (452)..(476): n is a, c, g, or t
  misc_feature (833)..(851): n is a, c, g, or t
cctaaagtcagatttaccgatattacnnnnnnnnnnnnnnnnnnnagaacatgtacataaagatgaggcgttgatagtaaatatagataaacaggtagacgacatactaagtgtacatccccaacataaacaatacgttaaaatggaaagaatgaaattgagtttgttaaaagcaaaacatgtgatgtcgttagaaagcaaggaatcagaagcactaatcgccgagcaaaaggagaaaaacgaactcattgaaaaaatggcagtcacgatgaaatatttctaccagcttttacaaggccacggtgttgccccatccaatgttacaaaacaataccaagaaattagtcagagtatcttaggacgtaaacatataacatggggaccacttccagattctggcatcagttcagaagctagtatagcagtatcagatctagatgaaatgcatgagnnnnnnnnnnnnnnnnnnnnnnnnngcaatcaaacattttccatgcctagtaaacccacgaagacgcctgatctgtttcgtatcaaaggtcgtaataatataacttttgcgcggcctgtggtgagaagaacaccagcaaaaaacactaaggataaggagaataaagagaatgggtatagaaaaccctttgattcgacaaagacctccgttacgacagctaaatctacagcgaaatccttactaaattctggatttaaaggtaccgtaagttcgcgagccaagactataattaaccctcccaggtttaaaaggtaataaaaagcactaggaaatttgtgccaatcccaaaattcttgcaataacttttatatttttatgacannnnnnnnnnnnnnnnnnncaatttctgtaaaataaatttgtattga

SEQ ID NO: 11543 - DNA, 702 bp, Diabrotica virgifera
  misc_feature (301)..(317): n is a, c, g, or t
  misc_feature (320)..(332): n is a, c, g, or t
  misc_feature (341)..(358): n is a, c, g, or t
  misc_feature (597)..(612): n is a, c, g, or t
  misc_feature (614)..(626): n is a, c, g, or t
ttgattcattgtaagacaccaaaatatttttacacatcagtaaagaaaacattcttagtttaacgatgtgtaaattaccattgtgctactatattttattcttatcaccgaaataattatctttctcgcccctttgcgaatcaccggcactactatactgtaattatctatttctcactctactattttaactgatatcaaaaactaatatctctattgaaaaataaacattgtatacaatgctttcgtaaagaactgctgtccactgttccatatgtgcttgtctttgacaaactcatannnnnnnnnnnnnnnnnacnnnnnnnnnnnnncttgatccnnnnnnnnnnnnnnnnnncctatttttgggcacgtagctctaaaaataaatattttctttgaatgtactttttcacctcaaatctacattatgaacttccacatcttaaaatatgatattattgattattatatattatctagttgttccttcttctccatatcctctctacctataaaattctaccatcctaccttacgtaccgctgagactagtaagattcctattccagaatatttaaaataaatctattctannnnnnnnnnnnnnnntnnnnnnnnnnnnnttctgtatattattcacgtggatatatcgtattaaatataacctatcatctgtacactcgataatttgaatgatct

SEQ ID NO: 11544 - DNA, 904 bp, Diabrotica virgifera
  misc_feature (108)..(125): n is a, c, g, or t
  misc_feature (127)..(142): n is a, c, g, or t
  misc_feature (144)..(171): n is a, c, g, or t
  misc_feature (173)..(198): n is a, c, g, or t
  misc_feature (217)..(341): n is a, c, g, or t
  misc_feature (343)..(558): n is a, c, g, or t
  misc_feature (580)..(607): n is a, c, g, or t
  misc_feature (611)..(647): n is a, c, g, or t
  misc_feature (649)..(748): n is a, c, g, or t
  misc_feature (750)..(765): n is a, c, g, or t
  misc_feature (768)..(792): n is a, c, g, or t
  misc_feature (809)..(823): n is a, c, g, or t
  misc_feature (825)..(838): n is a, c, g, or t
gcctgcaccgacccggccttccctccccgttccacccacgcgcccgcgcacgcgtgggctataactcctcttttaaaataataacatctttatttagtaagagtaacnnnnnnnnnnnnnnnnnncnnnnnnnnnnnnnnnncnnnnnnnnnnnnnnnnnnnnnnnnnnnncnnnnnnnnnnnnnnnnnnnnnnnnnncgggattcttaattcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataaatttcaattatttacnnnnnnnnnnnnnnnnnnnnnnnnnnnncacnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnccnnnnnnnnnnnnnnnnnnnnnnnnncgaacgctggcatgacnnnnnnnnnnnnnnncnnnnnnnnnnnnnnaaattcataagattttatttttacgttaaacgctcaatttttttaaagacgagagaccctatagag

SEQ ID NO: 11545 - DNA, 690 bp, Diabrotica virgifera
  misc_feature (16)..(38): n is a, c, g, or t
  misc_feature (59)..(94): n is a, c, g, or t
  misc_feature (210)..(230): n is a, c, g, or t
  misc_feature (397)..(425): n is a, c, g, or t
  misc_feature (519)..(549): n is a, c, g, or t
ccacccgcgccgcccnnnnnnnnnnnnnnnnnnnnnnncccacattttttaagtaaagnnnnnnnnnnnnnnnnnnnnnnnnnnnnnnnnnnnnatgggagaaaaaattcttttttattatataaagacacaattctattcttattatacccttggagaatccgagaaatattaaaccaacatgattcactccttattttccaaattaannnnnnnnnnnnnnnnnnnnntctaccggaaaaaaaataattgcaacaacttttttggaatggaatgcaactccgttgtcaaaatctccaattttttaagaaactcaccaaaattatttcataaccatccacttagaattaaatatcttttaaaactaataaaattgaaccctatttagggaagaacnnnnnnnnnnnnnnnnnnnnnnnnnnnnngtgttaaaccaaaaataggattcaaaattttcctcatttaaaagacggcactaatcaactttaaaaaagaataattataacttttaaaaagtcnnnnnnnnnnnnnnnnnnnnnnnnnnnnnnncttaggaatggcgaatataataacattaaaaaaatggccccttattaaaaatttatagggttactaaagggattccgccacctttttttcccccggttattaaaaacctggccttttggattaaaactaaaccctcccccg

SEQ ID NO: 11546 - DNA, 107 bp, Diabrotica virgifera
  misc_feature (20)..(56): n is a, c, g, or t
  misc_feature (58)..(98): n is a, c, g, or t
cgaagaagacccctataagnnnnnnnnnnnnnnnnnnnnnnnnnnnnnnnnnnnnngnnnnnnnnnnnnnnnnnnnnnnnnnnnnnnnnnnnnnnnnnctggggggg

SEQ ID NO: 11547 - DNA, 704 bp, Diabrotica virgifera
cgaattcccgcgctctctttcacgcgcgccgcgagactgtctttatagaggtgttgtgccgtgaaaatacctcttaacaacaacaaagaatcgcaaaacaaaggaacttggaacaatcccgccacaaagggtaccttccacaattgagccacaggatgctgaatcatctgggacagctcaaggttctttcttaaaatcacactttcacactacatgctaaactgctgatgcaatagaggaagatgactcctcataagggacgcagcttctttaaagattgtgattattcataaggtgggtattcctttcaaattgttaaatgatgtagtggtcccctgagccgatgcaatactatttggtaccgctcaagaaagatgacctaaaaagccagtagatcctcttttacaactcttgggaactgttgtacgctacggatattacaatgaactcaatgtagacatatgagacctacagaattttcccctactcataactggttagcatgcgcttcgaactacatatcccatggtatgaataatcctatcattacttccgcttgacatatcgaattatggttaactgtatgataatcctcacaagactctacctaactaccttcgcatacttagatatcttccctacacaaatggacaatatctgattcacctccagctgtgacctattacatgttacttactgtcacc

SEQ ID NO: 11548 - DNA, 185 bp, Diabrotica virgifera
  misc_feature (9)..(36): n is a, c, g, or t
  misc_feature (40)..(57): n is a, c, g, or t
  misc_feature (59)..(75): n is a, c, g, or t
  misc_feature (80)..(109): n is a, c, g, or t
  misc_feature (123)..(149): n is a, c, g, or t
  misc_feature (156)..(181): n is a, c, g, or t
tggatgagnnnnnnnnnnnnnnnnnnnnnnnnnnnngacnnnnnnnnnnnnnnnnnngnnnnnnnnnnnnnnnnncgagnnnnnnnnnnnnnnnnnnnnnnnnnnnnnngttttttagtatcnnnnnnnnnnnnnnnnnnnnnnnnnnntcggggnnnnnnnnnnnnnnnnnnnnnnnnnntata

SEQ ID NO: 11549 - DNA, 351 bp, Diabrotica virgifera
  misc_feature (2)..(190): n is a, c, g, or t
  misc_feature (192)..(210): n is a, c, g, or t
  misc_feature (212)..(302): n is a, c, g, or t
  misc_feature (307)..(348): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgnnnnnnnnnnnnnnnnnnnnnnnnnnnnnnnnnnnnnnnnnnggg

SEQ ID NO: 11550 - DNA, 59 bp, Diabrotica virgifera; identical to SEQ ID NO: 8339

SEQ ID NO: 11551 - DNA, 820 bp, Diabrotica virgifera
  misc_feature (17)..(34): n is a, c, g, or t
  misc_feature (69)..(90): n is a, c, g, or t
  misc_feature (108)..(126): n is a, c, g, or t
  misc_feature (316)..(342): n is a, c, g, or t
  misc_feature (372)..(392): n is a, c, g, or t
  misc_feature (479)..(537): n is a, c, g, or t
  misc_feature (635)..(819): n is a, c, g, or t
cctgcagccccgccccnnnnnnnnnnnnnnnnnngcgcccgcggacgcgtgggctagaactactcttcnnnnnnnnnnnnnnnnnnnnnngcaaaagtacagaaaccnnnnnnnnnnnnnnnnnnncttagtattgtgacagaatattctattcttataacagcaaaatcttattttttgtaccttgcgtatcacgcattctcaattaacacttatatctttatcattttcgaatttaaaacagctcaaaaactaaaattctcctcgtaaaataaatattttacctactttttttgcaatgcaatgttattccgcnnnnnnnnnnnnnnnnnnnnnnnnnnnccccttaaactcatttattcaccatatacnnnnnnnnnnnnnnnnnnnnntcattaatattacatatctttaggcatgagcttacaactacaatttcattacaatttaatttctcactaaaaattacgattacaacnnnnnnnnnnnnnnnnnnnnnnnnnnnnnnnnnnnnnnnnnnnnnnnnnnnnnnnnnnntcaactttttattaacatatcaacttaaattattcaactttagtaatgatgatcacattactattaaaaaatcgcatatttaccaaacatatatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 11552 - DNA, 887 bp, Diabrotica virgifera
  misc_feature (13)..(32): n is a, c, g, or t
  misc_feature (55)..(496): n is a, c, g, or t
  misc_feature (498)..(549): n is a, c, g, or t
  misc_feature (551)..(677): n is a, c, g, or t
  misc_feature (679)..(697): n is a, c, g, or t
  misc_feature (708)..(751): n is a, c, g, or t
  misc_feature (780)..(798): n is a, c, g, or t
  misc_feature (800)..(822): n is a, c, g, or t
  misc_feature (824)..(836): n is a, c, g, or t
gtaaacagtaatnnnnnnnnnnnnnnnnnnnncgataagttaattacgtattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnatttattgacnnnnnnnnnnnnnnnnnnnnnnnnnnnnnnnnnnnnnnnnnnnnctttataacgaatattattattcagtctnnnnnnnnnnnnnnnnnnncnnnnnnnnnnnnnnnnnnnnnnncnnnnnnnnnnnnnctaaagttttctagtattaagttatttatatactaagtcatttacttcgag

SEQ ID NO: 11553 - DNA, 833 bp, Diabrotica virgifera
  misc_feature (97)..(114): n is a, c, g, or t
  misc_feature (124)..(172): n is a, c, g, or t
  misc_feature (206)..(223): n is a, c, g, or t
  misc_feature (234)..(258): n is a, c, g, or t
  misc_feature (268)..(298): n is a, c, g, or t
  misc_feature (305)..(321): n is a, c, g, or t
  misc_feature (323)..(418): n is a, c, g, or t
  misc_feature (470)..(484): n is a, c, g, or t
  misc_feature (486)..(535): n is a, c, g, or t
  misc_feature (614)..(631): n is a, c, g, or t
  misc_feature (638)..(671): n is a, c, g, or t
  misc_feature (702)..(729): n is a, c, g, or t
  misc_feature (757)..(770): n is a, c, g, or t
  misc_feature (772)..(796): n is a, c, g, or t
gatgctgcgactcctgcaaccaccgccgccgttctccccccgtcctacccacgccgccgagaataatacaatattttattactaaaacgcaagaacnnnnnnnnnnnnnnnnnnctagttaacnnnnnnnnnnnnnnnnnnnnnnnnnnnnnnnnnnnnnnnnnnnnnnnnnaccttggcgtatcccgcattattaattaccaccnnnnnnnnnnnnnnnnnncaatttcaccnnnnnnnnnnnnnnnnnnnnnnnnngcacaatacnnnnnnnnnnnnnnnnnnnnnnnnnnnnnnngtattcnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaataatattctattacaatttaatttttagatagaaattaatgcatcacnnnnnnnnnnnnnnncnnnnnnnnnnnnnnnnnnnnnnnnnnnnnnnnnnnnnnnnnnnnnnnnnncctttatcaccatatccatttacattatttaaatttccgactgatgataatattactattacaagattgtatatttacnnnnnnnnnnnnnnnnnnctaatcnnnnnnnnnnnnnnnnnnnnnnnnnnnnnnnnnncaacatctctttctgtcttaactataaagannnnnnnnnnnnnnnnnnnnnnnnnnnnaccgcggtatattgaccgtgctaaagcnnnnnnnnnnnnnncnnnnnnnnnnnnnnnnnnnnnnnnncggcggatgacaaataaactgtctttatataatttat

SEQ ID NO: 11554 - DNA, 741 bp, Diabrotica virgifera
  misc_feature (446)..(499): n is a, c, g, or t
ctctctacacacccgtccgcaaacttaaatgatgttactgttgatcttttaatattgaatcgtagtgtgtgtttaattcagttggtatgactagtggaatttttttaataatggattaaattggtatatagtagtccctatgttgcactcaacaaatcgcttcttcaacataaccttactctacccattcctgatggtaaatgtcattatacgtatatttggatttacgtatcaggagaaaatgtcattatgcaaaactatgactttagattttgttccaacatgcccaaaataattaccagtgtggaacttcaactcgaatttcactcaaatcaagacaaatgacacagctcaaatgtctttctgtgaccagcaactatgtgcaaagatccattcctcaaaggaaactactaattattcctatgtgatacatacaaatacaatannnnnnnnnnnnnnnnnnnnnnnnnnnnnnnnnnnnnnnnnnnnnnnnnnnnnncacataagagaaaccgtgattctgaatctaacagtaatacacattgttagatattgacttgctgcccgtttgtctggaccaagcacgaatttccacgaacccaagaaccttactactgtggtgttggagcgagcatagagcatgttcgagatattgtctaggcgcactatataagtctgttgtatgctgttgtcacattctccgcactcaatgctgctattatgcctgatcagacctaatac

SEQ ID NO: 11555 - DNA, 755 bp, Diabrotica virgifera
  misc_feature (4)..(250): n is a, c, g, or t
  misc_feature (258)..(405): n is a, c, g, or t
  misc_feature (466)..(532): n is a, c, g, or t
  misc_feature (534)..(552): n is a, c, g, or t
  misc_feature (647)..(673): n is a, c, g, or t
  misc_feature (676)..(689): n is a, c, g, or t
  misc_feature (726)..(748): n is a, c, g, or t
ttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattacgattacaaattttcatattttaccatatgtcattatttatctctatatattatcnnnnnnnnnnnnnnnnnnnnnnnnnnnnnnnnnnnnnnnnnnnnnnnnnnnnnnnnnnnnnnnnnnncnnnnnnnnnnnnnnnnnnngtatatttcactacaatatataggtttattaaaggaatcccgcaacctttctttcacctgcttattacaaacatgtctatccgcattacatactnnnnnnnnnnnnnnnnnnnnnnnnnnncgnnnnnnnnnnnnnnacgaccgcgctaatgtagcataatcatcactttctcnnnnnnnnnnnnnnnnnnnnnnnctggatg

SEQ ID NO: 11556 - DNA, 792 bp, Diabrotica virgifera
  misc_feature (7)..(28): n is a, c, g, or t
  misc_feature (46)..(90): n is a, c, g, or t
  misc_feature (104)..(140): n is a, c, g, or t
  misc_feature (154)..(206): n is a, c, g, or t
  misc_feature (223)..(236): n is a, c, g, or t
  misc_feature (238)..(392): n is a, c, g, or t
  misc_feature (394)..(494): n is a, c, g, or t
  misc_feature (509)..(543): n is a, c, g, or t
  misc_feature (545)..(559): n is a, c, g, or t
  misc_feature (683)..(701): n is a, c, g, or t
  misc_feature (737)..(768): n is a, c, g, or t
gaaaagnnnnnnnnnnnnnnnnnnnnnngtaggtaattagtattgnnnnnnnnnnnnnnnnnnnnnnnnnnnnnnnnnnnnnnnnnnnnnaccctggggatccnnnnnnnnnnnnnnnnnnnnnnnnnnnnnnnnnnnnncaatttaaaagagnnnnnnnnnnnnnnnnnnnnnnnnnnnnnnnnnnnnnnnnnnnnnnnnnnnnnaatggaatggtattccnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgataatattaagnnnnnnnnnnnnnnnnnnnnnnnnnnnnnnnnnnngnnnnnnnnnnnnnnncgccacctttttttcccccggttattaaaaacctggccttttggattaaatataaaggcccccccgcccaccggttaatttgaatggcccccggattttgaccgggccaagggagcctaatccnnnnnnnnnnnnnnnnnnnccggaatggagggttggatggaaaaaaaaccggccnnnnnnnnnnnnnnnnnnnnnnnnnnnnnnnngtaaaaaggctaaatttttttaaa

SEQ ID NO: 11557 - DNA, 536 bp, Diabrotica virgifera
  misc_feature (119)..(172): n is a, c, g, or t
cgcccttacccacgccgtccgcgatctagatatgatggctctgacaaatgagtgatgctggaaagaaattggtttcctgtgacgaacaacgcgaaactgatctcttctttatccgggtnnnnnnnnnnnnnnnnnnnnnnnnnnnnnnnnnnnnnnnnnnnnnnnnnnnnnnttaacactggtgcacctttgctcaaagatctatgtgaaattcataatctatgaatagacgcctccgaagaaattgacaatatgtgaaagaaataattgcagatggtgtgctctgctgtcttcaagacgtaacggagagtctctaagatgacacttcagattccccatgccgtgagaggcgatttccatgcctttattggtgccggaaattaccttcatacaccatggcctaaaatgaatcacacgatcaagtaccacgtcttccatgctaacactgtaaaactcttgcgtgaacttgctatatgtgatgctgcctaaattattagaaaatgttatgaccttttgcaacgagaataagaatcgaa

SEQ ID NO: 11558 - DNA, 881 bp, Diabrotica virgifera
  misc_feature (7)..(27): n is a, c, g, or t
  misc_feature (48)..(595): n is a, c, g, or t
  misc_feature (597)..(833): n is a, c, g, or t
  misc_feature (835)..(863): n is a, c, g, or t
  misc_feature (865)..(880): n is a, c, g, or t
cgtatannnnnnnnnnnnnnnnnnnnngatatgttaattatgtattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnncnnnnnnnnnnnnnnnnc

SEQ ID NO: 11559 - DNA, 734 bp, Diabrotica virgifera
  misc_feature (5)..(25): n is a, c, g, or t
  misc_feature (69)..(128): n is a, c, g, or t
  misc_feature (157)..(189): n is a, c, g, or t
  misc_feature (393)..(408): n is a, c, g, or t
  misc_feature (410)..(438): n is a, c, g, or t
  misc_feature (513)..(540): n is a, c, g, or t
  misc_feature (542)..(604): n is a, c, g, or t
  misc_feature (617)..(655): n is a, c, g, or t
attcnnnnnnnnnnnnnnnnnnnnngttccatctaatgatagctacttacccttgggagagactatccnnnnnnnnnnnnnnnnnnnnnnnnnnnnnnnnnnnnnnnnnnnnnnnnnnnnnnnnnnnncatcatctatttattattttacgaacttnnnnnnnnnnnnnnnnnnnnnnnnnnnnnnnnncacacatatttcacacaatttttctgcaatgcaatgttattcgttctcaaatatatctcactttttcagaaataaactaaatttatttattcacactccatctctaattaactacttttatattcttcatattaaatatttctagggctgagcttaacactaacattttattaaaatctaatttccaaataaaaattacgatcnnnnnnnnnnnnnnnncnnnnnnnnnnnnnnnnnnnnnnnnnnnnncattatttctatttttcataaattttctattaacatataaacttaaattatttaaatctactaatgatgataacnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnccttttcgtatcnnnnnnnnnnnnnnnnnnnnnnnnnnnnnnnnnnnnnnncccgcggtaccttgaccgtgctaaggcagcacaatcattagtccttttattgaacgctggaacgaatgcttggatgaaa

SEQ ID NO: 11560 - DNA, 736 bp, Diabrotica virgifera
  misc_feature (263)..(288): n is a, c, g, or t
ccctatctcacccggtccgcccacgcgtaccggattataatgaatgcaatgttgagaaagatcccaaccgtgctcctggctgtaacccaactcaatgtgaagttgctaagtgtgtctgctcatatgacacgaacgataattactgcgcgcgctataaccgcaaatgtaccataaatgataaccatttctactcaatgagtgccgtgtaatgtacataacatcccatctatatgaagaaatcttttcatgcactaaacttaatnnnnnnnnnnnnnnnnnnnnnnnnnntttcttcatttctcacaaatacacaaactactcatcgttacaaagacctacacaaacaatcacatgaaatcacgtcgattgcagtgactcataaaaaggatccaaactactgttcccagatgtcttatgactactgttatgactaagatgtgtgtaactagattgattatagaaatatttgcctacataacctgtgtgtcaatactggtactaatatctcgatacctcatataggacgaaacatgaaatttacaatgattacatatcaattctttatatatgattcatcaattacaggctctcttggacctgtcccaatcttatcttatactttgtacttcaagatacctcataagtgctacggaaatgatcactactgtcccatcacaagccgtcacgtttatgagatagtcatgaacgaattggacagacatgataatcctacttt

SEQ ID NO: 11561 - DNA, 920 bp, Diabrotica virgifera
  misc_feature (286)..(304): n is a, c, g, or t
  misc_feature (711)..(711): n is a, c, g, or t
  misc_feature (818)..(818): n is a, c, g, or t
  misc_feature (846)..(846): n is a, c, g, or t
  misc_feature (870)..(892): n is a, c, g, or t
agggagatataatgtataggtaaaatatttaatgtatgtcgctaacaaagatcgaatgcgagaaccctatatttttatctcgatctatatctatacctatacaaaatacctacctactgagaaatacgattctcgatatgattaccggtactcaaatacaaaagtcatcatagtaatcaaagtaacgaatactgtaaatgattactttatacaaaagtaacgatttgtaacgaatactcgacagtaactataatcaacatcactaatagtcggaagaacgtggacnnnnnnnnnnnnnnnnnnngaaggaaatgccgaagaccaagaagaagatctcgaacacgatggacagaccaaattaagactctggtgggaaaatcacaatatgaaagcgtccatctggcacaggatcgcagccattggatacagcaagctaacaatatttagagtatcaccacgccccgacaaaggctcaaggaatgaggaggagagggttttcatattgaaactaattgtaaaggtgcgtcaggatatgctccgaatgccgtatcgaacctcctcgcgaacttaaatgtggacggcaccctgcaacaacgtactgaacctcgtcgcgatcagggtgcaacatcgaactgttccactagtttccggtaaatccatccacatcaaagtaaagggtcgtcgaaaggttcagaacgaggtttgccgtanattcacatgtggactagttgcgaagcattcggcgtttcggtcattgttattttgaaattgagtgcatcaacatggaatgaatggatgagaattgtactactaatagnaaattatcgagaaaacgaaatattatgngaaccaaaagagtcccagatattnnnnnnnnnnnnnnnnnnnnnnncataagtatataagctgatgcagcaacg

SEQ ID NO: 11562 - DNA, 55 bp, Diabrotica virgifera
  misc_feature (2)..(53): n is a, c, g, or t
cnnnnnnnnnnnnnnnnnnnnnnnnnnnnnnnnnnnnnnnnnnnnnnnnnnnngt

SEQ ID NO: 11563 - DNA, 503 bp, Diabrotica virgifera
ccctttccccccgcccggggatcctattggtttgtaggaacccccttatgtactcgtcctaattccggccttcactagagagattccgtggtgcactcatacggacctggagacttcgaatagagatacgctaagagattccctttgcagtcctagtcttagatctccctgctaacactctattagagtgatcaggttcggaacgcgaagaactccgcagcagcgccatggtccgtaccttctcagtcatacttgtcaatcacggggagggaaacgcggatgttttcacagtcccccatccagaccaccccccactcttctaggagatcagccgctagatataccattttgcacgttggcggatgcgtattctcggatccgtaataatgtggataaagattggttctgacgatggtagcatgtacatttggtggactatgtgaacattggctaacgtgtcgattcagtgtgaggctcgatacacttgttctaaccagtggttt

SEQ ID NO: 11564 - DNA, 750 bp, Diabrotica virgifera
  misc_feature (304)..(343): n is a, c, g, or t
aaattactgcataatgagagccatgagattcccgtccttggaaaccacgacgaataccaacaggaccaagaggtcgtacattccaactaccaggttgcactccaatagaaactaccactccatcgtcctagactatataaacatactaatattcgtggacatcttctcgccctttgatttattcagtaccagtcaaccacaccaccaccgatttcaacaaatttgacatccaggtcataaactttgccatcttggatacgacaatacctgtcaatataggaaacaccaccatccacctcggcannnnnnnnnnnnnnnnnnnnnnnnnnnnnnnnnnnnnnnnccgataattcatatacgttccatgatgctactttatcgccatgatcaatgatacatacaccgatgcataatcttggatactcttgcttgtacctgtgcacatgcctggtattactaaaatattaccatataggtaaccacacatcatgtcaacgcatacccgactgactccaaaggatattacatgacatgaataaatacagcgtcattaataatcaatgactcatgaactcactgatatacgctatcttcgtcatatagagaaaactgaaaggtttgatgcgaacagatatatctgcattaccactacttgtgacgtcctgtagacaaagtaatgatatcgatgtactaaatatttatgatacatatctttgatctgtatacgagtaacaaagaatcttctgcgat

SEQ ID NO: 11565 - DNA, 696 bp, Diabrotica virgifera
ctactgctgagggcagcgaaaacatcccttatgctgctaacatagtaatagctcaagatgagggactaaaagaatgctgtccaacacaaatacactgcaccggatatgcgcatgcgtgagtgtgccgctcatgatgtacccataggtgattttccttctattgttgaactttcgctaactccggccgtgctggtatcaatggggcaaaaggactactgtaatgtggagcttcatcaaacgacgagagttatctttgcctcataataacccattcagtacccaatattaactaattgtttagatatgcagaaaacttgagatctatacattctacatcgcactctgagtaacccgagaacaacaccctgccctgcacgacaaaatgtccgccccattccattatcgatagggaaaatatgacaactgttatggttgaaccttactacacccgatcaatgcatgttggcatatactgtgaactctccctgtattgaacagagcatacgactggtatagtcttgcatacgggacgtggtgtatcgcacactgtcccagtctatggatgacatgatcatcctcatggactactacactgcggattatctggtggagacttgaccgattatctcatgaaaccatttactgaacgtgtctactcattcgcaacacaagtggaaagagtatatgctacagata

SEQ ID NO: 11566 - DNA, 266 bp, Diabrotica virgifera
gtcctttctgtactataatatatgaagagattaaagatagaaaccaacctgggtcacaccggattatactcagatcatgtaaaagtttaaaagacgaacagacttaataatatatgtgcgacaccaattataaactttaatccaacatcgaggccgcaatctttattatctatttgaactctccattaaaagtacgctggtatccctaaggtaattgattcttataatctgtatagaattggatcacaaaaattattaagtaatat

SEQ ID NO: 11567 - DNA, 662 bp, Diabrotica virgifera
  misc_feature (35)..(58): n is a, c, g, or t
  misc_feature (60)..(117): n is a, c, g, or t
  misc_feature (119)..(132): n is a, c, g, or t
  misc_feature (134)..(146): n is a, c, g, or t
  misc_feature (164)..(176): n is a, c, g, or t
  misc_feature (178)..(251): n is a, c, g, or t
  misc_feature (254)..(297): n is a, c, g, or t
  misc_feature (318)..(365): n is a, c, g, or t
  misc_feature (367)..(391): n is a, c, g, or t
  misc_feature (401)..(420): n is a, c, g, or t
  misc_feature (458)..(485): n is a, c, g, or t
  misc_feature (494)..(521): n is a, c, g, or t
  misc_feature (523)..(535): n is a, c, g, or t
  misc_feature (537)..(553): n is a, c, g, or t
  misc_feature (555)..(567): n is a, c, g, or t
  misc_feature (612)..(633): n is a, c, g, or t
cgccccggaattccccccccttccacccccccgcnnnnnnnnnnnnnnnnnnnnnnnncnnnnnnnnnnnnnnnnnnnnnnnnnnnnnnnnnnnnnnnnnnnnnnnnnnnnnnnnnncnnnnnnnnnnnnnncnnnnnnnnnnnnnatattcgcttttacatcnnnnnnnnnnnnncnnnnnnnnnnnnnnnnnnnnnnnnnnnnnnnnnnnnnnnnnnnnnnnnnnnnnnnnnnnnnnnnnnnnnnnnnncannnnnnnnnnnnnnnnnnnnnnnnnnnnnnnnnnnnnnnnnnnncctaaaaattacgattaaacnnnnnnnnnnnnnnnnnnnnnnnnnnnnnnnnnnnnnnnnnnnnnnnncnnnnnnnnnnnnnnnnnnnnnnnnnccaatatacnnnnnnnnnnnnnnnnnnnnctaatgatcataatattactattaacaaattcgtatcnnnnnnnnnnnnnnnnnnnnnnnnnnnnagaattcannnnnnnnnnnnnnnnnnnnnnnnnnnncnnnnnnnnnnnnncnnnnnnnnnnnnnnnnnannnnnnnnnnnnnaaatttgcatgaccgcggcattttgaccgagctaagatagcatcnnnnnnnnnnnnnnnnnnnnnncctcgaatgcatggttggatgatcacaat

SEQ ID NO: 11568 - DNA, 69 bp, Diabrotica virgifera
  misc_feature (2)..(68): n is a, c, g, or t
gnnnnnnnnnnnnnnnnnnnnnnnnnnnnnnnnnnnnnnnnnnnnnnnnnnnnnnnnnnnnnnnnnnnc

SEQ ID NO: 11569 - DNA, 730 bp, Diabrotica virgifera
  misc_feature (2)..(28): n is a, c, g, or t
  misc_feature (146)..(531): n is a, c, g, or t
  misc_feature (538)..(575): n is a, c, g, or t
  misc_feature (595)..(608): n is a, c, g, or t
  misc_feature (611)..(633): n is a, c, g, or t
  misc_feature (641)..(663): n is a, c, g, or t
  misc_feature (693)..(724): n is a, c, g, or t
cnnnnnnnnnnnnnnnnnnnnnnnnnnncgatacgcgataaacatcccgatattaccgttccgaaaccggctagtcgtacaagactatctatagagtaatgacgggaattcagccaacatttttttcgcctcgtaatgataccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11570 - DNA, 72 bp, Diabrotica virgifera
  misc_feature (21)..(22): n is a, c, g, or t
taacagcgtaattttattggnnagagtcaatcgataaataagattgcgacctcgatgttggattaagtttat

SEQ ID NO: 11571 - DNA, 716 bp, Diabrotica virgifera
cccgcgggggccgcggccgggatacccccccccttttttcccgcccgcgcccactcaggattgtgttccgacacttgtgttactagagaagaaaagccactcgcaacattgtatggacttcattatctatagttacaagatcgtaaatataattacgcatataccaagaactcgtcaccagagaccaatcatgtgatttgctccctataagtcaccctctacataggttcgataaaatgcaacacatccacgaagctgctactcctactcaaatataccacgctgtattgggagctacacgacttgcacccttcctcgctgagtaattcaataaacagaatgttgctcacatgaacacatgaaatcatcataataacctgatacgaaaataacttcggaaacatcttataccacctgtaacgaacttgcaggcactactgatgatacattgtgtgccatcttgaattttgagcgaagatatacttgacattatgatgaccatcttctcagttgtacctgaactaagacaagatgaccgtgataagcagtaccctcgctgtggaagactcaacaccgttaaattggctgatctagtgtgagccgaggactatgacaaagtatcatcagctgttgtatactacactgattattccgactgcttgctatgagctgtgaacagatcgacatgcaaatcattgcatcacgtgatctctgct

SEQ ID NO: 11572 - DNA, 917 bp, Diabrotica virgifera
  misc_feature (675)..(698): n is a, c, g, or t
ctgtcactaaaaattataaacgtcaaaattcatagtaaataaggtatcaaagacatcctgtattgtttatccttgtttgacttattgtggtttctatggacaagcggcttaattttgcgatacgagtttctgtgggtaaaaaggagacctaacataaaaagtaattcgtgaataatttcatgcatgtgcaaagatataattgaaaaactataacatggtcggcttcttccatgccatagatacttcactgaagtatattaatgatctcaacaaaaaaatataactatgaataaccctaactataaataggtcatgcatatgcatattggcaatgatagaagagaagagataagaaactcaattggtaatttatgaaaaaaaagtaaaggaaaggtagataagaaaaaagaactgtgatagccgaaaagaatagacgactgcagtgacagatgacattttgacagttacgaaaaagaagaactgtgacagccgataagaaaagacgacattttgacagattagaaataaaaactgtgacagccgagaagaagaagagtgcggccatctttgaaggcgtggcatatggggtcagagcgggaatggaaggaggtagtccaagtaacccatactctgcttatgacttctgagagtaacgattctcttaaaagaaaaggnnnnnnnnnnnnnnnnnnnnnnnnctgaagatatttcgacaaaaattgtagcagattaacacattgcctgcaatgtcgcccaaaattgactagacaaaattttgttgtagcccttgtcggttatacagtgcgctggaatcagtgttaccctccctaattaacttatttgtttttaacacataagcaaaactctaggacagatcgattttaaaataatcataagttattatagcatcaatgttt

SEQ ID NO: 11573 - DNA, 894 bp, Diabrotica virgifera
  misc_feature (270)..(311): n is a, c, g, or t
cgagaagttcccaactgagttacgaaagcgtttaagaagacaacatgaagctaccccaagaaaacccggtacacccgtaccaacttaaacaggtttttgcagtttgattgacaggggatacacaaaaaagtttcataaaaattaaaattgtttttacagaatagttcaattatattttcgcgggttcacaaaatttggtagacccatagacataataaaaatagactaggcgtcgtgtggaatagaggaaattccacccaataaggtccnnnnnnnnnnnnnnnnnnnnnnnnnnnnnnnnnnnnnnnnnngctgacatgaagcttaaaccatagacagacaaattcaacctaataaaccctttagataggaaaattaataaaacttaatgcatataagttattatttatgtcttttatatagtttcgtgtcttttggttggtatttcattgatttccccccacccctcaaggcaaatgtctaggtatgccaagaatcgtggagcaaattagtgtaacgcggatcactcattcactcgatcagtggtctatctctctttagcagcgcttgcgcattacacatatgccactgtcactgtactgtgtgttaagtataacataaccttttgactgccttccgtttaactcaacaataaacttatatatagatataataaatgcacctgccaccttcagcgttctattattcccatctatattggtttggaagatcacgcgcttatgacaaagatagctagaccacttaatcctaatactatcgtttcacctctgttcacagaggactcataccttacttagtctattcttattatgtctaagagtagacctcataatatatgtgctatttaaacattttggacgggctcaatgcaaa

SEQ ID NO: 11574 - DNA, 818 bp, Diabrotica virgifera
cacgacccctgttctcatttaaaggaatcgtcgatgacgtcatcgcgcccaaatgggtgacgtcactggtatgatatataatatgccaaaaagtcgtggtttaaaaataaaaatcggcctgtttcggggcttttttttcaaaattgtccattctctagagaatgagtttgttccaacctttgcgtgctcactgtataaacagggatacttagcaatacaaacaaccaatatatattgtacttttattttagatattatattctatataaaaactctacaagtgtctttctttgaaaatttttccattaaaaaagttgaaagaacgctatatttgtatatttggatgagcatgactttatatcgaaattgatatacaataaaatctgtcacatccggatcaatgtggcgacagaccgatccggatatgaaaaaatccgcatatcaactggatatatgaaaatatcgcacatatatccgctttttttagagtctctgtaacgttttctccttcatccattccagcaatcaacgccatcaataactttcatcgattgacacgttttatagattctataacagtttggtccataggctgacagagggatgtaaccagaaagatactttatttctccatctgtttgctcttttcttctgtatcggtatgagatggtgcgctgtccaatagcaggactgcctttctcgcaacatccgtatatggggaggtccgcatgggacaggttatattgtactactcaattgactctatgtatatgattctaattttattactgatttataattagaaaatatcctttata

SEQ ID NO: 11575 - DNA, 921 bp, Diabrotica virgifera
ctatttcttgatataaaagaagcttatgatagtgtagactggactatactacgaaataaaatgatcaacttacaaattccagaagaagtagcaaacaccatacttaaactctacataaatagatcagtagcaatcagaaaagataacggcatcatttctgaatatcttttggtaacaaagggtttacctcaaggatcggttttatcaccattacttttcaatatatacacctatgatttacacaatatttcacctaatgcaaatattatttagtacgctgatgatttcgtcttttacacacatgcaagaagttatgataaaagtttacaaagtttgaatacagcacttacacctttcatccagaatataagtaatctaggttttgatttatctccgcataaatcaaaagtggtcatttttacccgacacaatattccaaattgtacgaccatacagctgaatgatattaatttttctttaaccaaccaaataaaatatctcggaatcactctagataaaaaattaacctttagagcacacattgaagaaattttacaaaaatgtagtaagggattaaacttcttgaaatgtattatgaggacatagtggggggcggagccccaaacagccttgactttttataaatcatatataaggtccattatagattatgacagcttcttatatggtagtgctaataataacttattaaaaaaattagatacctactttacaaaacaaagctttgcgactctgcattggtgcaatgacatcaactccaattgaaccgttatgagtagatactgtggaacctccattagagctgagaaggcaatcataggcagaaaaatgataatcaagtgcaaagtcaaaaattcatcacttactcaaaagatctccaccctaaatattcaggacctt

SEQ ID NO: 11576 - DNA, 899 bp, Diabrotica virgifera
gctttgaaggcgccaaattgttacaattttgttttctgtacattaaattacacaatttttggattaaattacacattttaaaatggatattcaaactataacaccacttcagtttgccgaaaacgaacacaatttttcggaattattaaaagatgaatccatcaggaacaaaatacctttgttaaatgtaaataaaatagaacatttgggagacctaaaactggtcagatttcatggtatgattcaagacatgcattctcctgagtactatttggaaaaatttgaagtggtgaatgaagatacaaaagagagttcctgggttattggaaaatacagggagtgtatcaaagtgaaagaaagtgtagagcaaataaattttcataacaattctaatattacttctgagagacaggcatttgtggttatatcaataccagcaaaaaatagttgggtaaggtcagtagaagaaacgcatacaatccaacccacaaaatgtgctgctgcaaacacgtctagtggtaaaagaattcatgaagaatccatggatgcagaagaaacggttggtccctcaactagtagaattccggggagtaagaaaatctgtagtgaaacaactcaatctgtagataataaaccagcgtcaagccagcaaaatgatatatttccactttcagatacattgataaatgatcaaaaacaagtgtttcacattaaattgtataacgatcaagatcaattaaaaatcaatgatgtatgtgagtttgttggatttttagatatagatccgtccacaaacgcaaatatgtgtattggtgatatggaaactgaagagtcaacttgttttataccaaaaattcactgtgtacattttacaaaattgaagcataataaccctctag

SEQ ID NO: 11577 - DNA, 961 bp, Diabrotica virgifera
acgcgctgcgaggcaccggcgccgagaattcccggcgtcctatccacgcgcgccggcaaatactgatatggccacatctgaaagtttagctatagccaaagatgtagatattgatggcagaaggacactggctgttgtaacaaaattagatcttatggatgcaggaactgatgctatagacatcctatgtggtagggttataccagtaaaattaggaattattggagtggtcaatagatctcaacaggatattatgaacaacaaatccattaaggattctttaaaagatgaagctacctatttgcagagtaaatatcccactttggctggtaggaatgggacgccatatttagctaagacattaaacagattgttgatgcatcatatacgagactgtttaccggatttaaagacaagagtcaatcttatgatgtctcaatatcaatctttgttaagttcctatggagaggatatatccgacaaaagcaaaaccttgctacaaattatcacaaaattcgcatctgcgtattgttcgaccatagaaggaactgctagaaatatagagacgactgaactatgtggtggtgccagaatatgttacatatttcatgaaacttttggaagaactttagactcaatacatccattggcaggacttacgaaaatggatatcttgacggcaataaggaatgctaatggaccacgtccagcattgtttgtacccgaagtttcattcgagttgttagataaacgacagataagacgattagaggagccatcgctgcgttgtgtggaactgattcatgaggaaatgcaacggattatacagcactgcggtaacgaagttcaacaggaaatgctccgatttccgaactctacgaagaatagtcgacgtcgtcacgcagctactaaggcgtcgcctgcccacaactaactcaatggtagagaatcttgtcgcgat

SEQ ID NO: 11578 - DNA, 651 bp, Diabrotica virgifera
  misc_feature (2)..(184): n is a, c, g, or t
  misc_feature (186)..(307): n is a, c, g, or t
  misc_feature (316)..(379): n is a, c, g, or t
  misc_feature (423)..(443): n is a, c, g, or t
  misc_feature (445)..(473): n is a, c, g, or t
  misc_feature (484)..(543): n is a, c, g, or t
  misc_feature (545)..(587): n is a, c, g, or t
  misc_feature (589)..(614): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgattaacnnnnnnnnnnnnnnnnnnnnnnnnnnnnnnnnnnnnnnnnnnnnnnnnnnnnnnnnnnnnnnnncttcttcattaacatataaatttacattatttaaatctcgtacnnnnnnnnnnnnnnnnnnnnncnnnnnnnnnnnnnnnnnnnnnnnnnnnnncttactaaacnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnncnnnnnnnnnnnnnnnnnnnnnnnnnncacctttttattgaaagctgcaatgaaggattgcatg

SEQ ID NO: 11579 - DNA, 870 bp, Diabrotica virgifera
  misc_feature (387)..(403): n is a, c, g, or t
agcaaaatattcatactgtttattttgttaaacatagtttgtggtggacgtattttttaatacaaataatatactgtgcatgtaatattagtatttatatatcgaaaatcgcaaacaatgactgttaccagcggcgttagctgcaaaattaagcaaactaggaattattcaaggaaaacaaaagcctaatgaaccgatcaagaagcaagactttaaaggctcttcaacttgtcccaataaatcaaatatctaccatgaatgtactgtatggtgtgaaactcactgtaagggagtacaaacgcctgatccaaagtattttagaaacttgcaaaagttattagtgaaataccctattccatcaaattggactgaaatatttgacaaagnnnnnnnnnnnnnnnnntactggaatatggagaatgatcttgtttcttggcttcccccaaagcaccctcaatccgtgaaagggcaaagcgcagcaaaacttcttgaaaatcgtttgaaaatgaaggaacggtaagaacgcctggaaaaagagaaagaaaacgaaaaacgggagagggaaagggaccgtgaaagagaacgagaaagggagcgagatcggatacagaagttcggatgaggaagagagaaatcatcgaagaagagaacgtgaacgagagcgagaaagggaaaaggagagggagagagaagaaagataacgaaggaggcaagaaagacacaaaaagagaaaagatgagattgatcctatggatcctgctgcttattctgatattccagcaggtgtgtggagtgacggattggaaaataacaagaggacagataatacagcatctgatgttctgtatcagcaaagaccataccctgcac

SEQ ID NO: 11580 - DNA, 720 bp, Diabrotica virgifera
  misc_feature (416)..(435): n is a, c, g, or t
cgcccctccacgcgtccgttaaaatatactgaaaatgtagacaattgtacaatatatgttgagaatattaaagccgatgctaaccatgagtgggtttcacggatattttcaaaagttgtaaatgaggtttatgtttccataccaaaatacagacgtaatagaacaaacaaaggttttgcttttgttgagttctaaaataaagctgagtgctacaaatgctcttacatactttgatagaattgagagtaaaatgccatcataagcaaacctcgaacaatttaaagagaattcaaacatttcagcaaaacgatgcaaatgatttagccaattcaaaatgcgccactgatacaaaagaatactaccctgaggaaatgcaggaagctaccaacaggaagaatgaggaagattcaaatgannnnnnnnnnnnnnnnnnnntggattgtccggaaactaacaaagatcgaatataaaactatgaatccgacaatataaacaagactgaagaacatttaagagaggctaacaataaagcgaaagtgtaccatgatgactctgacccaaaaacagatcatcaagaaaatatggaatttgaagacattgaacatgataggaagagctagcacaacaacgatgataacaaaagtattattagagagataagactacgaattttatcatagccagaatgcaaaaatatgataaatacatatttggatctac

SEQ ID NO: 11581 - DNA, 543 bp, Diabrotica virgifera
ttctgcatggcaagggcacttggtaagaatgactagaagtatcatctgacgcgattgagatacaaacacagtatctagatctctcactggacacatttactgatgagtgcatgacataacggatgacatctttattttccgaaggaaaacccttttaagactccaggaatgacaggtttaacgcaaatttagctcgtgctgatgttgataggaatgtggatgaatgtattacggttgtgcacgaacctggagatgatgaatttgaatatgagaaaagcctagatatggtggttaccagacacctacttgaaaaactcaattagaaatgacaagacatgatggagactcctatactaatgatgaaacacctgaccttgcttcacgattaccaaaaagtgcgcgcgcatccatactctctgtctgttcaagtgtgagaagaatagaagtagggcggaattgacagaaacaagaggagtgcctttactgtcttacatacgcattgatattgatgctatttatataaaaaccctatagttgagatga

SEQ ID NO: 11582 - DNA, 312 bp, Diabrotica virgifera
  misc_feature (261)..(291): n is a, c, g, or t
  misc_feature (293)..(310): n is a, c, g, or t
gcgccggaatacccgcggcctcttacacgcgcgctgttacgtataacagacgtaattttactgctacaggtcaaatacgataatataagattgacgaactcgaatgtggagaccaaagtggataaatggtgtagaatttatatatataaagtgctgtcccaacttttaaaatttcacatcggtctgaatacataacggggagaggcagctggggtacaatctgtaaactattaatatattgaaaaagtacaggaccaaacnnnnnnnnnnnnnnnnnnnnnnnnnnnnnnngnnnnnnnnnnnnnnnnnnaa

SEQ ID NO: 11583 - DNA, 683 bp, Diabrotica virgifera
  misc_feature (431)..(448): n is a, c, g, or t
ctaatatacgagataataacaatattattcctaaataataaagctcaaatttaaactactaagaacaaagtaacattgaacgaaacgaagactgatatacattattacagagttgttatctctttacactacgatcatataacaatatgttttataaacaacaagcaaaatgtggattaaacagctataatcttatggcttactgaatgaaaagaaaggcagatatagccagaaggtggtaaggtataccattttttatgtgtttcattgaaaactacaacgacgggtgggaagaaaatcatattgctttaagtaaattaaataagaatattatttttaaactaaaaagataaagttatacagagacaatgctacaataaagagctatagaatacgataaacaaggcttttaagtattaaatatactgacnnnnnnnnnnnnnnnnnntgtggagattaaacaataactcaatctatctcaataacactatataaaaacaaaaaatacttgacccaaatgtatctgatacatactaataaattaccataaacataatagcgaaattattatagaacagttaatatctataataaacgaacgcaaaatcgaagtagcactaaaggaaataattgcggtaatagatataacaacaatctctgtgctcactgaaatacgatcaact

SEQ ID NO: 11584 - DNA, 879 bp, Diabrotica virgifera
  misc_feature (73)..(93): n is a, c, g, or t
  misc_feature (596)..(625): n is a, c, g, or t
cacatgtgaactaaggtaactccacctgcactatttaaaattcttctcaagaattagaccataagtgtacgtnnnnnnnnnnnnnnnnnnnnnattatgagtgtgatggaacgatttcctgccagctcaatacaagaaccgagcgccttcatgagtcaagaccccatggacatgtataataatatactagtctttatcgtaacaaattcaaaccaatcccaccccacagaaatgcacatatttcagtgccagagtatatctgctcaagatttggtcgaagacttaaaagaactccgaatgggtaaagcaccgactagaagccgtaaaagtagcattccacctcccagccacaaaccaccccaaaacgtaataagcccatccagagatgtaactagagactactacggatcagactcagaactcacagctaacaatgacgactccagctctacaacaagtgaaaagtatgaaagagatgtcactatcctcaaccactgtttcgacgacatagaaaagtttatagccagattacaacacgcagctgctgctgcacgagaacttgagcgcagacgaaaaacaaggaaaactaaaaaacnnnnnnnnnnnnnnnnnnnnnnnnnnnnnnggacaaagccacccccagaaaaggagttcgtcgatattttccagaagtttaaattatcctttaaccttttagcgaagttaaaggcacatatacatgatccgaatgctccagaactggtccacttccttttcacacctttggctttaattgttgaagctgcgcatgatcagtatttcgaccagcatataccccataatgtcatttctccactactcacaagggaagcaggtaacttattaatgaactgtgtcact

SEQ ID NO: 11585 - DNA, 734 bp, Diabrotica virgifera
  misc_feature (21)..(39): n is a, c, g, or t
  misc_feature (41)..(63): n is a, c, g, or t
  misc_feature (65)..(103): n is a, c, g, or t
  misc_feature (119)..(172): n is a, c, g, or t
  misc_feature (198)..(223): n is a, c, g, or t
  misc_feature (240)..(275): n is a, c, g, or t
  misc_feature (296)..(348): n is a, c, g, or t
  misc_feature (388)..(418): n is a, c, g, or t
  misc_feature (421)..(441): n is a, c, g, or t
  misc_feature (644)..(669): n is a, c, g, or t
atttattttaagataatgagnnnnnnnnnnnnnnnnnnngnnnnnnnnnnnnnnnnnnnnnnnannnnnnnnnnnnnnnnnnnnnnnnnnnnnnnnnnnnnnngaagatttatttttcnnnnnnnnnnnnnnnnnnnnnnnnnnnnnnnnnnnnnnnnnnnnnnnnnnnnnnaatttaacagagctagaaaattatcnnnnnnnnnnnnnnnnnnnnnnnnnngataagttttttgtagnnnnnnnnnnnnnnnnnnnnnnnnnnnnnnnnnnnngtgagaaataacattacatcnnnnnnnnnnnnnnnnnnnnnnnnnnnnnnnnnnnnnnnnnnnnnnnnnnnnngtatttttaaggatgatcttaaaaataaaattgtattacnnnnnnnnnnnnnnnnnnnnnnnnnnnnnnnagnnnnnnnnnnnnnnnnnnnnnctatgatttatttttagtatatgattattcttattttttatcacttgttgattaaaatatacatgttaacttatttgcagttgctactgatgatgatattaggattagagagttgtatatttaagagaaatatatgggattgatactaggaatttggctgcatttgtttcacctgcttattataatgatgtcgtctttgatgnnnnnnnnnnnnnnnnnnnnnnnnnnctcaagttccaggtgcgacagatatggaccgagctagggtagcgtagacgttcccgtctccattg

SEQ ID NO: 11586 - DNA, 495 bp, Diabrotica virgifera
  misc_feature (220)..(259): n is a, c, g, or t
aggaaacgaaaaaaagcacacagcaagagaaaggacaaacaaacaatagccccccttatattttaataacaatagacttagctgtaacacgtctaactatagacgacttttacatcaattcattctgatacctatctcagaatgaattgaaacattattatgatgtcacaaatattagattcacagcgataactttatacatttctatactatatgtacnnnnnnnnnnnnnnnnnnnnnnnnnnnnnnnnnnnnnnnngaggctaaattaatgcattttacatagattacttattactgtaaaattgatcattcttctatttgaagaaaacattgaaataaacttaccaattgaatcatttttatgaatataactatagcatatactatgaatttttctattattataaatgtagccttctccttcgattactaaattgattttcttgcaacttccactgtgcgaacaaactaccttaacagatcatgatggaa

SEQ ID NO: 11587 - DNA, 913 bp, Diabrotica virgifera
gggctaatttttaccaaaataaagcttaaaaaatcagttttgttataaagttcactaagatgcaacttggcacggcatgcgacattaccaaatgttaacattatggtagtgctaaaagttgatataatttttcgttattttccatattgtaaaacaaatttgcaccgtactcctaaatagatcagtatccaaaaagttaaggaacagtattttacagctgcataatgaatcacgtatttaccaacatcatggtagcagcacaaatatctttaaaatctttaaacccgtttatctcaaaactactaatttcgagttatcaagttatagtattaagtttaggtggttatagttatggtagttataggtggtttatatatatggtatggtttatgtttattactatatggtagttatgatacttatggtggtttaggtagttatagtattaaaattaggtttaggttatagtattaaggcgacgatatgagaaatgggttctgtagattcagttgatgtactgcgcatttaatatggaagttcaatttggtctataacatattttttctatgctcatactttaatataggatcactacctgtatcataatgagcttcattatgatacagcttttcattacgctgcacatttttaactaatagaatcgcgatatggtattagcgatgaatgtggctcacgcgcaatgaccaatggcgagtgaaatacatacgctttgacagttcttaatatctacacaaactgactaatttaaaaattaaatctttttaagaaaatgtctgaagacggtagggatattaataatttatccatcaaaactcattctaataattcgtagtattgaaaatataaatgtatcaacaaaataattaattgaaccatatcactacttaatttc

SEQ ID NO: 11588 - DNA, 171 bp, Diabrotica virgifera
  misc_feature (2)..(80): n is a, c, g, or t
  misc_feature (82)..(96): n is a, c, g, or t
  misc_feature (98)..(165): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnngnnnnnnnnnnnnnnnnnnnnnnnnnnnnnnnnnnnnnnnnnnnnnnnnnnnnnnnnnnnnnnnnnnnngtttag

SEQ ID NO: 11589 - DNA, 524 bp, Diabrotica virgifera
gtgaatcataagcataattcacatgtgctattgctttgagtgactaagggcatggtaagataaattataaccatatgaaatgtaattaaatagatttcttcttacgtaaaaaggaacccacatttcctggagttcatagtgacacaaactagaacatcgtctatgcataaataactccttccgatagtacctagaaactaggttctattagttcaaaacgacacttgcgaagaacaacttggaattcgaatatctagctgtacatctgacatactttataatcgccgtaatatctgatcatccctcatgctacatataagatgttatgactgtatcgacatacaatcaacatgtactaccatactaaatttatgtaacagataatttcttattgttggctctgttcctctacaatgatcatgataaactgttaccacatcccagaataacaaaagataggatatttacccactcctccgtccatgactgtacgacgaaatagcacgatgaagatgtcatccaga

SEQ ID NO: 11590 - DNA, 890 bp, Diabrotica virgifera
  misc_feature (576)..(590): n is a, c, g, or t
  misc_feature (716)..(735): n is a, c, g, or t
  misc_feature (825)..(825): n is a, c, g, or t
  misc_feature (842)..(842): n is a, c, g, or t
gtagcttcttatactttggacatagaagcagtaagttgcgacgaaatgtacgtggatgtaacaaaaattctaaggaaaacaggactgacagttgacgaatgggcatcgcacatcagaaatgaaattagaactattacaggctgcccttgttcaacaggattcggagcaaatcgactgcaagctagactagcgactaggaaagccaaacctgagggacagttttatttgaaaccagaagaggtagaaaaccatatggtcgagttgaccttgtccgatctaccgggagtaggtagagctacactagcgaagctacaaaaactaggactatttacatgtggcgatgtgcagcttacttcactaaaagttctccagaacgaaataggccaaaaagcaggcgaaaccgtaaaagaacagtcagtaggagttgacagcaaaccgttgaacttttaccacgagaggaaatcggtatctgcagatgtaaattatggaattcggttcaaaacattacaagagtgtcacacgtttctcgaaaatctctctgccgaagtgtacaatagaatgaacgagattaatatnnnnnnnnnnnnnnngactttaaaattgttggtgagagctccagaagccccggtggaaacagccaagttccttggccacggaatctgtgacagtctgactaagagtaccacctcaaattcacttttaaacaacccacagannnnnnnnnnnnnnnnnnnnatcttgtacgaaaagctaggagctgattttgctgatttaagaggtgtaggacttcagctaacaaaattagaaaagaacgcctcgattaantaagccctgactagctnttttaagcagcacaaccaaaataaagtaacggaaaagctacgactgct

SEQ ID NO: 11591 - DNA, 713 bp, Diabrotica virgifera
gatgctgcgcctcctggagcggccgcgccgtcattcccccttccacgccgccgtccgcggacgcatgggctcataattaatgttgtaattgatgtcacaacgacagtcagctctcctattaataacacagctagtacaactgaacaaaaaccctgtggaggccttttctgcaggtcttatagatgatgatgacatctacatatgcgaagaactcataccatcactctcctgatacattatatgcgtgaggatttttcaaatgccgtctttattttccgagggaatacccacttacgcctccacgaaatgaaatttctatcacaactttaggatcctaatattgatcagaaggtggatgtatgcatttccatattgcgctaacctggaaatgataaatttgattatgaaaaatcctactttcgggtgaataccccaacatactgactaaactatttgaactatctgttactttcaatgataaccgatcctaatgatgaatcacctgcccatgctcatgctgcaaaagaatgattagaatcatactcaccaattcaaccctaatgtagacaacatgtgtccggaaatcacaacaacaagatgagtgatgggactgtattaagtttgaattgttagccgactaattacataaagacccatagttgatatgattcccggtctgttccaatctacatgactttttgtatgccatttcc

SEQ ID NO: 11592 - DNA, 723 bp, Diabrotica virgifera
  misc_feature (2)..(323): n is a, c, g, or t
  misc_feature (333)..(346): n is a, c, g, or t
  misc_feature (348)..(422): n is a, c, g, or t
  misc_feature (424)..(495): n is a, c, g, or t
  misc_feature (503)..(534): n is a, c, g, or t
  misc_feature (541)..(564): n is a, c, g, or t
  misc_feature (572)..(623): n is a, c, g, or t
  misc_feature (625)..(639): n is a, c, g, or t
  misc_feature (672)..(716): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaattatnnnnnnnnnnnnnngnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnggtttagnnnnnnnnnnnnnnnnnnnnnnnnnnnnnnnngtattgnnnnnnnnnnnnnnnnnnnnnnnngtaaagannnnnnnnnnnnnnnnnnnnnnnnnnnnnnnnnnnnnnnnnnnnnnnnnnnnannnnnnnnnnnnnnntatatagtattgtaagctgaaatgaagggttgnnnnnnnnnnnnnnnnnnnnnnnnnnnnnnnnnnnnnnnnnnnnngttaaga

SEQ ID NO: 11593 - DNA, 788 bp, Diabrotica virgifera
gtcatctgcagatagatattcattgtcctccagctggcggtacttgtagaaagagcaccactcttatcgaagtgattatgtgatattgtgagtgaaagaggctacttttttcggggactactacgagatactgtaaaagatttaagtacttgtagtatctgtaggggacaaaatgacccacatcacactagttcttctagccttctgcaatcttttctgccaatcactacaagatggacataagaacaatctagatgtgaacgagccaaatattgtattacatagagctgcttgcggatataaaaagggaacaaaatcaagcctacattgatggtttagtggacaatatcatgaacaatggaagtggtgatctgttgtggtctatcatgtcctaaattgggaaggtggatcgagatattctagagagattgattgctatgctgacgaatagacgaacatggagggaagaatacacattccgaaactcataatgttttaggaggtgttagtaatcttgctaaaattggaactcttctaagcaatgttacaaggagtgatacagatgcggataatgcagacgtcttgaaaagacttgaaagcgttgctcgtcttgagggtgccttacacggacttactgatgatgttataggtaaagaaaatctagacagctctccctatgtgcttaagagcttaagagccatacgatccctcttagctcaaggccaaggtaacaatggatgtgctagagctcttctactatgactgagatcacttctctgtcaagccaa

SEQ ID NO: 11594 - DNA, 275 bp, Diabrotica virgifera
ctcacatctttaatcttgcgcttatttaaaataacagtcgttttatacaattttttatacgacgcattagtataaaaaacacatattgtgcgtgtactttgtacgctcgtaagaagatatacttctatttaagatttctacaaaataaatatactttcaacaggttatttgaattttattataagactaaactaatttttacttactactttccaaaacatagtttattacatcaataccaaaaaatacaaactagggcgctctctctaaaatac

SEQ ID NO: 11595 - DNA, 603 bp, Diabrotica virgifera
  misc_feature (434)..(517): n is a, c, g, or t
ccccccgcgcgcggcggttcgtgagtttttgtaaaatcctatattatggtacaagtgaagaagggtattatttgatgaagtgaaactactttcgtagccatcaataaatatttttatctaccaagaggacagactgtgccccgtgtccatcagtgacaaaaaataaatgttaatagaataaatatcttcttccttacatcagcaaaaggtgtacattagttggggacgaccactgtctagagtaatttagtagtcgtgtagcgaactacaacctgaaacgtaacctaatcgttgaattaaacgacgacccttgttgatcaacctattatgtaaagactgaacaccttgattgtgtacatctaacccattggtagtgcagggtgccaaacatgaaagtttggaaagctataattataaaaaagtgaatatcagannnnnnnnnnnnnnnnnnnnnnnnnnnnnnnnnnnnnnnnnnnnnnnnnnnnnnnnnnnnnnnnnnnnnnnnnnnnnnnnnnnngacgattaccctgaatagagttgagcaaggctgtgaagactactcagtagtgtgtagtacactacataaggcggattcggtcctat

SEQ ID NO: 11596 - DNA, 649 bp, Diabrotica virgifera
atgaaaatagtgagggggagttgttccaataatgttgaaatatacatatattcaattacttaacttataaaatcatagaaaatgttacacctttttaagactccgtgctatttacacagtattcataattttcaaatgataaaaactcgggaaacgctgtaatttatacacatgactttaaaacacctgaaaatcgctagaacaaggaaaacttatgacatcttcaaaaatttgaaagagacatagctgaatggtactaacctcgctaccacaggtactgaagaataaaaactgtccaagagcctgaagaatgagataaagaaaaataaaaatgagcgatcttcatcatcaactaacagagatatgatgataataagggatatacaattaatgataaattcatttaacaatgtcattctaacgaagaaacccaataattgatgatatgtatacataaagaattagacaatatactgtcatgcttgccattagaagaaatgactgctgtggaatcgaaattactccattcattatctatgaataagtttgaatattctcacaataaattagatcactatgattgcactatcagtggatatattacatgaaatcgacaaaggattaaacaactatattatgatctgtgatt

SEQ ID NO: 11597 - DNA, 717 bp, Diabrotica virgifera
cgagctgattatgaaacacacatatgcatcgttatactttaccctcatttacttgtatacctgtgtataataaatacgaattactacccgatcaccgtagctcgaaccatgaaactgcacggattactcttatacaatcgaaaccaatatgtgcaaagcatcgctccacagcgtatgactcgccgcctccggaaaaccctaacaattgtcgaacgccctcaaacatcaggatgatatgtcaaatgtgtgacaaaacaattcccaaggaaacgatgtgcctctaccatggataggaatccttaccttaaataccccatcgagtccggaaaagtcacctgctgaaatgataccgcatacaatttgaggtcacacgttctccaatgaactcatcccagccccagaagaacaccccgaactgttaacataagctcctcttcaccccaacccctactcggaaagaatgacatatataacgtttaaaactttctacaccccagccatgtttggtggcatccaggctgtactctccctgtatgcatcagctcatacaactgatattgagtataatactgtcgaagacgtatcccacactcccccactctatgaaggatatgctcttcctcacgcaatccttcgtgtgaacttatatggtagagacttgactgaatacctcatgaaaatttagactcaacgtgactactctgtcagcaccacaga

SEQ ID NO: 11598 - DNA, 843 bp, Diabrotica virgifera
  misc_feature (11)..(842): n is a, c, g, or t
tttagctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11599 - DNA, 842 bp, Diabrotica virgifera
  misc_feature (772)..(772): n is a, c, g, or t
  misc_feature (824)..(825): n is a, c, g, or t
gttttaaaacatagattctcgctgatatataatcgtgactctaccgacatttatcaagtaaacaacgcgtttaaaaggatttgcttcattcagtttgattcgcgttatacaactgtgataaactttatctaatcgcaaagtgtcattataaaccagacaactatatattagacataaacacaaacttctacagtcagttgtacagttcaagttcatattgcaaaatggtgaaagcaaaaaagtggaattacatgaaacacttcgaagggtggcctaaaaagaccgatgtcgaactagtggaagaagaaatgcggcccattgaagacggggaatttcttgcaaaagccgtcttcctcagcgtggatccattcatgcgaggtttatcagaaaaattcacaatcggagaaccaatttggggaactcaagtagccaggattgttgaaagtaaaaatgaagaatttccagttggaaaattagttgttctaagagcgggttggaggacttacagcatctccaatggtaaaaaagaaccaccaactcttccagaaccctatctacttccagatattggagatctctccccttctgttgctctaggagtacttggtatgacaggaaacacagcatacttcttgttcttggagctctgccaacccaaagaaggtgacacggttgtggtgactgcagcagctggagcaattggaagtattgtaggacagatagggaaaatatacggttgcaacgtcattggaatagctggatctaatgaagnaggcgaatgggtggctaaggaatcgcgattcgatcattttattagctataanngtgatgatatcgatgct

SEQ ID NO: 11600 - DNA, 788 bp, Diabrotica virgifera
  misc_feature (11)..(763): n is a, c, g, or t
  misc_feature (765)..(787): n is a, c, g, or t
tttagctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnc

SEQ ID NO: 11601 - DNA, 154 bp, Diabrotica virgifera
gttaataatgtgttattccgtataccatatataaatacaacgaatttcgttagcttttacgactgagtcaatatagagagaatctattttatgttataaaaaatcaaaaatgttattcgttacatgtgaaaattaccaaataaatcataaatca

SEQ ID NO: 11602 - DNA, 325 bp, Diabrotica virgifera
  misc_feature (2)..(255): n is a, c, g, or t
  misc_feature (257)..(319): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnncgaggt

SEQ ID NO: 11603 - DNA, 610 bp, Diabrotica virgifera
gtcttcttcattttaatatactagatcctctctttagtctgaacttttaaaaatattacctcacgtttgatgattttatttgatattgaatatgttatacttatcttttatcaatgtaatattttgaacctcttgaatctatttttatacttgaattatcataaattgattatttgcccatcaacacactatttcttctaatcatcttcattgttttctacctatctctactaaatgttcttaataacaatgtaattctatactaaccatatctaaatttttaagatgcttcttatatttatttgttaccaattcatttctacatttgaatatttttatgttaaatatcatgaaacaatgtatagcgagatatcctgttgaaatctatcttgattaagattgaattattgtggtagagatatatctattagggattgttcatctatgtctgactatgatactaatttatgtatttatataattacttatttcctataactctataatagttttattaatggtatatataaatctttgccttaatttagaatactcttactagatcgagtatatattaagtagttgatacaatattcatgatatatccaaa

SEQ ID NO: 11604 - DNA, 823 bp, Diabrotica virgifera
ctacgcacaccacgcgcccgcacaatgaataagttattacgagatcactttattgtattgctattggtatctaatcatcagacggattccggtcggatcacagatacaataaatatgtgcaagtaatgtagccagctgtaccagcatactcttatagctcatcctgtccattcaaactctcgaagctaaactacccgaagttcaacctttacaaccccgaccactatcatttctaactctagaagcccacctactcacatacttcaatctttataatcgagacctgaagttctcactctataagtcctaccatctcttgtatcacttgaatctagacccaaagtatcacctctagaattgagtatccagacctttcaacccttgaattctgtccactaataattcatcatccgaacataaactaaccttacatgacaatttgactatgatcaaacatacggctcgaagaacaagctaccatgcccatctcccgattaagactttccgaaaatttggctattattagacgatggctggatgatacagcaaaccttgtactactaaagtgtagttgacttctagaacaaggtcctcccacaccatccaaaagtacgaaggctgatgcatctacatgctattgacaccatacaacattactaaaaaggtcacgaagcacaggatgaactactaagacgatcgatgaagcatgttactataccaacaagagcgaccatcatacattgatgatctctataccacacacacttagattggtgtattttatgaatcttcctattatctataactgatttctattattcta

SEQ ID NO: 11605 - DNA, 281 bp, Diabrotica virgifera
  misc_feature (2)..(229): n is a, c, g, or t
  misc_feature (232)..(278): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgnnnnnnnnnnnnnnnnnnnnnnnnnnnnnnnnnnnnnnnnnnnnnnncgg

SEQ ID NO: 11606 - DNA, 746 bp, Diabrotica virgifera
ccgcccctgttacaacatacaagcaagtaaagatgagagctagtgagaccgttgttaatcaataaacatgaacaaattaatatcattagcttgattagagttcccaaacctcatcttcctttgcaaaaatggtccaacgtgatcaaatgctgaatatgacccccttgcggaggaacaaaaacacgccagcaaatgtgactctgacgtacaagcaacgactcctcatgaaaaactgcatgaaaacacaaagccactttcctcaccatatgctgatactaccctgaatgcttgtgaatgctgaatctactgaagcctctcatctaacaaatcccacatgaacttcctgccaaattccttgtaagattccgcaacaaaggcgatcaagattttggtgtacacacccttgaaccttccctcctatatccaatgaacttcaacttcgttcctccacaaacttctcagatgcagcatatacatacataggacaaactgaacaagaaccactttcctctaccggttcctaccagctgctcactacgcaagccaaccattaggattgaacctcttgttgaactatcatgatgcttactagaaacgctttcccagaagctgtcatcaacgatacagtccacattgatgaactagaagaacgacttgatgcataaacattcttcctctatgtcctcctcgaccgctcgagcattattgcttctgatgatatgcacaacaaactctgctatcacttg

SEQ ID NO: 11607 - DNA, 762 bp, Diabrotica virgifera
  misc_feature (85)..(103): n is a, c, g, or t
aatacatgatatcgtaatgcatctgatcatttagatataacttaatgatgtaaatattgatgaaagaaaaaaacatgaatgatgnnnnnnnnnnnnnnnnnnngaaagcattaaaagatgatatagacatcaatcatgtgaaaagcttatacaatacacattaagaattattgtagtggtcaaaacatctcacatcaggatattattaacagcattatacattattgattctttaaaaaatgaaactacctatttgtatactcaatatcccacttagcttgaaaggaatgcgacgcaatatttaactcttcaattaaacatattgatgttgcatcataaaaaacattgtttaccgtattaatagacaactttcaatcttatgttgtctcacattcactcttctgtattgttcctatgaagaagatatatccgacaaaaataaaaactatgctacaacttattacatacattcacatctgtgaattgataaaccatacaatctactgcaaattatatacagaacactgaactatgtgatgcacgcactaatatgctacatatatcatgaaacttttgtaagaaatttagactcaatacgtcctttgacagaactaacaaaaatgaatatattgacgataataaagaatgctaatggaccacgtacatcatagtttgtactctacctttcattccagatgttagataaacgtcagataagatctttagaggacccatcactgcgtgtgagctactgattcatga

SEQ ID NO: 11608 - DNA, 796 bp, Diabrotica virgifera
  misc_feature (18)..(149): n is a, c, g, or t
  misc_feature (151)..(195): n is a, c, g, or t
  misc_feature (200)..(246): n is a, c, g, or t
  misc_feature (251)..(309): n is a, c, g, or t
  misc_feature (314)..(340): n is a, c, g, or t
  misc_feature (343)..(434): n is a, c, g, or t
  misc_feature (462)..(492): n is a, c, g, or t
  misc_feature (525)..(544): n is a, c, g, or t
  misc_feature (546)..(565): n is a, c, g, or t
  misc_feature (567)..(594): n is a, c, g, or t
  misc_feature (612)..(632): n is a, c, g, or t
  misc_feature (662)..(685): n is a, c, g, or t
cggccgcccacccgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnctttnnnnnnnnnnnnnnnnnnnnnnnnnnnnnnnnnnnnnnnnnnnnnnnctacnnnnnnnnnnnnnnnnnnnnnnnnnnnnnnnnnnnnnnnnnnnnnnnnnnnnnnnnnnncaccnnnnnnnnnnnnnnnnnnnnnnnnnnncannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaattttcctatcttaccctatggnnnnnnnnnnnnnnnnnnnnnnnnnnnnnnntcttccataacctttccattacactataaatcnnnnnnnnnnnnnnnnnnnncnnnnnnnnnnnnnnnnnnnncnnnnnnnnnnnnnnnnnnnnnnnnnnnncgtttaatacacgaatcnnnnnnnnnnnnnnnnnnnnnctcattaaaaacatgtctttctgtattacnnnnnnnnnnnnnnnnnnnnnnnncttaattcgaatggccgcggtatcttgaccgcgctaaggcagcatactcattaggtcttttattgacagctgcaatgaagggttggatgacccatcaactgtcttcattta

SEQ ID NO: 11609 - DNA, 905 bp, Diabrotica virgifera
aggtattgcaggtacaccaggaaggagtattgtcggtgctaaaggtgataaaggtgaccaaggaccttctggtttagatggtttagcaggaatacaaggagaaaagggtgatgccggaaccccaggtttccctggagtgaaaggagataggggttacccaggtgaacaaggagcaccaggaatggacggctttccaggaaccaatggagaaaaaggtgatagaggatttgcaggagcgcccggttttacaggagagaaaggagaccgaggtttgtcaggtcttgatggatatgaaggacaaaaaggtgaaagaggccgaccaggttccaccggacccttcggcgaaccaggagaaaaaggtgacgtaggagaaacaggtcctccgggtccgttggtgcaaattaaaggagataaaggagaaccaggaccttttggattggaaggcagacagggtgaaaaaggagaccgtggattctctggagctattggtctacgaggagagaaaggggatgtaggtttccctggtgttaaaggaaatcttggtagcccagggcgtccaggagctaaaggtgaacgaggtctttctggggtagctggattaccagggttgacaatcaagggggagaaaggtttgcctggaatacctggcaaaaacggaagagaaggtatacctggcaccccagggcagattggtgaaccaggattgccaggtttggacggcagacaaggaccacctggtccaccaggtccactgtgtcttcaagggcagaagggagatcgaggttttgatggagctccaggaacacaagggccaaccgggcccccatgacagccaggattagaaggcgcccctggacaacgaggtgataaaggagaaagaggtaaccccggtgctttcggagctc

SEQ ID NO: 11610 - DNA, 119 bp, Diabrotica virgifera
  misc_feature (5)..(42): n is a, c, g, or t
  misc_feature (47)..(89): n is a, c, g, or t
cggtnnnnnnnnnnnnnnnnnnnnnnnnnnnnnnnnnnnnnngacgnnnnnnnnnnnnnnnnnnnnnnnnnnnnnnnnnnnnnnnnnnnaccttacgataacagcgtaattttattgga

SEQ ID NO: 11611 - DNA, 756 bp, Diabrotica virgifera
cgcgatatgcagatgtatatatttctatatacatcgttagcctttcaagaggtcataagaacatgattgattgcggtcgtcacgactgcttaatatacgatgttactcttccccccaaaagacgctccatggacttccacatatatcatttacaaattaaaaaaagggaacacttgacaatctgaaaaaccgacatgtgacgacatctgaattagtctaatcaaaggatccgatatatgctgatgatgctgtccacgctagagacggatactaatatgtctgtcatacattacaagtacagtaaccacgatgagtgacactgacatgttgaaggaggaggatgcggaataataggaggacgtggtgaacaaagaggtacatgtacaatggaaccaccggctagaagatcaaagaataagcgtctacgtatacacgattaccacacatcctgaatcatggcaagactacaaaacaatatctatgagagaacctggatatgtatgtttagcgtatacattaccatatggctatggtgtaatgtagatattgagatacgaggccatgaaatatgacatcaagaagccacactatacaagatatacttaacatcacggacatgttgcctactatcctcttctaagaagacacatgtgttagagacaggagatccggatgtagatcgagatgctgatatatctctccccgtaacaggctttatccgacatacagacatcgcgctataagattctcgaggag

SEQ ID NO: 11612 - DNA, 601 bp, Diabrotica virgifera
ctgatatcctgttgactgctcacatttcccttgggagagagcagaacaactgatacgcttccaccatgttgcacgacgagagaaagatattggtaggacgaaaagaaaaggaccccggtccatttcgaaagctaccgggactaggtcttgacacgattggaagagggcgctatagaccatacggtctatataggtatcatgacccccgacacatctattaaatttaggatgcggttgacatatactgccgtctgataattagagaatgaacaagaacgcaaagaagccggctcgaggtgtatcattcaagaatagtgcttgaaacccactgttgtcgatgacgctgatgaagggtcggtttgaccagtatctcgaaggagatcacagacgcatagtaaacctatcagatattacattggtactctaaaaggatgtgtaattcatacattttctgatctccgaattgatcagcctagtattcgacctatataggcagatgcaacaaaccaaccgtgtataatgtatccgagtacgagacacaaatgcgccaatattcaaaagaaagtgtgtgaatttatcttccgtaaccaactcattcttg

SEQ ID NO: 11613 - DNA, 695 bp, Diabrotica virgifera
agttgaaatcttaggtattgtactgctattgctggaagacgcgtactgtggggtatcatctgatatttcataagatgataagaccgtaagaatgaacaccactgatggaccagtagtggatgaatttggaactgaatcacgtgcaaatagatcgcaagttatatactgttttaaaagaattccatatgccgtaccaccagatggatatttaagatttgcatgcacctgatacctattaactcaattgaaacatgaaggttttaaaatgaatcgatataataccttcgataatgtatacaaggaatcttcaccatgtagcacgaaagtgaaaattgctatatatggaaaaatatacagccctcacgaaccaatcaaagacctcgatacttccagtaattatatgtgtttacggaggatacatcttcgaaagatctgcagattttgacgatctccaaccagatttcattctttatgaaaatggaatcgtgatacctattctctatagacttgaatatttgggtgttcgtgatcgcttgtgatactgtatctccatgaataatggaatataatgaccattatactaagacttaaatggattaatgaaaacattacgaactttgtaggagatcccgagctgataaccgaattgtagacaaagctcctgagccgcttctgtggattatttactgcagact

SEQ ID NO: 11614 - DNA, 668 bp, Diabrotica virgifera
agttcatacattcgttcttacaaatatatattattcagacagaattcctcgactatgcagatattttagcaaaggaacaagctttacgtcatcaaaacaaattaccgaacaatcggccatatagagacgatgagatcgcacttaattacgggtaataaacaataacctctcttaatatgagaacacaaatattatagaaaccaacatatgatgagcactgtacaaaaccgctacacaaatgctaactcctcatacgatcatccaagtggaggcgaacctacggctatatctctttactcgcaccaaccaatttatctggcctcactcttactggatcgatatccatttcgaatgcgcttgccattaccaacaaacatgaaacagtcatatcaatgacgatgactgtatctcagcaacttcaacacgtaactcggtgcatactatccatctgtaccgcacatgcaacatgccattcaaaacttatataaccacgtaaaatccttcaacgatcaataatccaggatcaaacctatccacaatgaaacgaatgactcgacatctgtgaatgctttctacgccagagaggtgtctaatatataccatctttcgctcaacgctgttgtcattattatcttactactaagacattatgaacatgaacataatag

SEQ ID NO: 11615 - DNA, 864 bp, Diabrotica virgifera
  misc_feature (14)..(75): n is a, c, g, or t
  misc_feature (81)..(118): n is a, c, g, or t
  misc_feature (129)..(196): n is a, c, g, or t
  misc_feature (209)..(236): n is a, c, g, or t
  misc_feature (248)..(354): n is a, c, g, or t
  misc_feature (356)..(567): n is a, c, g, or t
  misc_feature (569)..(652): n is a, c, g, or t
  misc_feature (671)..(683): n is a, c, g, or t
  misc_feature (685)..(698): n is a, c, g, or t
  misc_feature (700)..(729): n is a, c, g, or t
  misc_feature (761)..(811): n is a, c, g, or t
  misc_feature (834)..(859): n is a, c, g, or t
cggacgcgtagggnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnngtcgaatgtgnnnnnnnnnnnnnnnnnnnnnnnnnnnnnnnnnnnnnnnnnnnnnnnnnnnnnnnnnnnnnnnnnnnnattattctgttgnnnnnnnnnnnnnnnnnnnnnnnnnnnngattagatttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnntgtatcataatcatgagcnnnnnnnnnnnnncnnnnnnnnnnnnnnannnnnnnnnnnnnnnnnnnnnnnnnnnnnngtataaagaatgttatttttaagtgaataagnnnnnnnnnnnnnnnnnnnnnnnnnnnnnnnnnnnnnnnnnnnnnnnnnnngactaagttactttagtatgaannnnnnnnnnnnnnnnnnnnnnnnnngttga

SEQ ID NO: 11616 - DNA, 815 bp, Diabrotica virgifera
gctatcttcacgtgcgggcctgcagagaagatgtaaagcagatctctgaatactttcgagcttcggaggaccaagaatctgcacagacttggttgatttccaacccaagccgaagaagatccatgctttcattcatgaacgctttcgtggacctagaattacttatttatagctgtagtatatagggtaaatattgcctctgataatggataccttaacgaatatattgtggataattattgtggaatattacatctcagttgctcattcccatcctttatagagatggatgtactgtgcttcttgccggagagtgccctgatcataattacagaggtagaaatgaaaaatatcatgctgtctttacctacagtttaccatgtagacaccgggaatgatcccaagaactatccagctgaacgtctctatcatacgaacaagatatatgtcacgcttgaacagaaagcctaaattgcaaagagaagcataaatgccacatatgattgtgtgatattttagatataagtatacgaatatttgattcagcaatgttgagattctcgatgtttcagataccatcgactttacatatcacattggatactacggtgttataatgaggatacccgaaatgcataactaatttgactaatacactagaatgcacgatggtgcacaagctgtagtatgtgaattgtgaactacttatgcagtattgtctcacgcattgtctgtgatttatgcagtgacaagatgtcatcatctggattcttaaaatcattgataacagtgtctgctgcattatgaatgaacat

SEQ ID NO: 11617 - DNA, 847 bp, Diabrotica virgifera
  misc_feature (76)..(94): n is a, c, g, or t
gccccaatatattcccggcgacccccacgcgcgcggacgcgacggtatttctttacaaatatttaggatatattgnnnnnnnnnnnnnnnnnnngtaaatatacattattgttaatcgagttgacataatattatctagatctgttcaattagtttgtgccgcattgtattatgtcttatcatatcatactaataactacgataaatgaagattatatccaattatagagaccgatgtattaacgatgtcccattattaccaattatttatattgaatgcccaatacaaattgaatctgattataacaatgatcgcagatcaggcacaatatatccacatgccttatattcttccattactcactatagacacatagctctgaatcatatatatgacaactatggaaaaattacaaactttggttgaacagtacactgaaactatcacatctaatactagaactcagattccctccctatctccttcactattatgtgtgatactgcactttggaggacaacctatgttcaatatcgatattaaattattccatgacctggatcttactaagtcaagaattccaggagagacgacaagactttgctcactgaactgaattgtaatactaaaagaactaaaatcctcacttaaaaggatacacatcgaataattctacatggatggacgagattaccatatttctaatagagtcacaggaatacactatgaactactgacacaatgattggacgatgatacatattacatgaagtatatcaatcgagcgtatgtgatctttattctacgtactattccgagttgttatgaagatgattattccaagta

SEQ ID NO: 11618 - DNA, 631 bp, Diabrotica virgifera
  misc_feature (55)..(83): n is a, c, g, or t
  misc_feature (314)..(335): n is a, c, g, or t
tgtgacgcctgtgcaaccgcgccgcaattatccccgtcgacccaccacgcccgcnnnnnnnnnnnnnnnnnnnnnnnnnnnnncctgaagataatcatggagaaatggtaacaatatttattgtcataatctgctgctacttctatagataacttactttgcctttccagatgctgctgtatgctatgttcatttatgatgaattgacaataagactgaatacaatgacagccaacaacatagatatttgatgatttcatatatatattcaacaatatggttgctatcaactgtcaaagttatcaaaaacatgnnnnnnnnnnnnnnnnnnnnnncaaactttacagcttcttgaattataatgcatacactgatatctttaactaaaaacatttctgtataatgtttaatgataattaacgtattgcttcatttaaattgtatcaaatatcttgagtctaaactatgcaacatttaccatataccattcatcttgccaaattattggcaaaagacaatactatttattagctatacatgtatattttacccaatgattactattatcacatgattatgatcatataataaatatttgcttctattaccaaaaaaaactactaaggtctga

SEQ ID NO: 11619 - DNA, 129 bp, Diabrotica virgifera
  misc_feature (2)..(91): n is a, c, g, or t
  misc_feature (93)..(128): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnc

SEQ ID NO: 11620 - DNA, 353 bp, Diabrotica virgifera
  misc_feature (2)..(15): n is a, c, g, or t
  misc_feature (41)..(127): n is a, c, g, or t
  misc_feature (214)..(241): n is a, c, g, or t
  misc_feature (276)..(295): n is a, c, g, or t
cnnnnnnnnnnnnnncatttaatttttacataaaaattacnnnnnnnnnnnnnnnnnnnnnnnnnnnnnnnnnnnnnnnnnnnnnnnnnnnnnnnnnnnnnnnnnnnnnnnnnnnnnnnnnnnnnnntacctttacattatttaaatttagtactgacgataacattagcatcaaccaattgtatattcaacacaaatatatatgattcatacnnnnnnnnnnnnnnnnnnnnnnnnnnnnattattaacaacatgtctttgtgtattacatatcnnnnnnnnnnnnnnnnnnnnctactttgaatggtcgcgctatgttgaccgtgctaaggccccatactcattcattatt

SEQ ID NO: 11621 - DNA, 899 bp, Diabrotica virgifera
  misc_feature (793)..(793): n is a, c, g, or t
  misc_feature (864)..(864): n is a, c, g, or t
  misc_feature (880)..(880): n is a, c, g, or t
caactaaaagcttcttggggacatttgttgcaaatcatcaggaaaatgcatatcgagagcgagcagatgcaatttccaggagagttactacgatggaacctacatctacgactcctccagaactgataattccttcaattacgacaactctacctccaacaaccacaggcataaggacaagggtcgaaacgggcgacgaagctgtaagcttgggtttaccatgcgtgactgacatgcaatgcaaaatggctgattcatcttcaaaatgcatagaaggaatttgcgactgtattattcggacaaatggcacacgatcttgttcggctaaaaatcgtggatgtattcccggaacatttcagtgtcgaagcaccggtacatgcatcagttggtttttcgtttgcgatggtagaaaagactgcagcgatggatcagatgaagaatgcttacctaacaaatgtccccaagaagcttttagttgcaaatcatcaggaaaatgcatatcgagagcgagcagatgcgatggatccaaggactgtgccttgggagaggacgaaatgaactgtcaggctatcggaagaaaaggttgtccaccagatacttttcagtgcagagatgggaaatgtctacccgagtacgaattttgtaatgctataattggttgtagtgatggcagtgacgaaccacctcacatttgcaaaggacgagcgagaaggagaagaacagaatattgtcctttacgatgtggaaatggcagatgccgatctagcgcaattgcttgttctggaagagatgngtgcggtgatggcacagatgaaagtcaatgttcagtttgtagatgtcccgtgattaagagcgcacttatangtcgttaatttttcgnttgacttgtacatgccaaa

SEQ ID NO: 11622 - DNA, 901 bp, Diabrotica virgifera
  misc_feature (113)..(151): n is a, c, g, or t
  misc_feature (190)..(227): n is a, c, g, or t
  misc_feature (229)..(246): n is a, c, g, or t
  misc_feature (274)..(296): n is a, c, g, or t
  misc_feature (305)..(321): n is a, c, g, or t
  misc_feature (323)..(350): n is a, c, g, or t
  misc_feature (352)..(376): n is a, c, g, or t
  misc_feature (410)..(517): n is a, c, g, or t
  misc_feature (548)..(572): n is a, c, g, or t
  misc_feature (574)..(591): n is a, c, g, or t
  misc_feature (620)..(640): n is a, c, g, or t
  misc_feature (707)..(730): n is a, c, g, or t
  misc_feature (762)..(779): n is a, c, g, or t
  misc_feature (836)..(877): n is a, c, g, or t
gctgcacccctgcacccccgccccggtacccccgcctccccccacgcccccgcggacgcgtggggataattatcattgtgagacatattttatttttatcaaccaaaacttcnnnnnnnnnnnnnnnnnnnnnnnnnnnnnnnnnnnnnnnctcacatatttattattttcgaccttaaaagagctaacnnnnnnnnnnnnnnnnnnnnnnnnnnnnnnnnnnnnnncnnnnnnnnnnnnnnnnnnccattctttttcaaatatatctacttcnnnnnnnnnnnnnnnnnnnnnnnctatcaccnnnnnnnnnnnnnnnnncnnnnnnnnnnnnnnnnnnnnnnnnnnnncnnnnnnnnnnnnnnnnnnnnnnnnncttattacaatttcatttttaactaacaattaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccaatgatgataatatcagcattaaaacnnnnnnnnnnnnnnnnnnnnnnnnncnnnnnnnnnnnnnnnnnntcaacattcttttcacctgtttatctacnnnnnnnnnnnnnnnnnnnnnatataccgcctcgcctgcccactgactactttgaatggtcgcgcaattctgaccgtgctacggtatnnnnnnnnnnnnnnnnnnnnnnnncacgctggaatcgatcgtgttggatgacaacnnnnnnnnnnnnnnnnnncttatcaagacttgtatttttactgctaacagctcatattcttttaccatacgaccnnnnnnnnnnnnnnnnnnnnnnnnnnnnnnnnnnnnnnnnnnctattatatttatctatataataa

SEQ ID NO: 11623 - DNA, 681 bp, Diabrotica virgifera
  misc_feature (30)..(48): n is a, c, g, or t
gagagcttgcgtccgataataacactatcnnnnnnnnnnnnnnnnnnngccaagacatcaagataaaatctgttaatgactgtcaataaatctggtattcattgtcgtacccactttcttatttaaacattgtacaatgactagagaaatgccgatattccgattatgcatatgggagtgcctaacacgaagatacgacttattcacgttgccgcaacttcaaacgccgctgcagctgaaccaaaacgaaccgacaaaccaactagacccaatacgtatgccaattatccctggaatcatcacaaacaccgatcctacacaacctaaacgctcgactactacatgtagaattgaattcttgagaacctatggaactttatgctctcattagaattaaaaacaatacataccccactttaacctatataagatcatgtcgagcaggattttgcggatcttgtgctatgtatattcagagtagtaaataccttaaactgaatcaattataattagaaacattaactaagatcatcatagatttatccatctgcctcatatgtatgtagtaaaacacttgaagcctgtgatgaataactactaccgacaatataaaactatagaataatcgttagcaagaaaagattataccctatagacatacactgaatatctgcagagtgt

SEQ ID NO: 11624 - DNA, 857 bp, Diabrotica virgifera
  misc_feature (19)..(36): n is a, c, g, or t
caacaatttattaacatannnnnnnnnnnnnnnnnngaaccataaaagctaaatgggcaactctctcattcatagagccaaataatcaactagctccaattttgtttgttactctatccatctaattaccaggtgttggcacattcaacaacaaattttgtcctccaggcaagtaggaaacctgccttgaccttgatagttggtatgcgatatcttcagctgcttctatacgtctcagttctactaaaccttctccagcatcaccaaaagccttggcaagaagcacagcagcttgggcatcaccctccgctgagattacagttgctttctttgtctgttcagctttttctaccaaaaacctagctttctcagcttcctgttgggcaacttgtttcaattctacagcttgtgtgaattccctaccaaaggttaagtgggttaatgatatatcatcaaggataacaccaaattgagtagctctttcagttaaatcttcactgactttttgggaaactacatctctctgagtaatcagttcactggcatcgaattgtgccaccacagcttttaggacttcattagtgattgatggtaaaactctttcttcataatcctggcctaaaattgtgtagatctttggtaattcgtctggaactggtctgaagagaatacggagtgtgatatttacgttttgcagatctttgctacctgttattactgggatatttctagggcgagaccgtacatcaaagataataggtttctgtacccaggtataaagaaatgtgtaccttcgcctataaacttgttctaataccggcgaacctgtcgaaataactgccctgtgacctccatca

SEQ ID NO: 11625 - DNA, 905 bp, Diabrotica virgifera
  misc_feature (878)..(878): n is a, c, g, or t
aaccaaactcttgcacattcgtttgttattattatggtttctacaagaataagaatgcaaatcaatttattagtgagataaacttaaatttcggctaagacctttgttaaaatatttcaagatgcgcctaaatcaagttttaaaaatagctctattagcgctcttttgtaatataacgttttgtgacagttttaacattctggctataactccccatgtcgggaaaagtcatcaactggtgttcgaacctttgtttaaaaagttagtttcagttggccatagtgttactcttataactcgatatcccatgaatgtggactcccccaagtggagggatattcctataggacccgaggatactaataccacagaactgtttgatttcagccttttaactggaactagattcgacagatatgcatgccctcttgttctcgcagaagctgctcggatttcatgttccgaggggttaccccatcctaacctacaacggtttttaaaagaagataaccattttgatgtagtactcatggaagttttcaatacaaattgctacatgggaattgctaccaaatataatgttcctgttattggtgtacattcggcaggttggatgccttggatgtaccaatggtttggggtaccatatcacccaggattcgtgaccgaccactttttgggaaactcacaaccaatggattttttggcaagactagaaaatacaattgtacatatatacaacaacgccatttatacagttacaatgtgctggtacggtagttatttatctaataaatatgtgggtgcagatctctacgaaaatggtgatgttatgaaaaatatgagtctgctatcgatcaatacacatttttcactanatttaccattagcattagggcaaacgt

SEQ ID NO: 11626 - DNA, 685 bp, Diabrotica virgifera
  misc_feature (11)..(28): n is a, c, g, or t
  misc_feature (42)..(65): n is a, c, g, or t
  misc_feature (86)..(103): n is a, c, g, or t
  misc_feature (108)..(145): n is a, c, g, or t
  misc_feature (199)..(237): n is a, c, g, or t
  misc_feature (239)..(254): n is a, c, g, or t
  misc_feature (288)..(367): n is a, c, g, or t
  misc_feature (378)..(499): n is a, c, g, or t
  misc_feature (501)..(560): n is a, c, g, or t
  misc_feature (562)..(591): n is a, c, g, or t
  misc_feature (604)..(683): n is a, c, g, or t
catttattttnnnnnnnnnnnnnnnnnntttcgtacaagcannnnnnnnnnnnnnnnnnnnnnnnctaattagtatcgagagagannnnnnnnnnnnnnnnnncgaannnnnnnnnnnnnnnnnnnnnnnnnnnnnnnnnnnnnnctcaacaattacctatttactattttcgaatctcaaacacctacaacattaacnnnnnnnnnnnnnnnnnnnnnnnnnnnnnnnnnnnnnnncnnnnnnnnnnnnnnnnttcttaaatatctctaattttttaacaaataacnnnnnnnnnnnnnnnnnnnnnnnnnnnnnnnnnnnnnnnnnnnnnnnnnnnnnnnnnnnnnnnnnnnnnnnnnnnnnnnncaaataaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncgcaaccttttcnnnnnnnnnnnnnnnnnnnnnnnnnnnnnnnnnnnnnnnnnnnnnnnnnnnnnnnnnnnnnnnnnnnnnnnnnnnnnnnntc

SEQ ID NO: 11627 - DNA, 629 bp, Diabrotica virgifera
  misc_feature (19)..(93): n is a, c, g, or t
  misc_feature (155)..(175): n is a, c, g, or t
  misc_feature (179)..(204): n is a, c, g, or t
  misc_feature (209)..(234): n is a, c, g, or t
  misc_feature (254)..(272): n is a, c, g, or t
  misc_feature (274)..(286): n is a, c, g, or t
  misc_feature (337)..(399): n is a, c, g, or t
  misc_feature (437)..(467): n is a, c, g, or t
  misc_feature (496)..(512): n is a, c, g, or t
  misc_feature (514)..(532): n is a, c, g, or t
  misc_feature (534)..(555): n is a, c, g, or t
  misc_feature (557)..(572): n is a, c, g, or t
gaacctgtgaggatcaagnnnnnnnnnnnnnnnnnnnnnnnnnnnnnnnnnnnnnnnnnnnnnnnnnnnnnnnnnnnnnnnnnnnnnnnnnnnatgagtatcatgaataattatttagtaatgatatgtttatcattttctaatttatacgagcnnnnnnnnnnnnnnnnnnnnngtannnnnnnnnnnnnnnnnnnnnnnnnngtatnnnnnnnnnnnnnnnnnnnnnnnnnntctagtatgatcttaaatannnnnnnnnnnnnnnnnnncnnnnnnnnnnnnnattaaagattataatattacttattattaaatatgttataagtaatatctnnnnnnnnnnnnnnnnnnnnnnnnnnnnnnnnnnnnnnnnnnnnnnnnnnnnnnnnnnnnnnncttactcatgatgattgtattatatattataaaaatgnnnnnnnnnnnnnnnnnnnnnnnnnnnnnnnctgttatcatctacattttattcacctgnnnnnnnnnnnnnnnnnannnnnnnnnnnnnnnnnnnannnnnnnnnnnnnnnnnnnnnnannnnnnnnnnnnnnnnatgaccgcgctatggtatcctactcgttagtttactacttgacagctggaatgaagg

SEQ ID NO: 11628 - DNA, 788 bp, Diabrotica virgifera
  misc_feature (16)..(201): n is a, c, g, or t
  misc_feature (203)..(275): n is a, c, g, or t
  misc_feature (283)..(632): n is a, c, g, or t
  misc_feature (641)..(781): n is a, c, g, or t
cccctcccacgcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnngttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactgtc

SEQ ID NO: 11629 - DNA, 589 bp, Diabrotica virgifera
  misc_feature (67)..(85): n is a, c, g, or t
cgctctctccagctcttttctgttctctggatcacaaggggacacgacatgttgcgcaactaatccnnnnnnnnnnnnnnnnnnnagagacaaacaggtaaattgacctaacgctgagctagcatgccaactcgttggaatgagattaataagtatccagagtcaagctaaaaatgaggaaatctctgcttttattcaaacctcatgagtgaagaatatatcgaatcaataacgccatatggatttcaggaaatatacgccaggacaaagttcattgggtttggataactcaagaagctcttgtgtacactagtagggacctggtctttcatgaaccaaacaatgctactggggacgaagaatgcgtgagcataataagtaataatggaacagataccacttgaaacgatatcacttgtaatcgcttgttttatcctctatgcgagaaacagatctgttgttctggttgcaattgtggatgttcttaatttaattgtttcatttaagcaattttacagcaatataaattactttttgttatttatgtaataataataacggtataattataataaaactgatcctacat

SEQ ID NO: 11630 - DNA, 194 bp, Diabrotica virgifera
aattatcttcattaacgctgaatgtaagtgcactggtagtccccgaattagtattttacccttctgtggctgccccctatgatcctttattgtaacacccccatcgaactatccttacatgagctataaaggctcttccgtcgaaatcacaagcactttgtcatattaaaccagtattcatcattgctgcaatc

SEQ ID NO: 11631 - DNA, 803 bp, Diabrotica virgifera
  misc_feature (465)..(484): n is a, c, g, or t
aagctaatttgtaccaaaatatcgcttaaaaaatcagatttgttataaaggactctgagatgcagcttgccacgaaatgcgacattaccgaaggctaacattgtgcccttgcgaagaggtgatatgatttttcgatattttccatattgcacaacgaatttgcgccgaacgcctatatacatcagaagccgaaaatctaaggaactgtattttacagctgcataatgaatcacgtatttaccaacatcatggatagcatgcacaaatatctttgaaatctttaaacccgacttatctgtcaaaactacatagatttctcagtgtatccaatgtgtatcacttattacagactgagtgtggtttatatgttatggatagatataggtaagtttatatatatgagatgaattatgtttattagaatatggatagttatgatacttatggtagcattcaggtagttannnnnnnnnnnnnnnnnnnncgctatagtattaaggcgacgatatgataaatggattctgtatattcacttgatgtactggacatttaatatggaagatcaattaggactataacatattatatctatgctcatactttaatataggatcactacctgtatcatgatgagcttcattatgatacagcttttcgtgacgctgcatagttttaactaatagaatcgcaatatggaattagcgatgaagatgacacacacgcagtgaccaatgacgagtgcaatacatacgctttgacagttcttaatatgtagacaaactgactaatttacatattaaatc

SEQ ID NO: 11632 - DNA, 881 bp, Diabrotica virgifera
  misc_feature (560)..(741): n is a, c, g, or t
gccagtagtcatatgacttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcccgccgcggtgctcttgactgagtgtcgtagtgagccggtacgtttactttgaacaaattagagtgctcaaagcaggccaaaacttcgcctgaatactgtgtgcatggaataatggaataggacctcgggtctatt

SEQ ID NO: 11633 - DNA, 770 bp, Diabrotica virgifera
ctccgaaaacgagacgaaactacacttgaaagcaaaagaatgtactcactcatatgaattgtagtttatatgtaataatttcatgttgtattctttgaattaaaacaactactgcaaaaaaaatgtctattatagagcttccaaaaaaacaattgttttatgcaaattaacaacgtgctgtaaaatttgccttcttctatatggcatatggaatacagcgaacattgtaaggagcatgtgttacgcaatttggacctctatgatattgcaggtgggtggatcaggcgcttttcaaacgttgacctatgtgtacgcttccaagcgcagtaggtaaatatttgacaaaatggatacttcaccaaagaaggcgatccgggtaattgcataattacaagaggaatataatcagaggactgtcgcccgtctcctccttatgacgaaatctcaacgacggcttgccgtcaataccaagagaccggtagctacatataatgacagagagatgatcgatttattgtcctattgatctatttattgatcctattattggtaatatgatgatcgaatgaccggatatgagcttcgataatgctgtaagaattttcgaggtgatcaccgtgcactcactggagagttagaagcaggtttaaggctgcaactttgactcacagataaactaacacacggcccaatttgaacgcacgtaagaaataaactcgacttctgtttgctctacaacatgtcaattgatactgtgaccagtgatgcat

SEQ ID NO: 11634 - DNA, 720 bp, Diabrotica virgifera
  misc_feature (46)..(68): n is a, c, g, or t
  misc_feature (89)..(119): n is a, c, g, or t
  misc_feature (158)..(178): n is a, c, g, or t
  misc_feature (256)..(269): n is a, c, g, or t
  misc_feature (271)..(284): n is a, c, g, or t
  misc_feature (307)..(324): n is a, c, g, or t
  misc_feature (326)..(345): n is a, c, g, or t
  misc_feature (383)..(396): n is a, c, g, or t
  misc_feature (399)..(412): n is a, c, g, or t
  misc_feature (441)..(455): n is a, c, g, or t
  misc_feature (461)..(480): n is a, c, g, or t
  misc_feature (507)..(534): n is a, c, g, or t
ccgcccgatctatttgtaagataataaactatttttcacgaaaagnnnnnnnnnnnnnnnnnnnnnnncagctaattaccattgcgacnnnnnnnnnnnnnnnnnnnnnnnnnnnnnnncttctctgcaccttgtgtatcagggactattctcccacnnnnnnnnnnnnnnnnnnnnncaagttacaagagctacacccttcagccctttattgaaacctacctactttaaataatctttttgtcatgaaatgccnnnnnnnnnnnnnncnnnnnnnnnnnnnntcaaatcacatcatatctattcnnnnnnnnnnnnnnnnnncnnnnnnnnnnnnnnnnnnnnaccattaaatattctccagggtatgagcattatgcatnnnnnnnnnnnnnnccnnnnnnnnnnnnnnatagacattacgattaagcattctcttannnnnnnnnnnnnnnttctcnnnnnnnnnnnnnnnnnnnngctattgctgatgaattgtctattacnnnnnnnnnnnnnnnnnnnnnnnnnnnncagtgatgataacagtaaccttaaaaagttgaatattacacctattcatcctacgcttaatcgcgtccttcatccacatttttcttccctgtgcattaaaaacactgtctttctgccttaactataacgactcgcctgcccactgatcaatctgaatggccgctgtattttgaccctcctaggtag

SEQ ID NO: 11635 - DNA, 260 bp, Diabrotica virgifera
  misc_feature (2)..(226): n is a, c, g, or t
  misc_feature (236)..(253): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttagaaagnnnnnnnnnnnnnnnnnngacgaga

SEQ ID NO: 11636 - DNA, 940 bp, Diabrotica virgifera
  misc_feature (560)..(582): n is a, c, g, or t
  misc_feature (706)..(728): n is a, c, g, or t
  misc_feature (824)..(838): n is a, c, g, or t
  misc_feature (840)..(862): n is a, c, g, or t
  misc_feature (875)..(875): n is a, c, g, or t
aatgtaccattgctatttttgatataattggatttatcttcaatttgaaaagaagaaaatcggtaagttctttattattttttaatagatatataatgaataaatatatggtgtaaaatatcaaactaaaagcctcgttgtaaaatacaacgattaaaagatattgaattaaaaaaaccaaaaaatactgcagaactaccaaatttttgagtcaccagccgccactgagtcagaggataaggttagcgatgtgcaataaatttttcgtactggaaggtatgtattgatacaatattcatcataaagcaaattatgcttgatcccttatcataaaatctattgaaaacgtctaccaaaacaataaaatgaacatcagaatagatggacaacttacaaaccctatagacataggtagtagaataagacagggagacgggaaactcattgagcaatttgctcttcaatttaatcatggatgaaatcatcaaaagcgtcaccaaaggaagaggattattgtaggaaacaaaggttgaaccttgcagaatggacacaagtacggnnnnnnnnnnnnnnnnnnnnnnngtatattaaggggtgcttattataagactaactttttctgaaaaaatttcgcccggaactccccttttcacccgtttaaaggggtaatttgtggtttttgcggaacgtagcccttcctgtaccnnnnnnnnnnnnnnnnnnnnnnngaaatatgaagagactatattttctacgatttatttcccgacagcatctgtctatcattcaccgtttagcaaagggtggcgccccaaaattgacannnnnnnnnnnnnnntnnnnnnnnnnnnnnnnnnnnnnnccctaaactgtancggaattaagaagaaaaactgcggcaattattcacaaataaatgattgattttttggtataggtt

SEQ ID NO: 11637 - DNA, 677 bp, Diabrotica virgifera
  misc_feature (2)..(272): n is a, c, g, or t
  misc_feature (274)..(360): n is a, c, g, or t
  misc_feature (364)..(415): n is a, c, g, or t
  misc_feature (417)..(438): n is a, c, g, or t
  misc_feature (440)..(482): n is a, c, g, or t
  misc_feature (504)..(558): n is a, c, g, or t
  misc_feature (560)..(599): n is a, c, g, or t
  misc_feature (601)..(617): n is a, c, g, or t
  misc_feature (619)..(644): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnntacnnnnnnnnnnnnnnnnnnnnnnnnnnnnnnnnnnnnnnnnnnnnnnnnnnnncnnnnnnnnnnnnnnnnnnnnnncnnnnnnnnnnnnnnnnnnnnnnnnnnnnnnnnnnnnnnnnnnncaacatgtctttctgcattacnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnncnnnnnnnnnnnnnnnnngnnnnnnnnnnnnnnnnnnnnnnnnnncaacaattttatttttacgttaacaagcttaaa

SEQ ID NO: 11638 - DNA, 784 bp, Diabrotica virgifera
gcgggtaccggcccgatatattcccggctctccccacgcgcccgctctctccttgtcttatctgttctcatgatcacgtagagagacattcttgtagcacatgtaatgctcaatctaattatttcgataggaaagctaacaagtgcgcacattagcgtatatatcctgctcttctataaagcaaacacgtatctgaatagagatcacgagatctccatcatgtatatcttatagaggaacgaaatctcttgtcctcacgcatccctcagatactcgcataacttatcaatctatacgacccataagtatttcaagaaatctactcctgcacgatattattttgcacttggaatagtatctcgactttttctcagcaacactagaagatatcctgacattatcatcaatccttagaatgcaactgttaccccttaattcctgatcataattaatacatagtggaacatctacctcctcgtacatcataactggacatctctagccgaatcctcaatccaaattgcacatactcgtagcactggatgcatatgaatttgtccttaatctaattgatacattatctcgattttactctatataaaaaacttaccgttatataactcattgtatgaacgttatcattatgtaaaactgtcctacctaatgaaagaatatatggagacatatctggaggacgcagcttacatacgccttgatgtttcataatacttctattatgttgtcaatagattatcaccgctgcccataggttaacgcgaatgga

SEQ ID NO: 11639 - DNA, 705 bp, Diabrotica virgifera
gcctggagccgccgggcaggaccccccctgtccacccccgcggccgaatgttccattgctatttttgatattattggattgatcttcaatgagaagagaagaaaatcggtgagttctatactattgtgtaaaaaatatataatgaataaatatatggtgtctaatatcagactagaagtgctacggacgcaaaatacaacgattaaaagatattgatttaagaaaaccaagaaatactgcaaaactaccatattttggagtcaccaaccgccactgagtctgaggataaggatagcgaagtgcaataaatttatcgcactggcatgcatggatagatacaatattcatcttaaggcaaattatgcttgatcccttatcataaaaactattataaacgactaccaggacatataaaatgaacagctgaatagatggacaacttacttaccctataaacataagtaatagaatatgacaggcagacggaaaacgcattgagcaatttgctctctataattaatcatggatgaaatcagcacaagcgtcgccaaatgaacaggattattgtaagatacagatgatgaaccttgcataatggacgcgactacggatatattagtgtatttatttctggtagaatcaggggggcttattataggactaactttttcagaaatattttcacctggaactcctctttgcacc

SEQ ID NO: 11640 - DNA, 830 bp, Diabrotica virgifera
  misc_feature (2)..(43): n is a, c, g, or t
  misc_feature (45)..(442): n is a, c, g, or t
  misc_feature (444)..(617): n is a, c, g, or t
  misc_feature (619)..(658): n is a, c, g, or t
  misc_feature (667)..(727): n is a, c, g, or t
  misc_feature (733)..(760): n is a, c, g, or t
  misc_feature (762)..(780): n is a, c, g, or t
  misc_feature (794)..(818): n is a, c, g, or t
cnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnncaatgaacnnnnnnnnnnnnnnnnnnnnnnnnnnnnnnnnnnnnnnnnnnnnnnnnnnnnnnnnnnnnntaagcnnnnnnnnnnnnnnnnnnnnnnnnnnnntnnnnnnnnnnnnnnnnnnngatgaataagctcnnnnnnnnnnnnnnnnnnnnnnnnnctaaatttattt

SEQ ID NO: 11641 - DNA, 687 bp, Diabrotica virgifera
aggacatgcataatttcatatgaagattataaacgggcagatgctgttactcatgagacttgctgtagagctggtaaaagagcaatgtcgccatcaaaggtttatcccatctagcatctgctatcgggggactctgcctaaccaactttgatctcacgttataaaatcatacatccctatattgatgaaaacaaatatctagaagcgaatttgtggtggccctgtaataactcaccaccaaaaacttcctcctaagaacatgatatatgcggactccaggcttaaattataaacggttacctgctgcatacaagatggatggccatactctcacatgctagcttttctttttgtatgctcttgatattactaagaaatatctactcgtcatacatatgacgtatgtatcatcagttcgactggcacgcgacattagatctataaatgtacgttgacatgcgttaggatcattccattgtaaaatttatgagtatatcttgatgaagcaagtcatattactctattatctatacatgcctctctgaaacgagaattacgacatatgtgagatccttctaaaggtaaaaatgattctaatgatatccatcttgagcgtcatgctatagtagatattaacttgctactaagcgattgtgaatatgcaaacgatatattagaaaccgaaac

SEQ ID NO: 11642 - DNA, 753 bp, Diabrotica virgifera
cgagagggaatgcggttcctattccgtatcccggcagcgtagccgtcacagagactggccctcgcaagagagcatcagaacggggtaacccaaatggaactgaaaacggagacaagagatacgggaagagttttcttttgctgaattaacgttggagtaccatggcatcctctagtagggagatatggggagctacgcgaacattaccggaatagcaatgatgacaggatctgctcctcgaaccttgagaatcctatatagggtcgcggggaggttctcaccgagttcgtacccatatccgcaacaagactccaaggagaagagactctaaaaaaaagaataatgatcagcacagaggatacgaagaaatgaatgcgaaacttcgaaaaaaggattgaatatataagatcgtatcgagacgttgtaggtgaggaacgggaacatggatgaggggcctggcctggctgaggagaagagagccctattcttacgagtggatcatcttgtatccgagttcggacccgtgactcgcacacccgcgtagcctgctcagctgcgtaggatctgagctacttgcgattgcacggtatgtacctcttcggacgcctttcaacggtcagatcaaaactagtacggactacgggaagccgattgactaattaatactgaggattgcgatggatcgcgcgcgaggcgatgcaatgcgatctctgcacagagctctgtatgacgacgtgaagaaactgatgcaag

SEQ ID NO: 11643 - DNA, 174 bp, Diabrotica virgifera
  misc_feature (2)..(46): n is a, c, g, or t
  misc_feature (53)..(171): n is a, c, g, or t
cnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgt

SEQ ID NO: 11644 - DNA, 763 bp, Diabrotica virgifera
ctatctcttgttattatagaaatttatgatagtgtaaactgagactatactacgaaatgtaatgatcaacttactatttcgataataagtaacaatcgccatactataatctctacatatatagatcaaaaatctatctgaaaggaccacgggatcctttctgaatatcttttgaaatctatggttttacctctcggatcggaattatcaccattacttttctatatatacacctatgattttctcaatatttctcctagtgctgatattgttatacactctgatgatatctacttttatcacacatagcaagatagttatgattaataatcactatatttgaatacagcacttacacctttcttcctataatataattaatctaggttatcatttatctccgcttaaatcaaaagtgaacatttttacccgactcaatattccaaattgtactaccatacaactggatgatattaatttttctttatcctaccaaatattatatcatcggaatcattctagataataaattaacctttattagcacacattgaataaattttacattaatgtaataaggtattatacttcttgaaatgaattatgaggacatagtgggggccggagccccaatcatacttgactttttataaatcttatttaatgtccattatatattatcacacctgctcatatgttagtgctaatgatagcttattataagacctagatacctactctacaacattaagctttgcatctc

SEQ ID NO: 11645 - DNA, 917 bp, Diabrotica virgifera
  misc_feature (351)..(365): n is a, c, g, or t
  misc_feature (896)..(915): n is a, c, g, or t
cccctttccacgcgtccgatagtagtccagaagatgtggtgcacgctgatgcatttactccaccaatacatattatctggcgttttttgaatctatctagcaatgcctattccgacgagatgtatggtgatgaactcccaccagaacctataatcatactccgcaaatctttagaggattatctcagccatcaataatgaacctttccctgccaatatgaaatacgacttcctgcctccttcgatctaaacacttaaacagaaaaatctccaaatatctcaatgaacatctctatgctgataaatacttgctcaccagattccaaaaattcttaaccttgtgtgccaaacnnnnnnnnnnnnnnncatagcatgatgtatgcaaagataacttattacacaccttcagtcatgtgataattacgcaaatgtctacataccaaccacctgcttcacatatgtcataaaacaattaaatgaccagctcacatacaaataaattaatatgaggattgaaaatagctacacagatggttacggaaccgtcgatatcaaagacttcgtggagatgatgagtgaatgatactcatagctactgggttatacctttatccttgtattatgatgattactgcattctttgttatccgatacttttatttatgtaactgtaatcataactctacatctcgtatgatgtccaatgacgactatatggtacatgctatatgcattacattcaatatatagactgcacaatttgacagaaatagagactgcgtgatgcctgtagatacaagctctaataataatgctccaattgtcatgcttgctgagagattggatgactttattcctcatgaatggggacattatgttaaaaactaactgtatacnnnnnnnnnnnnnnnnnnnngg

SEQ ID NO: 11646 - DNA, 76 bp, Diabrotica virgifera
  misc_feature (6)..(42): n is a, c, g, or t
taaatnnnnnnnnnnnnnnnnnnnnnnnnnnnnnnnnnnnnncattaaaaagcttatatttatttaaaagacgaag

SEQ ID NO: 11647 - DNA, 703 bp, Diabrotica virgifera
  misc_feature (357)..(374): n is a, c, g, or t
  misc_feature (668)..(685): n is a, c, g, or t
ctttttatttattctaaaccaataccatatttcttaatcaaagccaacaaaaattttatttcactcgatagataattcgtcttcgctagcccatattttctttttatacaacgacaaatatatcttttgtaccttgcgtatcagggattattaactaatacttatatatccactattttcgaatttagaagagctacacaattcagcacctttattgcaaacagtaagatattttacttcacctctttcgcaatgaaatcgctattcagggttctacaatatatctactctctctattcaatcccttatcctcatctattctccatatatttataactctatacttttatattatgnnnnnnnnnnnnnnnnnnggatgagctccgcaacaacattatattaaaagtttctttttatctaaaacttagcgatctagactatcatattttacaagacggtattatctattcttatatatgattattgttcctatttcttactatttgattaacatataactctaaattatttccatgtcttgatcactcgcatcatatccgtcttactgcattgcatatatattcaaactatatctggtaagtcctcgacttccgccacatttctttcacctgctcattagacacatgtcatttcgtaccaactgtctnnnnnnnnnnnnnnnnnncttagttcgcatggccgc

SEQ ID NO: 11648 - DNA, 633 bp, Diabrotica virgifera
  misc_feature (4)..(26): n is a, c, g, or t
  misc_feature (57)..(83): n is a, c, g, or t
  misc_feature (235)..(249): n is a, c, g, or t
  misc_feature (307)..(327): n is a, c, g, or t
gtgnnnnnnnnnnnnnnnnnnnnnnncttttgagtcgcgtgatggtaaagcaactgnnnnnnnnnnnnnnnnnnnnnnnnnnnataataaaatacacatataagtacaccttttcttatgtgttcattggaattatataagaaacacaccacacttagatgtatccgaattgatgttttcgtcttagtggaagcacctgctgccgctcctgcccccgccgaaaccaggtcctccnnnnnnnnnnnnnnnaagaaagccaaaaggtctggttccaatgtcttctccatgttttcgcaatctcaagtannnnnnnnnnnnnnnnnnnnncaacttatggaccaccacgaagatggcatcatctctaaaagcgatatgagggccaccttcgatgctgttggaaaactcgccagtgagaaagagctcgacgaaatgatcaacgaatcacccggaccaagtcaacttcactcaattgttgggattgttcgtgtacccgtataggctgattccagcagttacatgactatagatgaaatagacgtcaaggctttcatatccattgacgaaaactacaccattgacggaaatagattccgtcatgccctcttgacctgctgaggaaatgtccctcggctg

SEQ ID NO: 11649 - DNA, 938 bp, Diabrotica virgifera
attgctacttctaactctgtcttcttacgtagagaaaaacttgattcattcaagataagtgctccaacgactgttgttggtaacgagggcgaaccattcaagataacgtgtaatccacctgcgagggtatccgaaacccaaaattaattgggtttatttttataattcaggcgccattaaatccattaattcttctcggataactattgatccagaaggaaatctgtggttttctaacttaactcgagtagacgatagtgatgggcagaggttttacgcatgtgtagcaatcttagcagtaaagcaggaatacaaaattggtaacagaatattgctcaatgtaacacgacttgaagattttaatcgcaacagacaaccgcctacgaaacaatatgtcagtaaaaagagtgaagtgggcttacgaggaaaatctgtagaactattttgtatatatggtggaacacctgtacctcaaattttttggagtaaaaacggacgcatattagagacttcaaatcgaataagacaaaataattatggaaaatctcttctaataaaggatgtcgatattaacgatgcaggaacttatacttgtgaagcaagtaatggtgttggtgaagctcagacaaattcaatatacttgaatgtttttgcaagtccttatttcctaacgaaaccaacaaatcataatgccgctgaaggagatagtgtagaactggaatgtaaggcaagtggtgtaccagaaccacaaataaaatggatacacaatggaaaacctattgaagaatcattagacaatcctagacgaaaagtttaggcaataagattataatagagaatgacaaaagtacgacacaggaagatatgggtgtaatgcaaccaatagattacgctatgtttatgaggaaagttacgttaacgttttgagtaagttttac

SEQ ID NO: 11650 - DNA, 927 bp, Diabrotica virgifera
agtttttgaaaaatagtcagtggatcaacaggaagaagttaaaaggcaatggagtttattacatcactggcctcgataagcacacagattttagacatttctgtatactggctgctggggaattaatagccatcaccacaaagaacaggtaaagaaacatgttcttcgatcccatttacccttgttataaccaaatatgtctcgttatagttcaataggaactacatgggacacttaatgtacctcgttataaaacctcgtaatacctgtgttcatcataggtttaattaagcctaaataataaaatttcaacgttttaagattttagcccgggatcagtggtgctgttagaaaaaatctaacagtttatccttttccgtgaaaacttgatggaaaattttgcaacataactttacactcataagtgccttcaggaagattgtaataaactaaactaaaatagtaaagtaataaactgtaaactaaaaatatatgatatacacatcataagtatatggctgcactgccatttgcaaatatttcattcggagaacattctttgtaatcatgcttttttcctacaaaaatacacttacataattctagtaactgacattatttttcgattttaatactttgtaacactggggttctgtcatcagacgtcttgaatgacaagcatatttttgtagtaaaaaaaccatatcttcaataatcagtacaatgtcctaaaaatcttttatgctgttcgaaaaaaaaagtggaataagtttataatgacaacgaattatacacatggcataaactgaattgactcacaactgatcacaattcaaatggcatcgtgtaatgataggctgacgctccgaccaaacatcgacactcgggaccgtgcgattctcttaaatcgcgcaggtgccccccact

SEQ ID NO: 11651 - DNA, 766 bp, Diabrotica virgifera
  misc_feature (403)..(420): n is a, c, g, or t
cgccgcgacaaataaaaggactgtacaagtcaactttaaggtgccacagaaatcacactactcatggaattatgaacaggattactgcaataactcgcatacaagtacaacagtaaatatcgacaaataccaccgtgaatagttagaaagtggcgtaaaaaaaaagagagtataacagtgcgagatgtacaacgttacattcgtaacatataaaaatcttgaatgaatctacaaagtataactataccactaacacctcactggaaacttagaaatatagcaacattacctcgaataaaggcaaaaaattcaacaacactaacgtgaagaaaacatgaaagtggtaataagatgtcttccctggatatttagaaaagatgtacacaaaaaaaatgtgctaacnnnnnnnnnnnnnnnnnngaacctacaaaaatgctatagaaactgacatttgcttatatgtaattgacaacaatgaatctggctcctaaaacaagggaggacaaaaaccaccaactcctaatcaaatgaataatatagaagctagaggagaagctgaataaactaatgctcactgcatccactatattaataactacttcatcattgacataacactatatatgataataatgctagtcacattgctgtagtacttcgatatcgctacaacacttttacgtaatatattgtatataaatatataacaaaatgctttataacttgggtatgcacaggtaaagatgatttttgaagattgcacact

SEQ ID NO: 11652 - DNA, 874 bp, Diabrotica virgifera
ccttccccacgcgcgcgcttttttgtattataagtcacataatttttgagctagagacttttttattcccggagatagatatttttaaatactttaaattggattgaacaatatatcctcgaaaaatgcatagatttcccgtcttttgactttgaaactaacacactgtaccatttgacaaacatgagctagttttgacacgtatgcctgatcaaacggacaattttgagctgttaacacaaaactgattagaacccttaatgttgttatatagaactgacacttttgatagcgagtggctattgaactattaaatttatcctcaatgaggatagaacattttttgcttatcaatgaaggatattacctgctaatagcgccgcaacacaagactccacatctggacgagctagagtcaatgcatcatgctagggtattgatcatacaacgactcattcgggtccgcatacaagctgtgaacattctaatacctatgtaacgcctaggcgtccatatgagagggcccgtttagatcaagaattgaaaatcatcggagcctttggtctccgaaacaaacgtgaagtatggagagtaaaatacactctagccaaaatccgtaaggccgccagagaactgcttactctagaagagaaagaacccaaaaggatgtttgaaggtaatgcactcctacgtcgtttggttcgtatcggagtactagacgagaacagaatgaagctcgattacgtattgggtctcaagattgaagatttcttggaaagacgtctgcaaacactagtcttcaaatctggtctagctaagtcaatccatcatgctagggtattgatcagacaacgacacattcggatccgcaaac

SEQ ID NO: 11653 - DNA, 895 bp, Diabrotica virgifera
  misc_feature (33)..(88): n is a, c, g, or t
  misc_feature (110)..(150): n is a, c, g, or t
  misc_feature (172)..(202): n is a, c, g, or t
  misc_feature (209)..(333): n is a, c, g, or t
  misc_feature (336)..(387): n is a, c, g, or t
  misc_feature (391)..(467): n is a, c, g, or t
  misc_feature (470)..(760): n is a, c, g, or t
  misc_feature (762)..(894): n is a, c, g, or t
gcgcagtattcgcggcgagccccacgcgcgcgnnnnnnnnnnnnnnnnnnnnnnnnnnnnnnnnnnnnnnnnnnnnnnnnnnnnnnnngatgataaataattattgtggnnnnnnnnnnnnnnnnnnnnnnnnnnnnnnnnnnnnnnnnngcctcgtgtgtcacaggaatannnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnaagnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 11654 - DNA, 645 bp, Diabrotica virgifera
  misc_feature (2)..(66): n is a, c, g, or t
  misc_feature (68)..(116): n is a, c, g, or t
  misc_feature (166)..(189): n is a, c, g, or t
  misc_feature (191)..(223): n is a, c, g, or t
gnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnncaaatacaattttattaacatttaatttttagacaaaaattatgattatnnnnnnnnnnnnnnnnnnnnnnnncnnnnnnnnnnnnnnnnnnnnnnnnnnnnnnnnncctataaatttttcattcaaatataaactttacattatttaaatttaccaacgatgctattattaagattactatatagtatatttaatataaatgtataggattaatcaaaagactttgatagcatgtttttcacctgtacatcaaagacatgtgcttttcctctcctacataaatgctactctactcgacttcacaactttaatgatcgcacgtcttatctgctgagctatgggtaacatactcatctgtaattctacatctacccggctcctcaaggatctactgctgaagaacagcctttcttctccatatagaccaccctatccactcatgaacactcttactgttgtcttatgagagataatgacgccatctatgacttcagcagacgtaatcaagacatcgagcgcccaacctac

SEQ ID NO: 11655 - DNA, 675 bp, Diabrotica virgifera
gatcaacaaaaattaaaatacaggatatttttaatttgatgaatagatgaatgcgacatatataacaaactgtataatgatcaatcattaccaaaattactggatccgctatacacccttaatcataggaatatgaattgactgtgccgaatgtaattaacatcactaaacatcttagtgtcgtgcatactacatacacataaaactatcctgctagaagctcaatacttatttcttacacttctacacttaatcaactatgaagaagataaaatatgaatacgctgacttattactatatcacttgaaacagccatgacctacataattattatagacaataaaaaaatctaaaacatgtatcgcacaccaatacgattaatcagtaaaatatgcaaccccagtcccttaatcatattaatgccataaagtcattgtatatgattggacataaataaacaaaatggtgagacgctctagctactccacgattgctaacgctagaaagcgacactatgcatcatctatagtgtaacatcaattcgattcactgtactccgatattcgactcagtagtatctacaaacccagtcgctcttgatattaatagcgttgctgcagatccacctttgtataactgatataatagtgaagttatgcgtgctgattctgctg

SEQ ID NO: 11656 - DNA, 898 bp, Diabrotica virgifera
  misc_feature (157)..(188): n is a, c, g, or t
  misc_feature (192)..(250): n is a, c, g, or t
  misc_feature (310)..(328): n is a, c, g, or t
  misc_feature (356)..(375): n is a, c, g, or t
  misc_feature (486)..(504): n is a, c, g, or t
  misc_feature (516)..(535): n is a, c, g, or t
  misc_feature (809)..(809): n is a, c, g, or t
cgtaatctttcattctgcgtttgaatttttaaaaaatacttattggttttctcaggattcgaagaaaatgaatcctcatttgaatagcattgcagccgaaaatacgtacccatcctcttaacgtttcgacctccaaatcggatgttatcgaaatacnnnnnnnnnnnnnnnnnnnnnnnnnnnnnnnnatgnnnnnnnnnnnnnnnnnnnnnnnnnnnnnnnnnnnnnnnnnnnnnnnnnnnnnnnnnnncataatattagaattacctatattgaataaaaatgtgcaatttaaaatataatacatagnnnnnnnnnnnnnnnnnnngaactagtatttaataattttttcttcnnnnnnnnnnnnnnnnnnnngacaacgacatccgatttggacgtcgaaacgttaataaaaaataaaatcattttttagttggattggggcttattttccatttggaatagttgattatttcaagcacatannnnnnnnnnnnnnnnnnntattgtacaacnnnnnnnnnnnnnnnnnnnntaagcatattaagtgcatttcaaagaataataaaaaaattcaagagaaaagattgaaaaataagccaacggtggcgaatttttacagactcctcaaaaaaatggattttgcggtgaacatcagaactcgttgctggatcatgtgaaataaataattcaaaaagatttttttagcttatgagttttttgaggtaactctgtcgagttttttatttttaacgatttttgagttcttggtatcactcggaagtcaaaaaactgaaattctttatatncaaaaggtgaaaatcaacatatttatgattgtaaaaccaccaaataagcataaaaccaaatatatctcggcagagttacctcaggaaat

SEQ ID NO: 11657 - DNA, 497 bp, Diabrotica virgifera
  misc_feature (462)..(487): n is a, c, g, or t
ccaaaatacagttaaacgtagactgaaaaatatttatgagaaatggaagatttaaggctaaaaattgatcaggcctgtaaggttgcagaagatttcacaaaactttattatgatactctggataaacgacggcatttgatagcaagactgtatttggagacgggattattatcatggaatggtaatggtgtaactgggaatgaaaatattttgaaatttatgattgatttaccaccgtcatcttttactatacaaactctagacgcacagcctgttttagattctgcagtaaatggacaactgaccttcatcattcaagtgactggcagtgtaaaataccaagagaaaacaccaaaaacctttcagcaaaacttcataattacagcacagggcgataaatggaaaattgtcagtgattgtatgaggctgcaagaaccattaaacgctaagaactaacaactnnnnnnnnnnnnnnnnnnnnnnnnnnagtaattggt

SEQ ID NO: 11658 - DNA, 735 bp, Diabrotica virgifera
  misc_feature (40)..(113): n is a, c, g, or t
  misc_feature (123)..(275): n is a, c, g, or t
  misc_feature (314)..(347): n is a, c, g, or t
  misc_feature (367)..(398): n is a, c, g, or t
  misc_feature (412)..(459): n is a, c, g, or t
  misc_feature (490)..(540): n is a, c, g, or t
  misc_feature (550)..(581): n is a, c, g, or t
  misc_feature (688)..(709): n is a, c, g, or t
accgccgccattcccgcccgcgacccacccgcgccgaccnnnnnnnnnnnnnnnnnnnnnnnnnnnnnnnnnnnnnnnnnnnnnnnnnnnnnnnnnnnnnnnnnnnnnnnnnnaatggggaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggaatggaatgcgtatatccgttttatatatatctcnnnnnnnnnnnnnnnnnnnnnnnnnnnnnnnnnncactatattcataattatcnnnnnnnnnnnnnnnnnnnnnnnnnnnnnnnngcgacgaacttacnnnnnnnnnnnnnnnnnnnnnnnnnnnnnnnnnnnnnnnnnnnnnnnngaattttcatattctaaaatatgttataagnnnnnnnnnnnnnnnnnnnnnnnnnnnnnnnnnnnnnnnnnnnnnnnnnnncaaatttacnnnnnnnnnnnnnnnnnnnnnnnnnnnnnnnntgattatataattgatatatttactaacaatctataggtttaatacaggaattcaccaacatttttctcaccaccttattaccaccatgtctatttgtatcatgtcnnnnnnnnnnnnnnnnnnnnnnctactctgaccgccgcgcaattttga

SEQ ID NO: 11659 - DNA, 849 bp, Diabrotica virgifera
atagggaaggttggaccgcctgcaggaaccgcgaccgaaatccccgcgcccctcccacccgcccaaataaactatatatacttgtacatatttaaattatacagattacactactatgatattaaagcagcttctgattatctgaatacgatacaaactagcctccaacaataactacaatgaatatttacagatttgcctaaagatatacagattctaattgatctatagttccatcatttccttactcatgattaaaaacctatactgaatcttcagagcacaactatactacaatatctcaatgaaactttgacatttatcaacgatcagcaacataaatgcaagaaaatctataatcttagcgtggtgctaattttcaagccgtaatcactttcttccaaagttatttagtgatgattatgacaactataactactacatcatatctacatttttctgattcttctactatgtcataataacaccttctgattatctgcattctctacaaaaaactcctggcttgaaactaaagaacactaaaccacgtgttggctgatgaactgaattactattgcatgtaactatatacctatgactcacctaatactgctactaaaattgttagactatattgtatgactacattatcagacattgatcacttatacattcactttattattgtatattgctggacatatgtattgtattattatcatcgcaatgtaattaaaataaaaagatttgtggaagtattaatattttcaatttttcttcaacaagatctcgtaccgaagctcaggtaaaatataattttacacgtaaactttaatcttgttaaag

SEQ ID NO: 11660 - DNA, 486 bp, Diabrotica virgifera
  misc_feature (2)..(474): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttgggggtgat

SEQ ID NO: 11661 - DNA, 838 bp, Diabrotica virgifera
ggaaaggtgggacccccggcgggaacgggccggaaattcccggtccttcccccccgcccattttgatttgtcttacctgttgatctttttcgtacaacattgtaaccaaccatcatatataaagatagacaatacatgatgtgagtaagagatatatgatttacctctttttgaactcccctcatcgaaacatgagtatgctgctgtttttctaaatatttatatatatgtttattttcacattaaaaatagctctgaaaaaccttccaattgtatgacaaatatttaaaccatgcaacctccaaagacatagattcttctgtataatatgtacttcctgtatcgaaagatataaattcttcttatattcttaacgttcatactctaccatcctcctacattgaaatttatcctgtattcgctatgccattgaaaattatattgaacatcaattaaagttacttccagtatagattgagcgatataatgagattgatctctatcaataaacataatgtaactaactttatatataatctattattgtaaactgtatctataaccaacatgttatattataactataccttattattatataggcatgaataatgcaacaacataactcaaatccatacttattgtacaactgtatgattaataaacgagtacccaatatgttaaaccaaatgtgactcatgatatgatcaccttgtaatggaataggaccactgatgcaacctgctgaaaaattatgtgcacaaaatgcagctccagaaatttgacaacgatgattaatccaactattgcaacataacatcattgatttaaatgttat

SEQ ID NO: 11662 - DNA, 798 bp, Diabrotica virgifera
  misc_feature (11)..(38): n is a, c, g, or t
  misc_feature (89)..(107): n is a, c, g, or t
cccgccgccgnnnnnnnnnnnnnnnnnnnnnnnnnnnnttccttcttcttattatttttttgggatttatggttttggtgggaaaaaannnnnnnnnnnnnnnnnnngaaatgatatttgtatacttctccagggcaacaaaaatactatatcataaaaattttgttgtatgtttgcctctaaattcgtattgttagacaaaatctatcgcgcgacccattaaatgacagaaaatagcgcgactgttcccgggttaacattcggcagtacgtccacatttctaatgtaatgactatagtaatgaatatacgtaatgattatagtaatatagaccactcttaacactttagtgctctcaatattattttgactaatagtttggtgtcccagagcattttactcatgttcatgaaacccgacctggcaatttcatttcgtcttcttatttcttttatgttgtctatttggcaatttatctctctgcccatgtttggccttacctggactgaatgtctgagtatcctcagcaaatattttatttactgaagatacctaggctgatagattgatgacaatggcgatattgataaaactctcattggttttcttcctctatatggagattgccgtattgtatataagaatacattatcaacaacccacgccgaaacaaataacaaccaaaagtccctgcatatgaaacagaattattagaacaaatatcattagataactaaggtctcataaaagatgaggacaaacgtccatacatgcatttgtaatcccatattttatgag

SEQ ID NO: 11663 - DNA, 869 bp, Diabrotica virgifera
  misc_feature (2)..(20): n is a, c, g, or t
annnnnnnnnnnnnnnnnnnatactacaaaatgaggattgataatgacgaggattatagtgcatcagactctgatgacgattacacagaaaatgaaagaatattacttaataaagtaagaaatcgaggcaagaagttttcagatgatgagcaagaagtttttggtgttggaggcgatgaatcagaagataatgaagatgatgatggagatggaagtgatttagcattaagtgatgttgaaggacaggaggatgacgatttaccaggataccagacgcatgggcgcaaagataaaagaaagttttatcaaactgattatgtagatggtgattatggaggttttcaaggaaaagatgctcagcttgccgagttagaggaagaagaagcaaggaacctacagaaacaactagcccagcacttagatgatgatgattttggcctggatatatttgcaaaaaaagctgatgaagatgataaacagaatgaagagatcatcaaaactgatatttcaaagttgtctaaaagacaaaaactacaaattatgcaaaaagaatcgccagagttcttcaatcttgttcaggatttccaaaataaaatggcagtagtgacatcacacttacatcctgttttgaaaaaagctgaagctggggatataccacaatgcaaagctgttgattttgtacagtttaaatatgaattgatactagactattgtaccaacatctatatgtacctcttactgaagtcttcaacagtaaatgtgcagaatcatcctctcatcaaacgtctataccagtatcggcagttgcttctagaattagaaccagtatatgaggatgtcattaaacaccaatagaactgattttaaat

SEQ ID NO: 11664 - DNA, 585 bp, Diabrotica virgifera
  misc_feature (62)..(81): n is a, c, g, or t
aagataattattagctgcatgacgattaattcgtaaggaggcagatgatgttaataacatgnnnnnnnnnnnnnnnnnnnnctccctgtgtattagctgttaacaatcaataaccgccgatcatttatctaccaattatgaatggctaaaaacttatactttttattgaatacttcccacattcgaatactcatcttgaagggaaatgattttcggttctacttgtgtcgtactatgtaaggaaatatattaaagttctttatttcccagacatttaggatgtagcctattctcaattatccatattatgtatatgtataggatatgattgacaacagatatatatttccgcagaatttgaaaatagaaataaggatgaaacaattgcataaatcacattatcgaattataaatgttgttttgtactatgtgcccattactttataagtgatcagattgaagcgataaatttaaactaatgatgtattagaactgttacgatgaattcataatatggaatgagtgattaaaagaatccagacaggacccccaaaggaatgcataaacgttttttgtcacctcggg

SEQ ID NO: 11665 - DNA, 447 bp, Diabrotica virgifera
caaattcttggatctacagactgtatcagaatatgcaagaggacgggctgtacatgagattgtgcctggagataatggcgatatagcctttcatcctcacatagtaaccattctgtctataaatcttctactattatctagatttagagaatccaggtctctaacataacgccatattgattttgtgtaatgaactaatgtttcttatccctcctaacatgagtattctcactttactgcagtatagctacttcaatttgttaatgtctaatatttacgccacgtgatcaaagattacatcaccatcgcataggcatgccaattttcatatttctgacccatcgtatagcatgattaccactataatgatgtacaaggaggtcatccttacgatatttcttttatcatttgtatttattattatcataatggacgctctataccctt

SEQ ID NO: 11666 - DNA, 913 bp, Diabrotica virgifera
  misc_feature (4)..(30): n is a, c, g, or t
cgannnnnnnnnnnnnnnnnnnnnnnnnnnttatatagattatttattaaaattacattcatcgcataaaaaatacttaacaaactaatcggtaagaaatataccgccccgctgtctcagacgaccggataatttttacaacctgtcctcttttcagtccaaaatatctcgcaactgggtcaccagcttggattctcatcaacatattttcctttaatttatatcttgctaacaattcttgtttttcttctggtgtcattaccacatgttctggtaccaattcatgttcagtaatattgatcaacaactcggattccaaaaattgttctaatatgtattttggagccatatcaactagtgactgtttggcagatggtgtcatacctgcttgaacaacaataatagctctatgaatattttcttcctgcatacgggaacaataggttttaatggtttttattccaatttttggttcgtctgggaaaaatacaaacaactggtctgtaggatcatcattgtgagctaccaacacgatcaaatcacttcttgacggtcttttctcgctaggtttgtctccaaactgttccttaaattgttctaatgtttgatccaattcatcttgagttactaggtagcctctatcgtgacataactgcatgacagtttttctgattctccatagtttgtacgtttcagcttcgtcatccattatttagttaataatgcaaattcaaaatttaaatagaaaaatgtataatttgtcaacaaagttcagagaataaataatatagcaatatttctgtcgacacttgttttattttattacacttaaaattcaaaacctaacaaaaaaatttttgtggtgtaaatctttcttctgtttatattatggccgatttgcctattcgatttg

SEQ ID NO: 11667 - DNA, 892 bp, Diabrotica virgifera
  misc_feature (264)..(282): n is a, c, g, or t
  misc_feature (731)..(756): n is a, c, g, or t
ggaggagtatagcattggtgttccacacgatattacaatggaagttacaagtaccaaaccatttaatgataccaaagcacatttgaaaacttataccggcgaaagactgtatgaatgtaaaatttgttgtaagcagtttagttatctaagtacttttaatgagcatatgaaagttcacactggtgaaacaccttataaatgcgaaatttgtagtatgcattttaatcaccgaagtcatttaaatacgcatatgaaaattcacannnnnnnnnnnnnnnnnnnatgcgacatttgtagtaagccgtttactcgactaagtagtttaaaggatcatatgagagttcacactggtgaaaaaccttataaatgtaaaatttgtagtaagcagtttagtcacataagtaatttaaataagcatatgaagattcacattggtgaaaaaccttataagtgtgaaatttgtattaagcagtttagttaccttagtagtttaaatgagcatacgagtgttcatactggtgaaaaaccttataaatgtaaaatttgtagtaagcagtttagtcacataagtaatttaaataagcatatgaagattcacattggtgaaaaaccttataaatgcgaaatttgtagtaagcagttaagtcgcaaaagtggtttagataagcatatgaaaattcacacgggtgaaaaaccttataaatgcgacatttgtagtaagctgtttactnnnnnnnnnnnnnnnnnnnnnnnnnngagaattcatacaggtgaaagactttatgaatgtgaaatttgtagtaagccgtttactcgactaagtagtttaaaggtgcatgtgagagttcacactggtgaaaaaacttataaatgtgaattttgaagtaagcag

SEQ ID NO: 11668 - DNA, 923 bp, Diabrotica virgifera
  misc_feature (118)..(140): n is a, c, g, or t
  misc_feature (491)..(509): n is a, c, g, or t
  misc_feature (524)..(543): n is a, c, g, or t
agcgaattcccgagattccttccacgcatccgattgacttgatgcctgaatacttgaagctcccgatataatatttcctctaataaataatataagattttgattgcttcccacgtcnnnnnnnnnnnnnnnnnnnnnnntgatagtggagatgagggttgttgccgcaggaacagattacccgtctctgtcatctgatagttcgcccatgtatgtccatcaataaatttaactatttttagattacatttaactggaatttcttcaaatattaggtgttattaaatttattacaacagaaatgaatatactaccaatatgaataacctttgatcaaatacccctatttgattgatactgtcgaaattactactatccttcttctattatctttaccagtgttagtctgaagttattacaatattattatcagatcgaaatttaaatacatcattttatgatccaactgatggaggagatccaattctctnnnnnnnnnnnnnnnnnnnatttgggcatcctgnnnnnnnnnnnnnnnnnnnnccaagatttggattaatttctcatattgttaagcaagagataagaaaaaaagaagcttttgatactttaggaataatttatgctataatagcaattggattattatgctgtattgattgagctcatcatatatttacagtaggaatggatgttgatacccgagcttatattacctcagcaactataattattgctgtaccaactggaattaaagtatttagatgattagctacttatcatggaactactattacatatagtccagtaacactctgagcattaggttttattcttttatttacagttggaggattaacaggagtagaatagcaaactcctcaattgatatagtactccatgatacctatttatgatgtgca

SEQ ID NO: 11669 - DNA, 795 bp, Diabrotica virgifera
  misc_feature (471)..(490): n is a, c, g, or t
gccaagaagggcggtgaaatctcttacaataagtgattgaggaaattatattttagccgcatggttcaattattactgtattgccagttattttattaagtttgtgtttgaatcaaagtgacgaaatataatgaaactgtaagaagaaggattttgcaccgacccttctgggagaaatctcaaacgacgtatgaacttataaagacccaacaacaccacgggtaggcacttccagggttcaatcgacaagggacaggtctggaggatatacagcttcccatttgatcttgtttattttggttcttcttcctgcaaccctcagaggggcagtttcagtaacggttggaccgttacaccacattggtgttagcttcgtaccacggacttgggtattagacatcaaggaacattggaacctgtgaaaaggggtttgttttggggacatttatttgtaacggataaagacatacnnnnnnnnnnnnnnnnnnnnggacatttagcatacttatactttcataatttaattacatatattttttctttcctccaaaaacataagtatactgtaatttatcagagccatacctaaagttgatagtgatccccaaatttacataattccttggtagaagtttcgagctcgaatattcttcccacatatatgttctttacccttggtttgcattaattttagacttgttcccatgtagattaaatatataatttgtcttaattctctaactttaaaatcatttaactttgctttcatactttatcaaatttttattagttttt

SEQ ID NO: 11670 - DNA, 925 bp, Diabrotica virgifera
  misc_feature (386)..(414): n is a, c, g, or t
aaactttaaacgcgtttttcttaaaactgcctttttttttcaaaggcggtggatattgtaactcaaaaacaacttaaccgatctacctgaaattttgcatagattctctttagacatttcgtgaggtaacgctgccgagatattttttgttttgtgcttatttttttgtcctcgacaccttccggtataagaggaacatcgattatgtatgtatgtaagaggaacatcggttatgtttgtatatatgctagttttttgataaaaatgtgttgattttcaccccttttacaaaaaatttcgatattttgatttctgagtgatgccaaaaactcaaaaatcgttaaaactaaaaactggacagcgttacctcgagaaactcatacgcnnnnnnnnnnnnnnnnnnnnnnnnnnnnntcatgatgtgcttgaaatcttgatttcaaacaaccatactccccttacgtgaaattttttataaacttaagaaacaataatttaaccacacgttgccacctctaggtttaattcttggcatgtcaatcagaaaatatatgtgttaataaatctctatggccggtttcaccaacgacaaatagcattttattctatgaataaagttatttgaccaataaactgacatttctccattttactaacgtcacataagacttattttagttatttatgaaataaatacttactcttcgaataaattgggaagataatctggctataaatatttttaagaaagtgaattcgccagttttactttaaattatcaaaattatattgaaacataatataaattcattgatttatttgttgttggtgaaaccggaccgtttagtaacgtttagtatcgtttagtaacgaatatgtaactatattgttatttgatgtttgtgtttgtccatcgtccatttta

SEQ ID NO: 11671 - DNA, 695 bp, Diabrotica virgifera
ggcacacggacgttaagattgtgtactgtgtaggaattgactgttaataattactaatataatggctactgcccccgctgatactgttgctttaagacccacatactccctgagtacagagcattatcacatcatgttataatggatggactagcgcctcacctgggaaactaacccacaacatcctatgggatatattaccacacaaaaccgtacatcatcgctatgatgcatagacaacgaatctcgccgacatctaatccacaactttgctatgtatgttgacaaactaacatgttcgccgcgtgaatcttagcattcacgcagcggaaactgcctgttactgaaactctgttgctttagtagaggagcgaatgtggaagaaacatccaacataaaagaggtcttgaaaggctataaccaatctttctacccatatcatgacaattatgtgatactaactaatatgaacgcatccatgtaaccattctcaggagaaaatgtccctccgatatatccacaaagactgcatatcgccatgactcactaccttcccgtacaaaacatgctgatgcccttgctgtgctctcagatacccagatgattctctaagacgcttattgtgccatctactatgctggagaacgacaaggccatcgtagaagacattgcctcagtatacatctgtgtgatgg

SEQ ID NO: 11672 - DNA, 810 bp, Diabrotica virgifera
  misc_feature (95)..(122): n is a, c, g, or t
  misc_feature (143)..(177): n is a, c, g, or t
  misc_feature (193)..(223): n is a, c, g, or t
  misc_feature (244)..(265): n is a, c, g, or t
  misc_feature (271)..(292): n is a, c, g, or t
  misc_feature (341)..(360): n is a, c, g, or t
  misc_feature (372)..(419): n is a, c, g, or t
  misc_feature (421)..(442): n is a, c, g, or t
  misc_feature (444)..(493): n is a, c, g, or t
  misc_feature (512)..(575): n is a, c, g, or t
  misc_feature (615)..(680): n is a, c, g, or t
  misc_feature (682)..(696): n is a, c, g, or t
  misc_feature (710)..(727): n is a, c, g, or t
  misc_feature (751)..(783): n is a, c, g, or t
ggaagctcgtacgcccccacgtacccgtcccgaattccccggccccccttcgcgcccgcccccctttattttcaaataataaaatatccttttcnnnnnnnnnnnnnnnnnnnnnnnnnnnncgatagacaattagtatcgcnnnnnnnnnnnnnnnnnnnnnnnnnnnnnnnnnnncttcttgtacctcgannnnnnnnnnnnnnnnnnnnnnnnnnnnnnncttattattctcgaatttacnnnnnnnnnnnnnnnnnnnnnnttctcnnnnnnnnnnnnnnnnnnnnnnctccttcgtaacgaaatcgttattcgtttttaaatacatctaatcttcnnnnnnnnnnnnnnnnnnnncttatccccacnnnnnnnnnnnnnnnnnnnnnnnnnnnnnnnnnnnnnnnnnnnnnnnncnnnnnnnnnnnnnnnnnnnnnncnnnnnnnnnnnnnnnnnnnnnnnnnnnnnnnnnnnnnnnnnnnnnnnnnnctaaaatacgttattatcnnnnnnnnnnnnnnnnnnnnnnnnnnnnnnnnnnnnnnnnnnnnnnnnnnnnnnnnnnnnnnnnctaaatttagtaacgacgacaatattattatcaaaaaacnnnnnnnnnnnnnnnnnnnnnnnnnnnnnnnnnnnnnnnnnnnnnnnnnnnnnnnnnnnnnnnnnncnnnnnnnnnnnnnnncgtattaaatatcnnnnnnnnnnnnnnnnnntcaatttgaacggccgcggtatcnnnnnnnnnnnnnnnnnnnnnnnnnnnnnnnnnccctattgaaagccggaatgaagggtc

SEQ ID NO: 11673 - DNA, 699 bp, Diabrotica virgifera
  misc_feature (116)..(135): n is a, c, g, or t
  misc_feature (137)..(156): n is a, c, g, or t
  misc_feature (214)..(238): n is a, c, g, or t
  misc_feature (256)..(273): n is a, c, g, or t
  misc_feature (351)..(370): n is a, c, g, or t
  misc_feature (423)..(435): n is a, c, g, or t
  misc_feature (437)..(453): n is a, c, g, or t
  misc_feature (476)..(505): n is a, c, g, or t
  misc_feature (507)..(522): n is a, c, g, or t
  misc_feature (539)..(557): n is a, c, g, or t
cgccccggccccccgccctcccccacgcccccgatttatttttcaataataaaacatttcttagtataagcaaagaaaaaattgtattttctgatatttacttagtattgtgggannnnnnnnnnnnnnnnnnnncnnnnnnnnnnnnnnnnnnnncctcccgtcgcaccgcagatcacttaataattatctactttattattttcttcactcnnnnnnnnnnnnnnnnnnnnnnnnntattgcgcgacaaatatnnnnnnnnnnnnnnnnnncaatgacaaggtattcctttctcaatatatcctatttttttagaaaaaaatcacatctctttacttaacactatatcnnnnnnnnnnnnnnnnnnnnttatcaatattaaatatttctccggacgaccttaaaaacaaaatcttattacnnnnnnnnnnnnncnnnnnnnnnnnnnnnnnaaatctccttctccaatactacnnnnnnnnnnnnnnnnnnnnnnnnnnnnnncnnnnnnnnnnnnnnnncctcattaaaatatacnnnnnnnnnnnnnnnnnnncgagtagagatgatactattacaattgaatacttgtatacctaatatgcatatataggggtactcacggacccctcccaccccctttccacctgtctattcactgcgtgtctttctgtattctctaccccgccccgcctgcc

SEQ ID NO: 11674 - DNA, 113 bp, Diabrotica virgifera
  misc_feature (7)..(44): n is a, c, g, or t
  misc_feature (46)..(46): n is a, c, g, or t
  misc_feature (61)..(61): n is a, c, g, or t
  misc_feature (63)..(63): n is a, c, g, or t
taacagnnnnnnnnnnnnnnnnnnnnnnnnnnnnnnnnnnnnnntngcgacctcgatgttngnattaaagttttataattggtgtagcagctatattaataaagtctggtcga

SEQ ID NO: 11675 - DNA, 726 bp, Diabrotica virgifera
  misc_feature (37)..(69): n is a, c, g, or t
  misc_feature (71)..(88): n is a, c, g, or t
  misc_feature (100)..(126): n is a, c, g, or t
  misc_feature (151)..(200): n is a, c, g, or t
  misc_feature (209)..(240): n is a, c, g, or t
  misc_feature (250)..(285): n is a, c, g, or t
  misc_feature (295)..(353): n is a, c, g, or t
  misc_feature (372)..(407): n is a, c, g, or t
  misc_feature (409)..(425): n is a, c, g, or t
  misc_feature (429)..(454): n is a, c, g, or t
  misc_feature (477)..(492): n is a, c, g, or t
  misc_feature (495)..(529): n is a, c, g, or t
  misc_feature (531)..(547): n is a, c, g, or t
  misc_feature (612)..(637): n is a, c, g, or t
  misc_feature (663)..(684): n is a, c, g, or t
attatttaatgataggtaattagacatcgacgatagnnnnnnnnnnnnnnnnnnnnnnnnnnnnnnnnncnnnnnnnnnnnnnnnnnntggattattagnnnnnnnnnnnnnnnnnnnnnnnnnnnaatttaccagagctatataattacnnnnnnnnnnnnnnnnnnnnnnnnnnnnnnnnnnnnnnnnnnnnnnnnnnatatctcgnnnnnnnnnnnnnnnnnnnnnnnnnnnnnnnncttacattgnnnnnnnnnnnnnnnnnnnnnnnnnnnnnnnnnnnntctcattacnnnnnnnnnnnnnnnnnnnnnnnnnnnnnnnnnnnnnnnnnnnnnnnnnnnnnnnnnnnctaaaaattacgactatcnnnnnnnnnnnnnnnnnnnnnnnnnnnnnnnnnnnncnnnnnnnnnnnnnnnnnttcnnnnnnnnnnnnnnnnnnnnnnnnnnctctagattatttaaatctatcnnnnnnnnnnnnnnnnccnnnnnnnnnnnnnnnnnnnnnnnnnnnnnnnnnnncnnnnnnnnnnnnnnnnntgacatttctttcacctggtcattaaaagcatgactttttgaattaactgtaacgactctcctgnnnnnnnnnnnnnnnnnnnnnnnnnnatatattgaccgtgctaacgtagccnnnnnnnnnnnnnnnnnnnnnntcgatgcaatgatggtttggatgaaaacaatactgtctttat

SEQ ID NO: 11676 - DNA, 866 bp, Diabrotica virgifera
  misc_feature (416)..(435): n is a, c, g, or t
ctgaaatggtttaatggtgaacctaatgatgtgacaagagatatctataaagcactcagtatatgcaacgtaagtttataaatatctctaagcgcagctaaggtgttaaaaatgtccctgaaatggattaatggttagcctagtgttgagacaagagatatctctaatattttatacattcccaatttgtcataaaaatgattttcactgcaggtagagttattttctacaataatgatgcatccagtactgcttttgtcgtttataaatatgtagcttctgaaaagcgagagacttcttgaaaatgtccattgtatttatcaggtttccgctgtaaacatcagattatttaatatacttactctgatattatattgtaaactacataaggaatattaatattgagatatttatgnnnnnnnnnnnnnnnnnnnntgacagtatttaaacgtattatgaatacaatagtaagtatttacagattatattctagtaattatgttatagttaaattctacaggaaaacaaattgagatatatttgtatttctacaggaacttaattataacaaatcaagagtcacaatatagacctcttaggctgtttgaaagggtgcataagcacacactcctagtaagcgtaacctatagcatactaagtaaagtatttctagcagttctatttgagattacaaaagtaatgacaatcctttatatgtggtacctacttatcgatgacttgagtgtaaacacctcatatcttatattacgtaagatattacaggagagtccttatagtgaattgttccaaactcactctatcctaaaatatatatgatcgaatgtatgcgtaacgatataaatgtg

SEQ ID NO: 11677 - DNA, 725 bp, Diabrotica virgifera
ggtgcgacggctggagccggcggggaggtcccggcgcgcccttccacgcggccgaaaggatctatgtacgcatttatatatataaaagatatatgaaatgttatttgaagttgttttcatagtgatggtaaatatattagaattacgactacctaccctataaatttagtcgattcatatcttacagtaaaaaagtgctacaaaagaaactataccctaattttgctccctacctagcaaatgtcacataaacccatcatgcacttgcgacttcaataatagactgagcagttcttactctgccatcgatgtcatccatgatcgttgctgcggtatctagaatgtatagaacccaaccttattgcgaacatgcgcaccctactcagcgtatccatacatcgatccagatgttctgatgagcacgccaccagaacctcgacatgcaaagggtattgagttttctggccgatctccgtaatgcaagttgcactgactcgatatcaaattttatcttatcttgcctgtgtctagaacagtggatgtattgtgatgttctgtgaaccattatgctttaccatttaccgaataacttaaatctccacacttatctgtgacataatattagacttcttgactggctgtatggaaacagatattggattatgtgaatatatagagagcatgacaacgagaaacatatggaagtagataacaatatctgaatg

SEQ ID NO: 11678 - DNA, 112 bp, Diabrotica virgifera
  misc_feature (9)..(9): n is a, c, g, or t
  misc_feature (11)..(40): n is a, c, g, or t
  misc_feature (56)..(99): n is a, c, g, or t
cattttttntnnnnnnnnnnnnnnnnnnnnnnnnnnnnnncaattattaataccgnnnnnnnnnnnnnnnnnnnnnnnnnnnnnnnnnnnnnnnnnnnncggtgattaaaaa

SEQ ID NO: 11679 - DNA, 960 bp, Diabrotica virgifera
  misc_feature (833)..(851): n is a, c, g, or t
aaataaaagtagctcaattttataattagggcttcgactaggtctttctcagttgtaggcacgtcttatcttaacacgttgacggacagcgcgtcaaatgtataagcaagtgttgtgacactacatgtattttgcgtagtagaataggggaaaatgcaacgtctacagacgttgtgtcacattccatcaatgaaaattatacgtctatagacgttctgtccgtcaatgtcttaatgaaaactgtacaataagaaatttgacagggacaaataaaaggagctaagtggagatgttagatgcagctaggattgtaggcttgctacacctatttaattagcatttaaaattacaccacatgatgttagggtattccacaaaaaaggggacaatgcgaagcccaatatgaaatacaacgggtatctgaaagaaaattctactttaaatgcacatgaaaggtatacagaaaatatttgatatagcccggttatcgataagtgacacatttgaagagatagaccagttggtgtacaagtggtaataccatttgtacaccagttggtctatcgctttaagtttgtcatttatctataaccgggcaatacttgatatgacaatcagaattaagaccacacaaacaaatttgtagctagatgaatgttcatcaaagttagtatacagggtttgaatacagaggatatacgaaggataaatgagaattgaactgaaataattgaaaatgtaaattaaataatgattaaatcgaatatttagtgtacaaaaatagtaagacagaacataaggttaacaaatgagtttaatcaattgatatctgnnnnnnnnnnnnnnnnnnngaatattaaacatctgaggtttgtaagttctcttgtgattgatgctagtgccgatcttattaacctaacagattttattacttttaagcttgagcttaggcgaatgata

SEQ ID NO: 11680 - DNA, 721 bp, Diabrotica virgifera
  misc_feature (703)..(717): n is a, c, g, or t
ccacgggtcagaaccgataacaatgattatgtgtgaaaatcatagcttgcaatatttctgtgacaatgtgaaatctcactataacattcctactactactgatatattttttactccccgtgtcttataaatctatatgcgacaaaaaactagtatataaatacttaaatgatacattaatacaagggtttgacaattttttctcattacacgagaaacttatttccaagatacaataagctataactattgctatactactattccaataagagacatttctccatgataaatccatagatcctgacttggataatttattctttattatcaccatgatatattggacttaacaaaatctatgaggtaaatcatatgttctatgctacaaactagcaggattgtaatattactgattacaaagtgatatactcccaaaaacattttgatcatcacgcttatattctttactccccgcttcttatagaactatatcacgaaatgatttcaactgatcttaaatgatacattatctacaaaggtatgacaattttattcaattgtactcgtacgattatttcaattggtacacataaccgaataactatttctatactaccattctcaagatgtacatttctccatatgatataaagagatgccaacttgaatagtttcttcgctagattcctaaaactatatnnnnnnnnnnnnnnnctaa

SEQ ID NO: 11681 - DNA, 787 bp, Diabrotica virgifera
  misc_feature (18)..(51): n is a, c, g, or t
  misc_feature (64)..(114): n is a, c, g, or t
  misc_feature (128)..(162): n is a, c, g, or t
  misc_feature (168)..(232): n is a, c, g, or t
  misc_feature (245)..(295): n is a, c, g, or t
  misc_feature (297)..(399): n is a, c, g, or t
  misc_feature (430)..(510): n is a, c, g, or t
  misc_feature (526)..(581): n is a, c, g, or t
  misc_feature (583)..(601): n is a, c, g, or t
  misc_feature (607)..(636): n is a, c, g, or t
  misc_feature (745)..(757): n is a, c, g, or t
  misc_feature (759)..(783): n is a, c, g, or t
ataataatacaatatctnnnnnnnnnnnnnnnnnnnnnnnnnnnnnnnnnngagataattatannnnnnnnnnnnnnnnnnnnnnnnnnnnnnnnnnnnnnnnnnnnnnnnnnnccgtgtatcacggnnnnnnnnnnnnnnnnnnnnnnnnnnnnnnnnnnncatttnnnnnnnnnnnnnnnnnnnnnnnnnnnnnnnnnnnnnnnnnnnnnnnnnnnnnnnnnnnnnnnnngatgtgattcgcnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataaaaaattttcacatattaaaatatgtnnnnnnnnnnnnnnnnnnnnnnnnnnnnnnnnnnnnnnnnnnnnnnnnnnnnnnnnnnnnnnnnnnnnnnnnnnnnnnnnnaaatgaggataatatnnnnnnnnnnnnnnnnnnnnnnnnnnnnnnnnnnnnnnnnnnnnnnnnnnnnnnnncnnnnnnnnnnnnnnnnnnngtatannnnnnnnnnnnnnnnnnnnnnnnnnnnnngactctcctgcccactgagtaatttgaatgtccgcgcgattttgaccccgctatggtatcatattcactatattttttatagagagctgtaatgagagggtggatgagnnnnnnnnnnnnncnnnnnnnnnnnnnnnnnnnnnnnnnttta

SEQ ID NO: 11682 - DNA, 715 bp, Diabrotica virgifera
  misc_feature (672)..(689): n is a, c, g, or t
tgacacccctgcagaccaccggcccaaaattcccggcgccccccacgcgcgcgtacgagaatgaaatatcgttccggaacctcttggacaaattataataaaatgatagataataaagattgatgacagaaattttcatctttatcccaaaaagaatttataacgccataactggtgaaacatggataatgaattcccgatgacgtacccaccatatgcacattccccagacgctccagaaaacataagacgtaccagtgaccagtaaatatgttatctaaatacatgtatctgagtaatagaatatgattatacttattgtagatatgtctaattttgtataaaatatgttcattacaatcattaacgacctctcttctaatcacctcatgttaatatatattaatatgaaatatatctgacggatgagataataaagagaaatctgatcaaaaataattctctcgataaaaattatgatgagaagaaatcatatatacaaatgagacagtattaatttctacatattattattttaactgtaaatgaatagattactaatatataaatgtaaaatatacaaactgataaacgatgatatatatataagattaaaccattgtatattcagtgaaaatatataggttactgaaggaatgcatgaacatctannnnnnnnnnnnnnnnnngacatgtcttttagtgttagatagtg

SEQ ID NO: 11683 - DNA, 768 bp, Diabrotica virgifera
  misc_feature (374)..(392): n is a, c, g, or t
cgcgcggtctgttaacagccgattactcttactctaccatagtcctctccgaaaaggtctcccacaaccccacaaaatgtctctcgctgatcccgttgcctttatgaaggatttcctccctgccggtattcccgccgctatttcaagaacatgcgcagctccctcctgaccagaacccatgcttttgacctaacaacccttttccaggcaagtcactgaagatccgcgtgacaagggtatctaatactgcttcttacgtatcgcaaaggaatcggctgttcttgcctactggcgagataacaccgctaacgacatccgatatttcccaaccaagcaccttaacttccccttcgatgacaaatacaaacagatcnnnnnnnnnnnnnnnnnnnaaaatactccattctagtccgctacttcttaggcaacttggcctctggaggagccgccgcatctacctccctctgctatgtataccctcttgatttctccggatcctttatgaacgccgacgtacaagaatgatgcccatgaccgcgaattctctgcattgactgactgcattagctccaatctatccagctgactacttgatacgatgatttcgaggatttggagactcagtactaggtatcatcatctaccgcgccactattcttctattgctaccatactgccgatgtgatcctgcgcgatgctaacacactcgtctagcagtctcatgcgcattgcacagactgtgctccagctgctggatcatctcgtatc

SEQ ID NO: 11684 - DNA, 745 bp, Diabrotica virgifera
  misc_feature (40)..(63): n is a, c, g, or t
  misc_feature (99)..(135): n is a, c, g, or t
  misc_feature (268)..(285): n is a, c, g, or t
  misc_feature (287)..(323): n is a, c, g, or t
  misc_feature (349)..(363): n is a, c, g, or t
  misc_feature (365)..(387): n is a, c, g, or t
  misc_feature (475)..(529): n is a, c, g, or t
  misc_feature (531)..(549): n is a, c, g, or t
  misc_feature (582)..(623): n is a, c, g, or t
  misc_feature (625)..(647): n is a, c, g, or t
  misc_feature (649)..(704): n is a, c, g, or t
  misc_feature (706)..(718): n is a, c, g, or t
  misc_feature (720)..(742): n is a, c, g, or t
attcccgccggccaccctcccgcccgacgttcatttatgnnnnnnnnnnnnnnnnnnnnnnnngcaaagtagagaaagactctatttgacgacagctcnnnnnnnnnnnnnnnnnnnnnnnnnnnnnnnnnnnnngcaacatttattgtttgtaccgtgcgtatcacggattattaactaatcatcatatattccttattttcaaattgaaaggacctaaaaaattcacatttttgttgtaaaatacatatcttaagtaattcttccnnnnnnnnnnnnnnnnnnannnnnnnnnnnnnnnnnnnnnnnnnnnnnnnnnnnnncatctatttattaacactatatttgnnnnnnnnnnnnnnncnnnnnnnnnnnnnnnnnnnnnnnagggacgagcctcaaaataaaattttattagaactctcattttatagataaaaattatgattaaacattcccatatattacactatgnnnnnnnnnnnnnnnnnnnnnnnnnnnnnnnnnnnnnnnnnnnnnnnnnnnnnnngnnnnnnnnnnnnnnnnnnncccttagtaccgctcatactattagtattagcnnnnnnnnnnnnnnnnnnnnnnnnnnnnnnnnnnnnnnnnnncnnnnnnnnnnnnnnnnnnnnnnncnnnnnnnnnnnnnnnnnnnnnnnnnnnnnnnnnnnnnnnnnnnnnnnnnnnnnnnncnnnnnnnnnnnnntnnnnnnnnnnnnnnnnnnnnnnntat

SEQ ID NO: 11685 - DNA, 923 bp, Diabrotica virgifera
  misc_feature (42)..(795): n is a, c, g, or t
  misc_feature (797)..(827): n is a, c, g, or t
  misc_feature (829)..(856): n is a, c, g, or t
gaaaaatgtttatattaatcgatagattaattcagtattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnncnnnnnnnnnnnnnnnnnnnnnnnnnnnngataaatttcatttaattgggggtgatcaaaaaataattttaactttgtttatattataatattaat

SEQ ID NO: 11686 - DNA, 921 bp, Diabrotica virgifera
  misc_feature (3)..(127): n is a, c, g, or t
  misc_feature (129)..(646): n is a, c, g, or t
  misc_feature (655)..(673): n is a, c, g, or t
  misc_feature (702)..(732): n is a, c, g, or t
  misc_feature (743)..(779): n is a, c, g, or t
  misc_feature (781)..(825): n is a, c, g, or t
  misc_feature (855)..(913): n is a, c, g, or t
ctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccctgcnnnnnnnnnnnnnnnnnnnaattttggccgtgcctaggtaacataatnnnnnnnnnnnnnnnnnnnnnnnnnnnnnnngaaggggtggnnnnnnnnnnnnnnnnnnnnnnnnnnnnnnnnnnnnncnnnnnnnnnnnnnnnnnnnnnnnnnnnnnnnnnnnnnnnnnnnnncgaataaaaaccccactaaagttttttacnnnnnnnnnnnnnnnnnnnnnnnnnnnnnnnnnnnnnnnnnnnnnnnnnnnnnnnnnnntggggggg

SEQ ID NO: 11687 - DNA, 887 bp, Diabrotica virgifera
  misc_feature (135)..(186): n is a, c, g, or t
  misc_feature (188)..(237): n is a, c, g, or t
  misc_feature (244)..(266): n is a, c, g, or t
  misc_feature (268)..(293): n is a, c, g, or t
  misc_feature (295)..(319): n is a, c, g, or t
  misc_feature (331)..(344): n is a, c, g, or t
  misc_feature (346)..(408): n is a, c, g, or t
  misc_feature (410)..(423): n is a, c, g, or t
  misc_feature (439)..(479): n is a, c, g, or t
  misc_feature (484)..(500): n is a, c, g, or t
  misc_feature (502)..(566): n is a, c, g, or t
  misc_feature (568)..(606): n is a, c, g, or t
  misc_feature (634)..(684): n is a, c, g, or t
  misc_feature (720)..(767): n is a, c, g, or t
tatagaggaaagctgcctacgcccgccacgcaccggccccggccttcccgcgcccgatccacccgcccggccattaccgatcccagcgattatcactgtacctctttggaaacattttatttaatgctagttacnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnncaatttnnnnnnnnnnnnnnnnnnnnnnncnnnnnnnnnnnnnnnnnnnnnnnnnncnnnnnnnnnnnnnnnnnnnnnnnnnctttttaaatcnnnnnnnnnnnnnncnnnnnnnnnnnnnnnnnnnnnnnnnnnnnnnnnnnnnnnnnnnnnnnnnnnnnnnnnnnnnnncnnnnnnnnnnnnnnggatgaccttaaaacnnnnnnnnnnnnnnnnnnnnnnnnnnnnnnnnnnnnnnnnnctacnnnnnnnnnnnnnnnnncnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnngattacaacattgtctatttagtaatcnnnnnnnnnnnnnnnnnnnnnnnnnnnnnnnnnnnnnnnnnnnnnnnnnnncaaaaacatgtcatgttgcattaaatataacgtcannnnnnnnnnnnnnnnnnnnnnnnnnnnnnnnnnnnnnnnnnnnnnnncacgtagcataatcattagtattattattgaaagctggaatcgagggttggatgatcaacaaccgtctttatctacttatcacgaatgttattcttcacgtacactgcttaaattcttct

SEQ ID NO: 11688 - DNA, 831 bp, Diabrotica virgifera
  misc_feature (2)..(223): n is a, c, g, or t
  misc_feature (225)..(244): n is a, c, g, or t
  misc_feature (246)..(511): n is a, c, g, or t
  misc_feature (513)..(574): n is a, c, g, or t
  misc_feature (576)..(617): n is a, c, g, or t
  misc_feature (619)..(648): n is a, c, g, or t
  misc_feature (680)..(692): n is a, c, g, or t
  misc_feature (694)..(736): n is a, c, g, or t
  misc_feature (752)..(769): n is a, c, g, or t
  misc_feature (771)..(814): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncnnnnnnnnnnnnnnnnnnnnnnnnnnnnnntccactgattaatatgaatggtcgcgctatcnnnnnnnnnnnnncnnnnnnnnnnnnnnnnnnnnnnnnnnnnnnnnnnnnnnnnnnntttggatgacctaacnnnnnnnnnnnnnnnnnncnnnnnnnnnnnnnnnnnnnnnnnnnnnnnnnnnnnnnnnnnnnngatgagaagaccctata

SEQ ID NO: 11689 - DNA, 732 bp, Diabrotica virgifera
agaacagccccaacgctttcaagaacattacgactgataatcaatgccccacacacggtcaacttcctaaggagacatacggcgtagacatgttgtcacatcgatcgcactcactcagacgatacccagggatctacgcgaggctccacccgatagaggacatgtacaaacacccggacgcgacaatgacaaaaaattacttgtcgcaggtatgtatcgctaaaccaccggtagggagtgacaacaacatttcggccaatacgccgaaatccaaaatataattgtgaagacaaattccaacactgctatataaaggggatttgtattcatcgcatttacccgacacaatctattgactcacctgtacctgcaggcgaccatgtcctcagtggtgaaaaagtatgacccaaaatacccaaagacaaggctatgcaaaaatattatgtaggccgcactcacctctgaattgaaagatgatgacatccagaactatttctcacaatttgaatcgacccttgatattcgaagtgacatttgacaagcgaaagaacccaatcgacacgcatcctgaattcatcacatcttgaatctagaacaagtagcgaatgcttcactcaatcgaccccaacaaacccttatggacaaagaggtcgatgtaaagaaagctcctcccaaagcagaccaaacggcagatcccatgatgcatatgcatggcatgcgaccaggaggcag

SEQ ID NO: 11690 - DNA, 638 bp, Diabrotica virgifera
acatatgctgaacttgctgactacatgaatgcaaaattattaaacaaggctccaggttctgagtcctgatataaaccgacatactcatccgcacctggattaaatgatcgcaaatgaaattaattcactatctcacattatagtctgcttactcctcacctttatgtttacctgcgacagatccagaaattccttacaaactctgcgccaacattacccgatgctgtacctcacgtatgaatactctgctccaaagacatattcctcttcaaaaccaccaatgtataaataatctatcccttgaaaacacaaaatcatgacacacactaactacgatacaacagcgccaactacatccccaatatcctacatcagaactcatccctctaaaaagtcttctaactctagaccatatattaaacaaattatggacacccgagagctactcctcaactgatccactaatatcaacttactcggcaccatcaacaggccaaggcatcgctcccttaatgtataacgagactgctccagttgtatctacctactcagcccctcttgtgactacaagtgatgtctgccacgcctgtttcatatgacgctatattcttctcctgatctgtctgctatattctgct

SEQ ID NO: 11691 - DNA, 805 bp, Diabrotica virgifera
  misc_feature (24)..(41): n is a, c, g, or t
  misc_feature (64)..(85): n is a, c, g, or t
  misc_feature (93)..(141): n is a, c, g, or t
  misc_feature (149)..(181): n is a, c, g, or t
  misc_feature (242)..(260): n is a, c, g, or t
  misc_feature (268)..(295): n is a, c, g, or t
  misc_feature (317)..(355): n is a, c, g, or t
  misc_feature (380)..(397): n is a, c, g, or t
  misc_feature (405)..(425): n is a, c, g, or t
  misc_feature (464)..(493): n is a, c, g, or t
  misc_feature (513)..(550): n is a, c, g, or t
  misc_feature (587)..(606): n is a, c, g, or t
  misc_feature (608)..(631): n is a, c, g, or t
  misc_feature (633)..(646): n is a, c, g, or t
  misc_feature (658)..(713): n is a, c, g, or t
  misc_feature (715)..(729): n is a, c, g, or t
  misc_feature (773)..(796): n is a, c, g, or t
cccccctcccacccgtccgttttnnnnnnnnnnnnnnnnnnttacccacaccaaacaaaaatcnnnnnnnnnnnnnnnnnnnnnncacttgcnnnnnnnnnnnnnnnnnnnnnnnnnnnnnnnnnnnnnnnnnnnnnnnnncgtatccnnnnnnnnnnnnnnnnnnnnnnnnnnnnnnnnntttccaatttaaaagagctaaaaaatcacaattcttattgtaacacaaatattttacatcnnnnnnnnnnnnnnnnnnncattcgcnnnnnnnnnnnnnnnnnnnnnnnnnnnntaaattacccttatttattacnnnnnnnnnnnnnnnnnnnnnnnnnnnnnnnnnnnnnnncacatatttttagggatcagcttannnnnnnnnnnnnnnnnncatttacnnnnnnnnnnnnnnnnnnnnncaacaattttcatattttaacatatgctatcatttatcnnnnnnnnnnnnnnnnnnnnnnnnnnnnnncttctttattacaatatacnnnnnnnnnnnnnnnnnnnnnnnnnnnnnnnnnnnnnnctattacaaaattgtctatctactaaaaatatatacnnnnnnnnnnnnnnnnnnnncnnnnnnnnnnnnnnnnnnnnnnnncnnnnnnnnnnnnnncattaaatatcnnnnnnnnnnnnnnnnnnnnnnnnnnnnnnnnnnnnnnnnnnnnnnnnnnnnnnnncnnnnnnnnnnnnnnnctatttttattgaacgctgcaatgaaggcctggatgaacacacnnnnnnnnnnnnnnnnnnnnnnnncgattttat

SEQ ID NO: 11692 - DNA, 63 bp, Diabrotica virgifera
  misc_feature (10)..(60): n is a, c, g, or t
gtaaaaagcnnnnnnnnnnnnnnnnnnnnnnnnnnnnnnnnnnnnnnnnnnnnnnnnnnnaat

SEQ ID NO: 11693 - DNA, 717 bp, Diabrotica virgifera
  misc_feature (157)..(176): n is a, c, g, or t
tcttacgcgcgcgttgtaacctaaaccaccctttcattttactgtcattctgagatttattattttaatatacggagattattactatattatgtgtggtactaaagtctttaaatagatagggtttatttgagatgaataattgacacagacgggnnnnnnnnnnnnnnnnnnnntatcctccgtcaacaagtacctgctgtaatagacactccagatgagaaggatgaaatgcagtaatatgacttccaagccataactagtgtgactaagaaagtacgatcgcaacaaccacataatcccccctttgtcaaaatttccttttacgcaaattctgcactgatcttctcacttttcctgaggtgactattgaggattcataactcttacagtctgatgtaagtttacctagaaatttaatgaaacatagtcttatgtacagattctactctcatgacaaggaaatgtcatcacaatcgttcagatatttctggtctgaggactgcaagctgcccactatactgcatgtgaggcatcgtaatgttacatttacttctgagaacttgtatgctctatctgaacatatcttgagagattctataaccttcatatgaacattgcgtgatacagactctaatattgttgaatatgttcaatgaggaggaaaattctatctctactagtgcatggagatatgatatctgcaacatgtatatc

SEQ ID NO: 11694 - DNA, 213 bp, Diabrotica virgifera
ttttttgcttttgttctttattaaatattttctgtacaaaatctgggacaatatgcataaaaaaatcgagagttacacaaaatttatcgttttattaaattttgtcatacaatggaagtacacaacgcctcctttcactcatacaagttatacatataaacttaaaaactacgtttacatcatactagagttaaataaagaaaaacataatac

SEQ ID NO: 11695 - DNA, 611 bp, Diabrotica virgifera
  misc_feature (2)..(130): n is a, c, g, or t
  misc_feature (132)..(436): n is a, c, g, or t
  misc_feature (443)..(480): n is a, c, g, or t
  misc_feature (500)..(513): n is a, c, g, or t
  misc_feature (516)..(533): n is a, c, g, or t
  misc_feature (546)..(567): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnaagactgttcgannnnnnnnnnnnnnnnnnnnnnagattaaaccggtgtgagccaggattgttttctatctttaattt

SEQ ID NO: 11696 - DNA, 920 bp, Diabrotica virgifera
  misc_feature (814)..(814): n is a, c, g, or t
  misc_feature (833)..(833): n is a, c, g, or t
gtctccaaaaaatgttcaaaattacagccgcaatcttggaacgcgtttttgctacctgttgatcgctactgtttcctcttaaggcttatcagacggaactcgttgcagtgctgtaggtttggctttttcagttgtgggataaatggagcaaattgcaatagtagttatttatgtatcaagtcagtaaagtaaagaatagcgttttcaaagacacaaaagttgtgttatatttggaaaagccctatcgaatgcctattttgcaattgatttttacgaaatttaatataactccggttctaacaatcggatcaaagttttccaaacgccaattggttcagtttttcaaaaggaacaattttcattttggtaaaattaaactctaataggttatgacacacaatcatttaaacaattaaattgttaataacaaataattatatgacgggttttaagcttagtatcctcgaaaaatcgaatatacgcatcataaaaattaaaagaaaaacatcaaggtacccaggggacataaaagtgcatactcaaaatcccacccctgcttcctagagtgtaagtctaaatcccgatacgagtttatttttcgacgtgttggaaatatcatagttataattttggttatattcaaattatttcaaatcttataaatccttgggtgaacacaaactaaattagtgaaaaaggagaaacagcagcaccacgccacgtcttcgtgcgacgccgacgcctacgctccgaattacaagcacggattcgattattatgatgtgacggtcggttgcgctctctctgctatgcncaaatagatgaagattgancaggcactttaaccaaataggaaaattggtttgtgtggtgtagattgaatatataccttttatataagcgtcaggcttaacgctact

SEQ ID NO: 11697 - DNA, 770 bp, Diabrotica virgifera
  misc_feature (363)..(386): n is a, c, g, or t
  misc_feature (399)..(411): n is a, c, g, or t
  misc_feature (413)..(432): n is a, c, g, or t
ccatgaacacaaacgcgaaaaatcctcgtattcttaaaagaataggaacccatatgggagtttttcattgagatgaagccttatcatgatatatgtgaagacaggtacactgaatatcgcaaatcaaaaaagaatataaatagaccaaagaataccagaataattgttattatgtaatgatgatatttgtagttagatgtaccgtggataatataatcacaaaaaacatagatacgaacatcatcaaagaggatttgaacaaactataattactgtacgtccagatcttataaaatacatagctataaaggtaagttctgctggtttaatttatgctcattttggatatgaagtattagacgnnnnnnnnnnnnnnnnnnnnnnnncctacaaataatnnnnnnnnnnnnncnnnnnnnnnnnnnnnnnnnnaggtatttgtgtaaaaattagatgctatagacaatggagtgcctatgtttactgaaggtagaccataatatagaatatacacccatttaagtgcgataatacacacataaaatccagaatggaattctccaaatccagatcctagcaatgaatctttctttaaagctatggaggaaataggaacagaatttaatgaaagaaatatagatatcacaactgtttgttgagcagctggaggcgatgtaataaaatctatataaagcatatgtatagtacgtgaaaacggacagatatatttactaaacaacagatgtccatggaaagatcatctatctgta

SEQ ID NO: 11698 - DNA, 801 bp, Diabrotica virgifera
cacgaaagaaaatatagagtgtgctgagttataacttccccagttccatggaccaaacagtaatcacagtgttctgctttatttccacggaactggggaagtgagatcgtacagcgaaagaaaatatgagttgctgagttataacttccaaattatagcttttgattataggggatatggtgactcttcagatggagaacttactgaagatacagttggggaagattgtgttgaactatacaaatgggtcagaaatcgaacaaaatctgatatttatgtttggggccattctctgggggctgccctagctactaggacagtggctgagatggaaaattactacaatgtgcataccaaggcattagttttggagtcaggatttaccagcatgagggatgagctgtatgttcatccatatggaaagttatttgcctggttgccgtggttcgatacagtcgtagtggaaccattaatgcacaacggatttgtatttaacactactaagcatctgaagacaataacttgccctgtgatgattttgcatgcgcaagacgataatgaaataccgtactattttggaaggaggctggctgacatagcagaaagcagaaacatcactacagtttatcatgaatttgatgcgatgtttggttacaagcattattatctgtatcaagatccatttatgaagttttatatcatgaattttatcgaacaagtaaacagtaagaggattatcgaaggtaacaatacgacggtggtaccgtctatgggtacaactgtatgaacaataagacgtat

SEQ ID NO: 11699 - DNA, 739 bp, Diabrotica virgifera
  misc_feature (40)..(64): n is a, c, g, or t
  misc_feature (266)..(287): n is a, c, g, or t
ggtacgcgcctggtacgccgataccgagcacctctttggnnnnnnnnnnnnnnnnnnnnnnnnnttatagacaaatgcctgaatttttcccttgctcccaaatagctttaaaacgccattattgagaataaatttaaaaagttttcccggggacggaccccccttatgaacaatccccagacccccaggaacattgcgtaccggatccttatattgttacaaaaacggcactgattatacatatataatattattggagtgtgatnnnnnnnnnnnnnnnnnnnnnncattacgatccattatgaccctctcttttcacctctggataactagatatcaggaagtttatctgacagattaaatactaacggatatctgacaaacaaaaacttcccgttaactaaatatcaggagctgaaaagacagatactaaggatactgctatataaacttcccaataattaattatctggaaatgataagacctctaatatctaatctgtcagataaacttcctgatagacaaaaatataatagaaaaattaaccttgtttttagcagtgattaaataaacgaatactgagggaatgaaatggatcacgaacaaggatgttctatgaggaatgaaaaatgagttgtagattgagcttaccattaaacacataaaactgcagtatctgctactcatatgagaaatcgacaccgatactccctgatgcagtacgtatagcaaggtaca

SEQ ID NO: 11700 - DNA, 757 bp, Diabrotica virgifera
gaagtggacgctgcggtaccggccggattcccggctcgtccacgcggccggtacagtggtgatgttaactaggatgtaatgatcgagtacctcaaacttattccagccttggacacagtgacaggagaaccaggagcctagaatggtgacgactcagattgaagctaattggattactttatatctgcttacgaggatgaattcataaataacaatagtatctccacaatgatccttaattgtctcatgttgaacatcaaaaataagtacacaatgatgatgcatgctgatgttaccctcactcgccttgctcttgaagtgaagtttcatgacattttatttaagcaaggctgaggcaaatgtgtgacattattaatatgatagatgaatatttcccttacataccattcctctgaaaacatgatgcaagtaagatagtatgtttctgttgttattgaaaatcacttgacaaaagtttgaatattctactgaattatcgaacaacgcaaattatacacaggaacacgaactagagtgtgttcttccaccgactttcataagaactgactttacccatcgcatttcgtattacttgagatgcaacggatttatctatagattgttctattataggtactatagaatatatatactgtcacttcattgctacacactattgactattctgcatggtctaatcacagagttctctcatatatagttatgtacatatatgtgacctatatatattacactt

SEQ ID NO: 11701 - DNA, 911 bp, Diabrotica virgifera
  misc_feature (256)..(274): n is a, c, g, or t
  misc_feature (454)..(472): n is a, c, g, or t
  misc_feature (560)..(592): n is a, c, g, or t
  misc_feature (651)..(676): n is a, c, g, or t
  misc_feature (690)..(709): n is a, c, g, or t
ctatcaaagaacttagaggcgatgggttcgttaactttatcagtgatctttttatcgttagcggctttttcggtcgctgaaaatattgttgtgtgtaactacgagtcaaagtcccatttaagagatggagaaggaaaattcgatgtttctaatttaaacgaagctttgcgctattgcacccatttattatatggctacgctgcaattgacgacaacacatacaagttagttccaatgaatgaacaatatgatgtgnnnnnnnnnnnnnnnnnnnatataaccgatttgaagaagacccaccccaaacttaaggtgttactttctgtgggaggaaacgaagatgtttctaatttaaacgaagctttgcgctattgcacccatttattatatggctacgctgcaattgacgacaacacatacaagttagttccaatgaatgaacaatatgatgtgnnnnnnnnnnnnnnnnnnnatataaccgatttgaagaagacccaccccaaacttaaggtgttactttctgtgggaggaaacgaagatgtcagtggctcaggtgacgnnnnnnnnnnnnnnnnnnnnnnnnnnnnnnnnnctaccgctcaccggttaagctttgtcaactctgcatacactttattaaaagcttatggnnnnnnnnnnnnnnnnnnnnnnnnnnaattccccgaaacnnnnnnnnnnnnnnnnnnnnctggattgaaaaaactgtggagttccatcaaaacaacagttgccggtgaacatgttgttgacgagaatgctcagcagcatagagaacaattcgtagcattagttaaagaacttaaaatgctcttaagcagacacatgcaactgtctctgacagttttgccaacattaccagcacagtgtattatgatcccagaaatctggcc

SEQ ID NO: 11702 - DNA, 854 bp, Diabrotica virgifera
  misc_feature (78)..(96): n is a, c, g, or t
ttctaaaccagtggagctcagacttactctgcgtgggatctaccacgtaaactgcaagggtccagcgatcgactgccnnnnnnnnnnnnnnnnnnntttgaaattaaaaaactttattgcacgtttcagtttgataaaaagttgtaactacagatagttataattaaagtcatgtttttcaacttaattttatttgaatgttgatgcatggcactgcctatcctccacaggttttttcatatgatactacgtaattaccgaggaccaaatgtaagcatgatgagagatgttcgtcagccgattcatcatcagggcttctcattccggatggaatatttgtcgcacttgtgtgttgtcaaagtttgttgtatgacttgtctttcgttacaattttcttccattcattttgatatatgcataattccctccagtttctcacttccagaattttgatatctctcatgacctggtcctcccatctctctctgggttttccccttggtcttttagtttctggtttccatttggtgatgttcttaatcagtaggtcgcttttctttctctgtatgtgtctcagccatctcagtctcttcatctcattaataaatctaactatatcttcttccttcattatgtctcttaggggtcaatccatatggaatcgaccacaaaaaaggtgatttctgttttgaccatctccgattttgatgatttttggtacatttgttctgcttacccaaaaactggaaaatctgaaatttgggaattttttttactactggttttggttttatgaatttttgaaaatgacggaattgtcaattttggttatgaggagttctgaaaggggggtt

SEQ ID NO: 11703 - DNA, 802 bp, Diabrotica virgifera
  misc_feature (533)..(555): n is a, c, g, or t
ctcactatctagaagagatggtgcgcctgctggtaccgccccggcattcccggcgccccctagccgccgccttctctttatctacatagagcccttgcttctttggtaaaaatcttcccagcattccatcataagtgatagttaattaatattgagaaaaaacattaacttcttctacaaatattctataaatctttgaaccttatctatcacgaataattgcttaaaactgctacatctgtaatgaaccaaaacatgctctcacaaaaacctctagctatgattgtaaaattaccccttttataaaaccaaatcgcaaacaaagctgatacaactgaatatactcccaaactactgaaacaaagaaaatttcaccatgtacccatcctatcaatatatacatctttgtatatgaatatcaatcaataaacatcagtctttacactatgataaactaaattcaatttatatcatccacaacttgtacctattgatattaaccacctaccaataattgaaattattatatcccnnnnnnnnnnnnnnnnnnnnnnngaaatactaccttatgctatgaatacagaatatactcatgaagttcatcacatactcccaatatgaaaaacctatacattaagctcttatactgtattccgcttacacaaacgtatatcgcttatcactcctgctatgaaagaccactatgtttgcataccaatcaaactctctcctgcccactgacatactcgatagttcgcctacatataccactataacgaaacatagaactgtagaatattac

SEQ ID NO: 11704 - DNA, 733 bp, Diabrotica virgifera
atatgtatcttattattcttacttatgactgtaataacctattactataaataataatagagatatggtaataatcaactataccacctatggtgccttccacctccaggacttgcatgggacctactgcctatatccctacactctgtcccactatgattcactctcaatcacagaactatctgaaagagaaaactattaaaagaatataacacactttcattgtgtaaatatacgaatatgaccgtttatctgaaaatccgatgtgtatgttaatacttttaatttaattgcctccacgatgaaatgaatgtataaatacacttattgcttctctgcatcccgcacctactgccagtggagtgatcataaatacaatatcgaatcacaccattatactatcttcaactcttattcaaacatgcatcatcagaatactgtgctcattctccaaatgctccatgtggtggactactgcattgatatcaatgacttcactgacctcatacctgtaatcttaactgacaaacatcttttcaccctgaatcatttcatgtctcatttagcgctaaatgatgtatataccatgatatattacctcaattagagactctctgatcgagatacctctgcgctgtctgttcatctctttatctataatagatattagacagaagctatagatgctattactaaggactctacttttgctcatgctgacttagactagtat

SEQ ID NO: 11705 - DNA, 917 bp, Diabrotica virgifera
  misc_feature (527)..(616): n is a, c, g, or t
  misc_feature (789)..(789): n is a, c, g, or t
  misc_feature (796)..(796): n is a, c, g, or t
  misc_feature (809)..(809): n is a, c, g, or t
  misc_feature (816)..(817): n is a, c, g, or t
  misc_feature (852)..(852): n is a, c, g, or t
gcaaccatacttcccccggaacccaaaagctttggtttcccggaagctgctcgccgagtcatcggaggaacgtcggcgaatcgctagctggcatcgtttatggttagaactagggcggtatctgatcgccttcgaacctctaactttcgttcttgatcaatgaaagcgtttttggcaaatgctttcgcttctgtccgtcttgcgacgatccaagaatttcacctctaacgtcgcaatacgaatgcccccatccgttcctattaatcattacctcggggttccgaaaaccaacaaaatagaaccgaggtcctattccattattccatgcacacagtattcaggcgaagttttggcctgctttaagcactctaatttgttcaaagtaaacgtaccggcccacctcgacactcagtcaagagcaccgcggcgggattgagttggaccgcccttgcgagctaagcccaccggtaggacgtcccacgacacgccagttgacaccgcgtacgatgaaccagcgacgtgggacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaattgatcctcgttaaagggtttagagtgtactcattccgattacggggcctcggatgagtcccgtatcgttatttttcgtcactacctccccgtgccgggagtgggtaatttgcgcgcctgctgccttccttggatgtggtagccgtttctcaggctccatctccganatcgaancctgattccccgntacccgnntacaccatggtaggcgcagaacctaccatcgacangtgataaggcagacatttgaaagatgcgtcgccggtgccagaccgtgcgatcagcttaaagttat

SEQ ID NO: 11706 - DNA, 794 bp, Diabrotica virgifera
  misc_feature (2)..(69): n is a, c, g, or t
  misc_feature (76)..(142): n is a, c, g, or t
  misc_feature (146)..(200): n is a, c, g, or t
  misc_feature (202)..(254): n is a, c, g, or t
  misc_feature (256)..(417): n is a, c, g, or t
  misc_feature (419)..(515): n is a, c, g, or t
  misc_feature (517)..(569): n is a, c, g, or t
  misc_feature (572)..(596): n is a, c, g, or t
  misc_feature (598)..(624): n is a, c, g, or t
  misc_feature (665)..(680): n is a, c, g, or t
  misc_feature (682)..(704): n is a, c, g, or t
  misc_feature (746)..(769): n is a, c, g, or t
cnnnnnnnnnnnnnnnnnnnnnnnnnnnnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnncgnnnnnnnnnnnnnnnnnnnnnnnnncnnnnnnnnnnnnnnnnnnnnnnnnnnncgacagctgcaatgaaggcgtgcatgaaaaaaaacctgtcnnnnnnnnnnnnnnnncnnnnnnnnnnnnnnnnnnnnnnnccttatattcttttaagacacgagaacactctatagagttannnnnnnnnnnnnnnnnnnnnnnncagtattatatatatatatataata

SEQ ID NO: 11707 - DNA, 829 bp, Diabrotica virgifera
  misc_feature (11)..(77): n is a, c, g, or t
  misc_feature (79)..(216): n is a, c, g, or t
  misc_feature (218)..(292): n is a, c, g, or t
  misc_feature (294)..(372): n is a, c, g, or t
  misc_feature (374)..(444): n is a, c, g, or t
  misc_feature (449)..(548): n is a, c, g, or t
  misc_feature (550)..(596): n is a, c, g, or t
  misc_feature (618)..(630): n is a, c, g, or t
  misc_feature (632)..(740): n is a, c, g, or t
  misc_feature (763)..(792): n is a, c, g, or t
atttttattgnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnngatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnacaacattcttttcacctgtannnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgaagtggtggatgagaatnnnnnnnnnnnnnnnnnnnnnnnnnnnnnnattagatttaagctaataagcttaaattattgtaaac

SEQ ID NO: 11708 - DNA, 856 bp, Diabrotica virgifera
  misc_feature (799)..(799): n is a, c, g, or t
gtaaaaaagaacgatttgaaatttgcaaatttggtgatccaatatgaatgggggagtactttctcacaggagtatcaactggaaagagtttgcttgtggatggggagcagcccttataaatgtatccgtcacttatccaatcaataaattaatctttagacagatcctccatggcacaaaaatatacccagctttcttacaactacgaagcgaaggtatccactacctctacagagggatccttccaccactatgtcaaaaaacattatccttgtcgataatgttcggagtatacgaggaagtcaaaagacctttgatacagctaggattcaatccgtacggtgctaaagctataggcgcactagtatcaggaacaacagaagtcatactgatgcccttcgaacgagtacaaaccattttagcagattctaaacatcacacagactttaggaacactttacacgtatttagggaattaggcaaattcgggatcagggaatactatcggggattagtgccgatcatacttagaaacgggccttcaaatgtgggcttttttatattacgggaagagatgcaagaacggttcccgaagtaccaaaacgagtttttaaggacatctttagaatttttatgtggtgcaatgattggggtgatactctccacggtgttttatcctttaaacgtattaaaaattagaatgcagagcaaaataggcggctcgttcgagaatccttggagggtactcttagatatttacaacgaaagaggcgggaaagttagatatatttactacggngtgcaggcgaactataccagggcctttattagttgggggggtcatgaatactgccta

SEQ ID NO: 11709 - DNA, 487 bp, Diabrotica virgifera
  misc_feature (154)..(167): n is a, c, g, or t
  misc_feature (169)..(185): n is a, c, g, or t
  misc_feature (439)..(461): n is a, c, g, or t
catctcaggagatgttagttttgttccttttaagtagtttagttttaacaattcctttgcagtcttcctttttgatggattgtacgtcaacatgtttaatatgaagacgagcagtctgattaaataagttttaaggaaataatttaagatactnnnnnnnnnnnnnncnnnnnnnnnnnnnnnnntaggtttattcgatgtgagtcaattttcgattgtttttgcacgtttgaatatttacaaattaattatctgtatttaaatacatattcgacagtgatgtcatggggcaagtgatgtaataattcgtattgaattgtaggtttttctgatcaaacattgaaatttgaattgatatttatatgctaacggtaaatggttatatatagagtaagtattttatatataattaacgagcgcaatgtacggagtgtcgtcnnnnnnnnnnnnnnnnnnnnnnncaaaaatggaatataatatataactt

SEQ ID NO: 11710 - DNA, 658 bp, Diabrotica virgifera
  misc_feature (261)..(278): n is a, c, g, or t
aatggcggacacattgttcgcttgatgtgtgtgagatctactgtaataatttatagaataaaataaaatgtcataatccaccgctctgcccattagtgtagcgtatactatgacaagtccgacgaagaaaaggagtcaaatatttcacttccattattttccaatgctccaatcctacccaatgaaaacaattactgtcacctacatgtttctattaaccatcttcaaccctacagtgatactgacaaagctgtacatcannnnnnnnnnnnnnnnnnagataccgttcttgctgttgctcgtattccccgtgtttatgaggtgttacccaccgattttgttcagggagctttctgtaacatgagttatatgtggatgcatgtttgcaccaaccaatacatgtagtcactggcacatacgagtaaacatcattatacgtctttatgttttatcatcctctgtatctgctaatgttgtgtcagacttaattattgagcataagacatgtcttcgaccaattctctgaattgccattggttgtcagttgacttagtacaatatatatagcaaaacttaacaggctgcccagacattgatgacaatcagggcatgagctgacattcataaggtttataagagtcaacgctcccctgctgac

SEQ ID NO: 11711 - DNA, 627 bp, Diabrotica virgifera
gaatgcggggcatatttcggaacccgggaacgagaaccgtattaattgcgatatcgcgtcgaaagagagaactaccgggtatgcccgaatggcctggataggactccgagagattcttgaaaagttttcttttctgtataatgttccagttcctgcattcctgtagacatagcatgatatggttggtaacgttaagatctccgcacgtgcagctactgtgcgaatgttctcctcgaacgcttgaaaattaggagaggatgacgaaggagtttcggaccgcctcgaaccaatatccgctgctattctctgaggtgaagagtgctctagattatataataatagtctgcaaggagaagttcaccaaattggatccggaacttaaacatattgattgggtctgtagatcagtgatcgtctcacttgcatatgatgaggctcctgtgtgtaggatgtcggggtctagcttgagagtgatacgatcctaattcttacgaattgtctatcatgtattcgactaccgactggcgtgttgcactcccgagaaacctccttgatgacttgctctgagttacttgcttgaggttgaatgtactcgtcacaacgccattcaacggacactgtcagaac

SEQ ID NO: 11712 - DNA, 150 bp, Diabrotica virgifera
  misc_feature (13)..(148): n is a, c, g, or t
gttaaaaagctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnat

SEQ ID NO: 11713 - DNA, 1034 bp, Diabrotica virgifera
  misc_feature (67)..(85): n is a, c, g, or t
  misc_feature (138)..(161): n is a, c, g, or t
  misc_feature (194)..(229): n is a, c, g, or t
  misc_feature (232)..(244): n is a, c, g, or t
  misc_feature (246)..(283): n is a, c, g, or t
  misc_feature (290)..(380): n is a, c, g, or t
  misc_feature (386)..(399): n is a, c, g, or t
  misc_feature (401)..(486): n is a, c, g, or t
  misc_feature (502)..(533): n is a, c, g, or t
  misc_feature (538)..(576): n is a, c, g, or t
  misc_feature (583)..(604): n is a, c, g, or t
  misc_feature (606)..(652): n is a, c, g, or t
  misc_feature (677)..(704): n is a, c, g, or t
  misc_feature (723)..(745): n is a, c, g, or t
  misc_feature (812)..(834): n is a, c, g, or t
  misc_feature (837)..(876): n is a, c, g, or t
  misc_feature (884)..(916): n is a, c, g, or t
  misc_feature (936)..(952): n is a, c, g, or t
  misc_feature (954)..(993): n is a, c, g, or t
agggaaagaggggacgcgtgcgggaacggggggggaattccggccctttaaaggcgcgggattaatnnnnnnnnnnnnnnnnnnnctttagaaaaagtaaagaaagattgtatttagagatagataattagaatgggnnnnnnnnnnnnnnnnnnnnnnnnggaaaaagttatgtttgtggacgttgggtatannnnnnnnnnnnnnnnnnnnnnnnnnnnnnnnnnnngcnnnnnnnnnnnnngnnnnnnnnnnnnnnnnnnnnnnnnnnnnnnnnnnnnnngataagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaggnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnngtatattaaaatatgnnnnnnnnnnnnnnnnnnnnnnnnnnnnnnnngttcnnnnnnnnnnnnnnnnnnnnnnnnnnnnnnnnnnnnnnngatttgnnnnnnnnnnnnnnnnnnnnnngnnnnnnnnnnnnnnnnnnnnnnnnnnnnnnnnnnnnnnnnnnnnnnnagggaacttttttttcccctgaaannnnnnnnnnnnnnnnnnnnnnnnnnnngataaaagggtcgcttggnnnnnnnnnnnnnnnnnnnnnnnagggattttgaccgtggtaaggaaaaataatcatttagattttttattgaaaagctgggatgaaagnnnnnnnnnnnnnnnnnnnnnnntcnnnnnnnnnnnnnnnnnnnnnnnnnnnnnnnnnnnnnnnngtaaaaannnnnnnnnnnnnnnnnnnnnnnnnnnnnnnnngcttatttcagttttttacnnnnnnnnnnnnnnnnncnnnnnnnnnnnnnnnnnnnnnnnnnnnnnnnnnnnnnnnnaatttatacttttttttggggaaatttgggggggggggggg

SEQ ID NO: 11714 - DNA, 891 bp, Diabrotica virgifera
ggcgctgtttaagaacgccaaggaaaggatcgtgagtttaacagaacagaacaacaacttgaaggaagaagttaatagaccgggaagatcagacggagctgaaaaggaaagcgaagactctgctaaagttgatgaattgctcgagaaaatagctttgctggaaagagagagggacgatattcttgaagaaaaacaacaggaacaagataagcatacaacagaagttgaaagtcttaaccaaaggatatcgcagttgcagaggcaattgggccttcaacaaggatcaaaacctagcactagttcaagtaccactgaaaagtcttccactgaacggccaactgctgatattaaaccaatggcaggtcactctacaaatactcaaacacaatctgttcctatacaaccatggcgaagtggtggggaacctcctttagcaagtattagaccaatgtctgcacaactacgcactggtgttgtgttaccaactagtcagagtccaagcgcagttatggtaccaccacagcaacaggtgcacacaacaggatccagttcaatcgaagccctttctagcagccccactagctctcacacagaatacgttcctgccactagttctgctagtcctgcaatgttgggtcctcgccaagtcgccgtacctcccacccaatcgtctcaagatacagaagatgacgagagtagtatgcaggtccaggcagctccacaaacccaagccgttgctcttgtactaccaagagttgaaccacctagcagtggaccaactcaggaacagggtacgagcagtagcagctcgaacactgtgacgacgacacaggctgggcataaaagacagcgagaagctgatatggatagtagtcaatccgatgagcaaaa

SEQ ID NO: 11715 - DNA, 843 bp, Diabrotica virgifera
  misc_feature (39)..(56): n is a, c, g, or t
  misc_feature (124)..(141): n is a, c, g, or t
  misc_feature (150)..(175): n is a, c, g, or t
  misc_feature (222)..(262): n is a, c, g, or t
  misc_feature (345)..(365): n is a, c, g, or t
  misc_feature (492)..(509): n is a, c, g, or t
  misc_feature (605)..(624): n is a, c, g, or t
  misc_feature (634)..(670): n is a, c, g, or t
  misc_feature (771)..(827): n is a, c, g, or t
aaaagaacaaagaaaaaaaagtggacagaaggaaagagnnnnnnnnnnnnnnnnnnccggaaaaggaacacagaacaccaaaaaacaagcacggcaggaaacacaacagcagaaaaaacaacannnnnnnnnnnnnnnnnncagacaacnnnnnnnnnnnnnnnnnnnnnnnnnnaagagcaaacaaccaacaagaaaaaaaagaaaggcgagcagaggcgnnnnnnnnnnnnnnnnnnnnnnnnnnnnnnnnnnnnnnnnnggaacaacaagacccagaatagcacaacaaacgaacacaaaccagcaggaagaaagacgacacgaacgcccgaacaaccaccnnnnnnnnnnnnnnnnnnnnngcaccacaaaaagagaaacgaagagaacaccagaaaccaaaaaaacgacacacagaacaaaaagacagagcaaagaaaagaaaaccgcaacacgacaaccccccggagagacaaaaaccagaacccnnnnnnnnnnnnnnnnnncccgcccgcccacggaccaagaagaaagcccgcgggagcgggaacgagccaaagcacaaaaccaaaaagccccaaaacgcaaaccgcaaaggaggnnnnnnnnnnnnnnnnnnnnccaacacccnnnnnnnnnnnnnnnnnnnnnnnnnnnnnnnnnnnnnaagcccgaaaaaaaaccaaaacaaccaaaagagaccaaaacacaaaaaccaacactcacaaccaacacaactaaaaaagaaaaaaacccaaccgagggggnnnnnnnnnnnnnnnnnnnnnnnnnnnnnnnnnnnnnnnnnnnnnnnnnnnnnnnnncaaccaaccccacccc

SEQ ID NO: 11716 - DNA, 788 bp, Diabrotica virgifera
  misc_feature (18)..(54): n is a, c, g, or t
  misc_feature (97)..(117): n is a, c, g, or t
  misc_feature (119)..(195): n is a, c, g, or t
  misc_feature (214)..(253): n is a, c, g, or t
  misc_feature (273)..(298): n is a, c, g, or t
  misc_feature (304)..(353): n is a, c, g, or t
  misc_feature (377)..(453): n is a, c, g, or t
  misc_feature (456)..(470): n is a, c, g, or t
  misc_feature (487)..(519): n is a, c, g, or t
  misc_feature (521)..(547): n is a, c, g, or t
  misc_feature (566)..(586): n is a, c, g, or t
  misc_feature (588)..(608): n is a, c, g, or t
  misc_feature (610)..(635): n is a, c, g, or t
  misc_feature (656)..(688): n is a, c, g, or t
  misc_feature (696)..(718): n is a, c, g, or t
cccactccccccctcccnnnnnnnnnnnnnnnnnnnnnnnnnnnnnnnnnnnnncaacgaaaaattttatttactgatacctaattaggattgtgcnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncagagctaaaaaactaccnnnnnnnnnnnnnnnnnnnnnnnnnnnnnnnnnnnnnnnnaatgaactgttattcgctcnnnnnnnnnnnnnnnnnnnnnnnnnntcaatnnnnnnnnnnnnnnnnnnnnnnnnnnnnnnnnnnnnnnnnnnnnnnnnnnaatattaaacatttttagggatcnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnatatatcattatttccnnnnnnnnnnnnnnnnnnnnnnnnnnnnnnnnncnnnnnnnnnnnnnnnnnnnnnnnnnnncatattagtatcaaacacnnnnnnnnnnnnnnnnnnnnncnnnnnnnnnnnnnnnnnnnnnannnnnnnnnnnnnnnnnnnnnnnnnntaaacatgtcttcttgtatcnnnnnnnnnnnnnnnnnnnnnnnnnnnnnnnnnagaatgtnnnnnnnnnnnnnnnnnnnnnnncgcagcataatcattagtctttttattgacacctggaatgaagggatgcatgaaaaaaactctgtcttta

SEQ ID NO: 11717 - DNA, 595 bp, Diabrotica virgifera
cccccttttcacgcccccgcccacgcgaccggagaagcagcttcccttctgacgggaagtgttgaaaatatgtttagtagcaagagctttgatcgctaatagagtacaattgctgtcctatttgaaaaacagctacctacatttgttaaaagggttgtaaatcgaccaagtgtatgagttgatataatgaaaggacctaatgatcagacagaacaaactactcatatcatattccaggaactggaatcatcctacatacacttacccagaacacgacctggcgaatctaattcactcgcaagaagtaacctgatagataaatccactgcccttaagaatcctacagaaaaacaaatgtccaatacacgaaaatagatggatgctcgctagtggacacaaattctagaccatttcataactaccgaattgcaaaagtactccactaataaacatagaggtagatctgaaagctcttatgaagtcccagcatgtcgaccaaaatccatatcacataaaggtaatgtgcgaccacttctagaccgaaaagatgaactatacaagatgagacacagttgtagcatgcagaatctgctgc

SEQ ID NO: 11718 - DNA, 404 bp, Diabrotica virgifera
cccgccgccgagatggacaatcacgcttgaaatacctctacttacatagacatctttacttactgcacctaagagtaaaacagtgtgagcggaatatgtctggagcgctgaggatgacatcgaaatgacatgataccgtgagctacgtgctctgctcgtttcgatgataagtgacaacttcccgagacgtcctcatgataaatggcttgccttgcaacttctcatgtaaatatccatatgcatcgtattcgacgtacgaattacctacatcctgataccagtctaggaaactgccagacgataaatttgactggatagacacttcagtcatataacatcgaagatgccactgtgatggctaccacagaacagaaacctcccacaaatgaaaaaaacgcgctcga

SEQ ID NO: 11719 - DNA, 728 bp, Diabrotica virgifera
  misc_feature (3)..(23): n is a, c, g, or t
  misc_feature (93)..(113): n is a, c, g, or t
  misc_feature (139)..(162): n is a, c, g, or t
  misc_feature (298)..(317): n is a, c, g, or t
agnnnnnnnnnnnnnnnnnnnnncaatttgatatgaactcaataattgtgaagacagatattctagataaaattctatcaattcacagactgnnnnnnnnnnnnnnnnnnnnncttagattcatgtgtttcttgtttgnnnnnnnnnnnnnnnnnnnnnnnnccactaccatgacatttcttaaccctaaagatctctttctaagcgctttaattctttttcagttggagaatccaatgatgagagatgggaatagatgcaattcagaatggctccatgctttttaaaaaaactaccnnnnnnnnnnnnnnnnnnnngaaagaaagactccgttgtctataatattttattacatttgtattggacatgtaccggctaccgatattcgaatttacctctaaaagagtcatcattaatttttataatcctaattaaaaatatgttacaatgcatttattatatattatgatccttatattttctataatggattcatcatgaaatatatgattttcgatttaaatcacgtattgatgataatattaggatctatgaaattgaatcttgaggacaaatataaaggtacaataaaggaattcggcatcttttgtttccaccgacatcactgccatgtctttccgcatcaaaaagaaaggcccgcctgcccactgatgaatctgaatggccccaggaatcctgaccgggctaaggcagcataatcattcaga

SEQ ID NO: 11720 - DNA, 769 bp, Diabrotica virgifera
  misc_feature (2)..(47): n is a, c, g, or t
  misc_feature (58)..(94): n is a, c, g, or t
  misc_feature (101)..(160): n is a, c, g, or t
  misc_feature (177)..(523): n is a, c, g, or t
  misc_feature (557)..(586): n is a, c, g, or t
  misc_feature (593)..(606): n is a, c, g, or t
  misc_feature (608)..(622): n is a, c, g, or t
  misc_feature (624)..(641): n is a, c, g, or t
  misc_feature (643)..(667): n is a, c, g, or t
  misc_feature (670)..(687): n is a, c, g, or t
  misc_feature (708)..(766): n is a, c, g, or t
gnnnnnnnnnnnnnnnnnnnnnnnnnnnnnnnnnnnnnnnnnnnnnnctgggtatccnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatgaaatggtattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcacctgtccattataaacatgacttgttgnnnnnnnnnnnnnnnnnnnnnnnnnnnnnncttcagnnnnnnnnnnnnnncnnnnnnnnnnnnnnncnnnnnnnnnnnnnnnnnncnnnnnnnnnnnnnnnnnnnnnnnnnagnnnnnnnnnnnnnnnnnnactttattgtctttataaagnnnnnnnnnnnnnnnnnnnnnnnnnnnnnnnnnnnnnnnnnnnnnnnnnnnnnnnnnnnctc

SEQ ID NO: 11721 - DNA, 677 bp, Diabrotica virgifera
cccccacccatacgaccggctcaatatcgaaaaaaatgaactgagaggacatgaaaggcctatgaacgtcaattcactttgaacgcatgtagcctgataactctactactactggacgttcaattaacaaaagtgtagcaaacgactgcttgaccttccaaaaaaaagtataaaaaaaaccaagatatggcatatgactccttcaaacatgccggtttacaccccaaaatttaaggccaatggaaatcatatgactacccttgatattgcttgcttagaaactctaaaagaatacatactatgcaaccatccttgacgcacctgaactcgaatatgcctgtaatgaatatgatcgcagctacgccgctaaattgctctgactgcactcttggctccatctcagactaattgcccattaaaataagtattataaatccacgtctctatcgatatgaccactgctcctcctgatttcaccctgggtgaaaaacaacattataggcgatagtcaacagacatggactcaatctcaaccattcatacaaggattcactattccaatgaatcccaaaatgaaacatccacctacatcaacaaaatcgtctacaacacagctgaccttgattccataccaattacatgatggcaacgacaccacatagcagaaggatcacaca

SEQ ID NO: 11722 - DNA, 687 bp, Diabrotica virgifera
tgcagtgcaccggccgcggtattcccggccctttccacgcgtgcgtttatttacatttatgctttgactcattatatctatgcaaacagatatatatggtatatttgagtatgacttatatagtatacatggctgttgcgcaattgagatgtttaaagatatttactgtatttcttttccctgcatcctatcatcattctgaacttctgttgacatcctcttgaaaattctcttctgcaatttcttctggaattttcatttctaatctattgttatatgcattctcaatttcctacatatcatgtttgtacctttcttagaatatatattttgaagtatatagactttattgatttcccatgggaatttgtttgatatgtctataacaacctgacaatactatatcactgtatctatatcgatatccaagtcctatctattgaacctcaatgctttatggggactaatttctacattgtttattataggtgtaacttattgtctcatatttttcacgtagaggtatataattacatccatacttattggattcaacttataaccttgtataaacaaatgataaagtagccttacctggacttttaacgctcatttttgtacagttatttagacattatatacatgactgaatatgttcactctctttgttacttactctgctataat

SEQ ID NO: 11723 - DNA, 171 bp, Diabrotica virgifera
  misc_feature (4)..(168): n is a, c, g, or t
agcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatc

SEQ ID NO: 11724 - DNA, 791 bp, Diabrotica virgifera
  misc_feature (465)..(486): n is a, c, g, or t
  misc_feature (717)..(717): n is a, c, g, or t
ggttattacaggataatatgtaaatattgtaggtagtaggtacctactattgttttcttgtttacctattgaaacttataaatattcaaaccacttgattttgttctaataaatctcaatgatttcgtttgtggttcttctcttgatttgtgccaagttcggtgtctctcagtctccggctgaagtagtatcagctccaaatcctattaatgtaaaatttacaaaatctatagattttacggtagaaggtgggactaactcgtggaaagatgacttgagaaaatttctttttcaggaaaatgaggctttcaatctaggtaccaaaaaagacaacgaaaatgtttccaacaagtcctcatctggcttacataagtacgaaaacactttaaaaaatatattcgataagtgcaaatatatggttggtaaaagtcaaataccgttttgtctcttaaatccagcacaaannnnnnnnnnnnnnnnnnnnnnttatccaagcagttgcaaagaaattttgaaaagtggtaaaaataagtcagatgtgtacataatcaaacctaaaaccagtaacaagccgtttgccgttttgtgcgatatggaaattaaagggggtggctggactcatattcagaggaggtttgatggatctcaagatttttacctaccttggagagattacaaatttggttttggtaaccttatgggtgaattttggattgngttggaaaatatttacgatatgacagcttttgaaacaagcgaactcctggtagaatttactgatacagacaaaa

SEQ ID NO: 11725 - DNA, 777 bp, Diabrotica virgifera
cctgcatgcaccgaccgcggaattcacgccccgacccacccacgcggccgcgtacatttaaaaatatatcatccatctcgcctgtatgtaattagttatgatatggatatggccacaactgaaggcattgtgttaataaccacgtactcctgtgtacaagctttacagcatgacaaagtgcaagattattgccaaggaccaacggaaacgagccacaccatcatatgtggccttcacaaatacttaaagtgtaatcggacatgctgacaataaacatatacccataaacctcaatgagaaaatgtttgaggtccaacatcaaaaagtgcgaaactattatgacagagattagaacctgacatgaaacattgcacatttgaagatatcctgcggccattaaaacacatattaaggcgctatagataggatataactcactccattctacactaacgaacctacttccatggacaatacaaaaatgaaagataacagcacaatcataattaagaaagaatgcccccaacactgtaatcagcaataccatgcatatatcaatgtgtcacaacccctgtctaccacagatggtgtcacgcattgctggacttcaggtaacacgtattcataaattacaccactgctgctgctcactctgtatgtgatatacaatatggaacatggagatagatgacgatccatcctcgatactctatggtggtacttatgatctgtcaatcttagcaattgcagatggtatcattattacctgatcaactg

SEQ ID NO: 11726 - DNA, 607 bp, Diabrotica virgifera
cccctttttccccccgcgtcgtgttatttacttaatagggcccctttttatatgtcaataaacttatcaagtttagacagtacgattgctgtgttatttcatattttatcttaatacacaatttgactattgtgagatgcgatgtcatctcgtatttttaataagtccgatatatacaccacatatttctcatgctgttctcatgacaaatttatccgtgtatctaacaaaaaaatctgtaattacattttttgagaccctttctattccatatcatgatatcttccagttgtttacgaagctaatgacagttatttatatcgaatatagataaaattacctctttctgacatctgatattaatttctgcctctagggcattagtatatgtaaatgtaaatctcttcgggaatactccctgaaatccaatataactaaacatagactcgctttagtatcttgacaagtaatgaggacaggatgattgatgaccatgataaaagaatattttcaccagcatgttaagaagctactcttgcgcatcatcactattcgatttgtacaatattatcagaacaaaacaactcacgcattttcgacacattat

SEQ ID NO: 11727 - DNA, 901 bp, Diabrotica virgifera
cggacgcgtgggcgaaattagggaacacattcggagcccatcttgaagaaacaccacatggcttgtaccacatacttaaatcgtcaattcagttacgcagtactaccgccgacacttgtgtgtggtcgacacactgtaggagtcggcactgaacgagttagtgaaatatattgtaaattccttattcgcctgaatgattatgtcgttcagtgtcagatacattcatttttttaaattctcagtaaatactatggtcataagccttctgtcattctcataagataatttaatcatacaaaaaattccgattgtatgtctactgttctttctatttctttattagcgattcagtgtaattataatgaactcaagtagttaatttccatggcatctcatttattatactgtgttcttgtatttttgttactatgcaatcttttctactggtcacctatttccctcataaattaattaacattatgtagtctcgtttaaggtaagtgataaacaaaaaatctactgccggaaattgtttcactgtttttaggtgatttggatctggaaccacccaatcataccattagaattgttccatcgataataatttaaagcagtactatacctacctaaatgtagtgctgctacccatcaaaaaaacaagacatgaataaatagaaagatatttattgtacaatatattagttacaaaaatcatcaaacaattatctgccaaaaaacctgaaacattttcatctaacaaccagcatcacaacatagagcctttatttgatgtcacctaaagtcttccatttatgtgatttttttacgaggcatttaaaagggcgatccctttgaagactttagactactctaaaataccattttttttaatgtttttaat

SEQ ID NO: 11728 - DNA, 986 bp, Diabrotica virgifera
  misc_feature (2)..(764): n is a, c, g, or t
  misc_feature (847)..(847): n is a, c, g, or t
  misc_feature (860)..(860): n is a, c, g, or t
  misc_feature (944)..(975): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaattaccttaggaataacagcgtaattttatcggagagttcaaatcgataataaggattgcgacctcgatgttggataaangttataaatggtngtagcagctatattaataagtctggtcgacttttaaattttacttgatctgagtttaaaaccgtggggagccagggtgggtttnnnnnnnnnnnnnnnnnnnnnnnnnnnnnnnnccaaaagggcc

SEQ ID NO: 11729 - DNA, 681 bp, Diabrotica virgifera
  misc_feature (91)..(139): n is a, c, g, or t
cctccccccgcgtccgatatttatcttttccattataataaccttatcttattatcatgatcgagcattattatttatagatattataacnnnnnnnnnnnnnnnnnnnnnnnnnnnnnnnnnnnnnnnnnnnnnnnnncttcctatagtgcttcttgagagtattaatatattgattatatatgaactattttacctactattacatctatttttattgctatcccatcgttacaaatatattatatactatatgtttgtaatgacccggctatcactattaaatctatcgaacttctttgaaactagaatcctatgaatattctaatctcatattgataaatatgattttaatattatccatctaatgtattattagatatgagctttcaaatattatatgatgataatctaattgctgaacccattatgaacataaattctaatcatattttactgcatgatatgtatattctttcatgatactattccttctttatgagtaaaatttgatgctacaccctgacgtcttatccatattattttctcactgaaacgatcatgaatattatttgaacgaatgttcaagattagtagatgggaccatagattgatacctattgcattatattcacctgcacctaaatatcatgccatatggattcttatataaagtgcact

SEQ ID NO: 11730 - DNA, 592 bp, Diabrotica virgifera
  misc_feature (10)..(10): n is a, c, g, or t
  misc_feature (12)..(12): n is a, c, g, or t
  misc_feature (16)..(492): n is a, c, g, or t
  misc_feature (494)..(581): n is a, c, g, or t
cctctcccgngnccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnggctaaggtac

SEQ ID NO: 11731 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11732 - DNA, 70 bp, Diabrotica virgifera
  misc_feature (3)..(3): n is a, c, g, or t
  misc_feature (5)..(6): n is a, c, g, or t
  misc_feature (24)..(24): n is a, c, g, or t
  misc_feature (34)..(34): n is a, c, g, or t
atnannttgatggccgcggtattntgaccgtgcntaggtagcataatcatttagttttttattgaaagct

SEQ ID NO: 11733 - DNA, 576 bp, Diabrotica virgifera
  misc_feature (318)..(356): n is a, c, g, or t
  misc_feature (376)..(393): n is a, c, g, or t
  misc_feature (479)..(501): n is a, c, g, or t
tgatcctgtttgccgaacttgagaaacttgtgcgtcatgtataacatacgaaaaataatttgacatacgtttagcatcctcctttgttcatatgattacaaactgatacaaattcatgcgtgacgtatgtctgtgttgtgatgataacaacccggctcttcattcgggggcattaaaaagtagatctgttttgaaatctcgtgccgcaattggctgggcagaccggtagagacgtagtggggaaagaagtaacgatttgctacgcgataccgcttgccggcttcacttcatcgttctcttatcttcttgtgatagaannnnnnnnnnnnnnnnnnnnnnnnnnnnnnnnnnnnnnnatacatgagattaataatgnnnnnnnnnnnnnnnnnnctttatcaataagaatctagatggctaaatctcatatgattagatatgatattattaagaaagatacataagtattctaatcttgnnnnnnnnnnnnnnnnnnnnnnnattctgacttattcacaactgggagttatagataatattataataaaactactgtatcattgaataaaaatatat

SEQ ID NO: 11734 - DNA, 716 bp, Diabrotica virgifera
gaagattcaccgagatcgtcacctttaacagtacaagaaacttccaaaaaacaaacaaaatctccagaaacgggatacataggtgacaaatctagatctagattgagctggtcacctagtaaaggggaatatatagattttaatgaagacatagacaaattatctccaccaaatgattcaagaactcggcaaagttgggcttgcagcgataggaaaccaaagcctaaacaaacctctacgctggattttaaaagactactcttacaaaaatcaagttccaattctccgaagaagctatcagctgttgaacagctgaagatgtctaaacaacaaattaggccttctcctcaaaaactccaacctgaaatgaatattttggacctcagcgcctctcctcggagcttagtaaacaggaagttcatgcataaccctcctgggtctccgaaccgagagcaaaaacctctaacggaagtcctatctcccaggacccaatggcgctttggcagcccaagaagtgacgttctctcctccccaatcctagaagattgcagagaagacgaaagtccgaacagttcctgtgaaagaaagaagtctcccaagaatcgcagctcgaactctagcacagagtcatctccgaagaatcgcagctctaactcgaatactgagacatctcctaaggcgatgcctcgtcaaacgcattccacgacttataccct

SEQ ID NO: 11735 - DNA, 776 bp, Diabrotica virgifera
  misc_feature (602)..(602): n is a, c, g, or t
aaaccaaaacaaatggtgaaattttactcataataatcctttcgttgtttatgttttaatgtgatacttcgataaataatttaaaatgggtacagatagaaaagtaataagcgtaaaatttaatcaagatcaaggatgttttacatgctgcatggagagtggtataaggatctacaatgtggagccactagttgaaaaggctcattacgatatagaaactgtaggaagtgtttctcaatgtgaaatgctatttcgtacaaatctactagctgtagtctcaggtggatcacgtccaaaatttgctgacaacgtccttttgatctatgatgattttttgaagaaatttatattagatattacatttccatcatcgataagagctgtgcgaatgagaagagataaattagtggtagctcttttaaatcaaatacatgttttttcgtatcccactcctactcagaggttgtttacattagagactagggaaaattatagagggttgtgtgaagtcagtcctttggcttctgctgaaaagcaattattggtttttccaggacacaagattggaagtgtacaattagtcgacctatcctgtacagaanttgggggtgtcaagtgctccagtttggatccaagcccataaaagtgaagtaggatgtttagcctttgaatcacagggtacaagactagccactgcatcctatcagggaactcttatcagagtttgggataccacaaagcaaaacttggtagtggagctgaggcatggatcagat

SEQ ID NO: 11736 - DNA, 918 bp, Diabrotica virgifera
  misc_feature (810)..(810): n is a, c, g, or t
  misc_feature (877)..(878): n is a, c, g, or t
  misc_feature (907)..(907): n is a, c, g, or t
cttctggcaaccacaggtgactcaacattatcatggacctcaccgatttttccgaaactgatgtcaaacgatacgtcaagtaacccattaggaagaccaataacaaaacatgaagactcaattataggttcaatcttgaacgtaggagctctcattggaccgctcatattcaacttcataactcgtcgattcggctataaatacaccttgttaggattggccataccgcatatagtttcatttttggttctagcatttgcaagaaatatttaccttttctacgcagccagatttttggccggactttcactaggagctggatattccttattttccttgtatgtaggagaaatatcagatgattcgaatagaggagggatgattgtaataactaacatattttggtcattaggtaacttcctgcctttagccattggaccatatacttctattatgtctttcaatttgattttaacggtccttccagttttattttttgtactcttctttggcataggagtggaaagtccgtattatttaattcgtcaaaaggaagaggagaaagctgaagaggcccttatgtatttaagaggaaagaacaagaaagatatcacggaagaacttggtaaaataaaaaattttgtagaacacagtaccgaaggtcgtattcaagatatttttactgacaaggttttaagaaaatgcatattgatttgtatcttattgctggctacccaagatttgggaggatattgctccatactttatcatctaacgttgatttttaaagcagctggttcagaaattccngaagatacagctgctttaatagtcggcattggtctatttgcatctagcttttagctccatttttggnntgatactttggacgacgacctttactaantacatcagctt

SEQ ID NO: 11737 - DNA, 753 bp, Diabrotica virgifera
  misc_feature (2)..(713): n is a, c, g, or t
  misc_feature (721)..(742): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagggggnnnnnnnnnnnnnnnnnnnnnntatttaattta

SEQ ID NO: 11738 - DNA, 397 bp, Diabrotica virgifera
  misc_feature (260)..(286): n is a, c, g, or t
gccgaatataatatagatttctttactaactcagtggacgggatgggtaaataaatatcaaaacttagatttctggtggaatagagatgattgtgccttgctggaaagacatgaaggggtttacgaattaaaccaaccgtttctagaatatataaagatggaagtgttaaaattccgtgatctctgaagtaacttctgcaatgtgtaattattctgagggtaaacagatatcttattgaagaaatgcctcgaattccatnnnnnnnnnnnnnnnnnnnnnnnnnnncgtgatttacacaatcaaaagctttggcatagtcagaaaacagtgtcaatatatagattattgtttagtgcatggtaaacgtcatgtaatatagaaaagatggcatcactg

SEQ ID NO: 11739 - DNA, 655 bp, Diabrotica virgifera
attttccaaaacaatgctactgtactgtacaagtgacaggttatattatttaaaacacaataacaaattttaacccttcaatatttataattagtttgattttgatttgtaattgtttaaattataagatatgtagtttttcttttccatattcgttacagatatgtaatcgaaaatttaaattcaaaaaatcatggctggcgaacaagatatgcccaccttcaaatgcgtcttggtcggagatggaggtactggcaaaactacctttgtaaaaagacacatgactggtgaattcgaaaagaaatatgtagcaaccttaggagtagaagttcaccctttagttttccacacaaatagaggacaaattcgttttaacgtatgggacacagcaggccaagaaaagtttggtggtctgcgtgatggatactacatccaaggacaatgtgccataattatgtttgatgttacatctagagtcacttacaaaaatagttccaactggcacagagatcttgttagagtttgtgaaaatatcccaattgtattgtgtggtaacaagttgacatcaaagataggaaagttaacgcaaagagcattgtcttccataggaagaagaaatttacatactatgacatctctgcaaaatccaactaca

SEQ ID NO: 11740 - DNA, 674 bp, Diabrotica virgifera
  misc_feature (18)..(673): n is a, c, g, or t
agttaatgcataggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 11741 - DNA, 647 bp, Diabrotica virgifera
aaatcttgatattttttttaatagatttttgcagagtggtataatgatatcgtcataatgtttgacagaatgaaagacaacattgtcagtgtcaaaatatatttgaaattaaacataatgttcataagtaaatgcgaaaatgtagacaaatagaaagttaaatcatttatcttgtataaaactggccgtgtttgaagaccatgcagacagtcaatatttgaaatctactcttttcagtttttaaacaatccatattgcgttaatcactgagttaggcgtataccactgtaaatggcaacattgcaatgcaattatttcgtcttccacgtcgcaaactgcgtaatggtgtagttggagtccagcgtagttgccacgtttctattttatgtaatactatatgcctaatacaaaaattaacgcacttctataaggtataaatctacttaaattaactgcattcttacactatggaaatttgaaacaaacgtattactttctacttaacatttatggcaaactactataatgtatttattatatcttattctttattgaccgctatcatgtttacaatttttttaaacttttctctatcggctgttgcgcgaaataattctactgttgaaccacaccattgtctaatatta

SEQ ID NO: 11742 - DNA, 832 bp, Diabrotica virgifera
  misc_feature (788)..(788): n is a, c, g, or t
gtaaaaaatgataaaaataacttttaaaatgtgctgaaattctgtataaaatctgctgttacctgtaatgtagataaaaagtaaaataagatcatggaaaaaagtaaaacgttgactttaattagtattttgtcatttaaagaacagaacaacatagaacacaaccgataataatcatcctgcaatatagaagtacatttagaaataaatactctattttaggagttgttaaatacttgtgcatattatgggtatataaaatggggaatttatggacaatgtattgctatccagttctcaactacagcagttgaagtgcttccattataaatattgcttgttattgaaagatttggtattttgaagagatttttcatattgatatgtgaaatgagatgcaatgcaagaaatcttttgttcaaagaatatcagctttacaaatattgcagttgtttagagaaaacattgaaatactttcaactgaacctgcggttatttaatggttatttaatcgaacaagctgtggcagtacatttttaaccaggagaaaatctagtgcaaatatatgtgcgtgtttgtttgttttaaaatgttgccatttaaggcaaatacagtaaaaattccgttaaccgaaatgtcttgacagtttaaataattttgtcaataaaaagtaaattaaacagcaataaaataaggaaattgaacatgtttagactgttttttaaggaaatcttctattttcttttgtgttttcctttgacaacgatgttttgtagctctatctcccncatactatgtcatttgataaaataagaatacaaaaaaaccatgt

SEQ ID NO: 11743 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11744 - DNA, 693 bp, Diabrotica virgifera
  misc_feature (635)..(635): n is a, c, g, or t
caagaaaacaagtttttttcgcttaccatattattatctctttttgtgttataactagaagattcataaaggggggaatctctttgttgttttatgagctgcaaaaatgttttatatggtttttttggttggatgcatggtttttaaggtattcccaaagagccgtttgagagggtgttgtttcaatgaaaacagtcaattttcaagcaggaatagctcaggaagtgttgagttttcgaaaagaacttatagaacagtttttgcttaatattgggttctctagcaacttccgtggttggttaggcaaggggatttccacccccgagacggggtgggagccgcccccgggacaaaggcacgcatcggcatagggtagactttgtttcttgggctattccctacttactgtgaaaatatcacgtaaatcgatatagtaggatggaattcggagccacataccctcattgactgcccatagtatgttgccttctgcgtttattctcacggatttggttttttaacgtttatttagatattagactaactatggtgatatccgatttccaatagtaggtacctagtggcaccacaaaaagatgaaatgacattaatattttttaatgatatcatatgtngtgatatttagctaaaaaagtgtggttgtcttttccataaagcaagcaccatcaatct

SEQ ID NO: 11745 - DNA, 697 bp, Diabrotica virgifera
ataggacagtcggcaagtatttgacaaagatggtgtccaatcatcaacgagactgggaccagtaccttccgttcttcgcaatggcctatagatctgctgttaatgaatcaactggccaaacaccagcaaaagtcctatttggacgtgagatgcgtctaccctgtgatctagagtttggatgtcgacctggagaagatgttgctggtgaggattacgtgaatgaattgcgaagaagaatggacgatatacatgagttggtccgttctaatcttcagatcgctagcgaccgaatgaagaaacgatacgatacccaagccgagaagggatgttttaaggagaacgacaaagtctggctttataatccaaagaagcgaacaggttgttctcccaagttgcagcagttctgggagggtccgtacctcattgtcaagaaaatcaatgacgttatctaccgaataagcaagattcctaggggaaagccgatgatagtccaccataaccggttggcgccgtacgagggagaccacgacgtagatgaagaagtggaagtcaaccaaattcgaggaatacctgaccttacctttgaaagagtcatgagtgcctacggaggtaccggtaaagcaagacatggtgttaccactgaagaaaagcgagattttctcgcacttcccgatgactattcgctggcccataccat

SEQ ID NO: 11746 - DNA, 450 bp, Diabrotica virgifera
  misc_feature (38)..(57): n is a, c, g, or t
  misc_feature (122)..(170): n is a, c, g, or t
  misc_feature (310)..(330): n is a, c, g, or t
agatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 11747 - DNA, 611 bp, Diabrotica virgifera
aatcatccgtagctgtgaatatatattagaacatgaccattattacgactatgctcagtaggattccctgcattacagaatgaatctaaatagatttgcaattgatgcggataactacattatactgaagacatatggtacattgactacgagatattttatctatccctgatgacataaccctgagcaatgctggccttatgcaacccaacatactgtatactgccctaaaacaaaacaatgcgaaagaatatgatatattacttcttgcttctatactagttatgcctgtacttgcgaaccatttcatagatggtatcgcaccaactagtgaacacttcaatgctttgggcgcctcatgggattcatcctctgcctgcattaatggaccgtatcctatgtacttaacgtgctacaacaacaaaagtgactgcaacgagaatccttctgacccaagatactgactgtatgatctcatcagatgcacacatacatgctcaataaacatagactgcgatcccactctacaacatgagagctatgtgtcatctgaatcaccgtacgcaccctcacatactatgaaacgatactctgctgatgtcacaccaaga

SEQ ID NO: 11748 - DNA, 896 bp, Diabrotica virgifera
  misc_feature (636)..(653): n is a, c, g, or t
  misc_feature (836)..(836): n is a, c, g, or t
  misc_feature (855)..(857): n is a, c, g, or t
  misc_feature (881)..(881): n is a, c, g, or t
agatttccaaaatttacgaaaagctttcatcattaagtgtcaacaagggtcctgggcctgatggtataccacctaattttcttaaggaattcagttttgtactatcgcgacctttgtttcatatatttaataaatctttggatgtaggtcagtttccggacttttggaaactttcttatgtcacaccaatatataaatctggtaataaatctaatattagtaattaccgccctatatctattcttagtgttataccaaaggtgtttgagagtattataactgatttcctcaccttcgatagctccgggatcctaaactctcagcaatttggttttactacaggcaagtctgctgaactgagtttgttgacctatgttgattttctgtgtgaagccttggaggagggacttcaagttgattcaatttatactgacttttccaaggcctttgacagagtaaatcatgaactcctgattcaaaagcttagctcctatggcataagtggacctttgttgcagtggttacagagttatttaaccgaaagatttcaacaagttcgagtaaaccacttttactcacaaacctttccagttaagtcaggtgtaccacaggggtcccatttgggtccattactcnnnnnnnnnnnnnnnnnngatattaccaactgttttcacgattgtaacgccttgctatttgctgatgacttgaagtgctttaaagttataaaaaatcattatgatgctgccatattgcaatcagaactgaataacctctctgcatggtgttcacttaacggtatgaaccttaatttcatcaaatgtcatgtaattaacttntaacgtactcaccacccannntatatcaactattacattgatggncaatttgctcacact

SEQ ID NO: 11749 - DNA, 796 bp, Diabrotica virgifera
  misc_feature (203)..(233): n is a, c, g, or t
gttgtttgtgctttcatgatgcaacttgtaaattaaaatgacagtgactttgacctttgacagctgcgtcaaaattttgttttgacatacactgtccaacaagttcttttgtcattcttttgttatgttaaattgaagattttttttgtaatgtaaaagatttgtagatattttgtcctgtaaaatcatttcctgttaaaagnnnnnnnnnnnnnnnnnnnnnnnnnnnnnnnccgtaaagttttaaataaatgtttgtgaaagtgtatctatcatctcatttctgtagcctttggaaaaattttaacagaaaactaatgcaactgtatgaaagttttagttcaggagaaaagaaagaatatggcatagaagccaataataaggaaagatgttgtcccaatgtaaccccaaagaggaatcaatgatgattgtccccccgattggtacccgtaagtaagaaagtatccagtaagtacccataggtgaaatagaggatttatttcaaacggcgtccctttttgttaaatagtagaaagatcctctagtcagagcaaacgaagaaaatttgagattactaaggcaagctattccagtttacgaagaaatgtttgcagcagatttaactattggtattagtaaggcatttgatattttagaaaatttcagaaggacgcaaacaagtgctaattgcaacccagctataatggtaattcatgaagggcttgattatgactacgataaagaaatatatgccaatagaaactggaagaaaactttcctgtgcgaatttttactt

SEQ ID NO: 11750 - DNA, 449 bp, Diabrotica virgifera
  misc_feature (15)..(42): n is a, c, g, or t
  misc_feature (76)..(96): n is a, c, g, or t
  misc_feature (379)..(411): n is a, c, g, or t
cccctccccgcggcnnnnnnnnnnnnnnnnnnnnnnnnnnnncctttaagaggtagtagctcttaggctaagtatnnnnnnnnnnnnnnnnnnnnncggcacaccgggaggtcttacggggaacgggggagaatttttcaaagaaggctccgcagagcaaccaaaagggtccagggggggtcccccccctaaagggaagggcgaaaacccccggccgggccgaggaaaaaaaataatttgttggggggtgggttggggaaaccccggttagggggttgcgagaacattttgggccaaatgggggaatcgaaaggataaaggtaaagacagatcccccccctgggggatcaagggggtttgctttcttatttttttcccnnnnnnnnnnnnnnnnnnnnnnnnnnnnnnnnngggaccatgtccttattggggaaaaagatgacccccca

SEQ ID NO: 11751 - DNA, 164 bp, Diabrotica virgifera
  misc_feature (2)..(19): n is a, c, g, or t
  misc_feature (32)..(32): n is a, c, g, or t
  misc_feature (37)..(56): n is a, c, g, or t
  misc_feature (63)..(82): n is a, c, g, or t
  misc_feature (145)..(145): n is a, c, g, or t
cnnnnnnnnnnnnnnnnnnttttcacctgttnattannnnnnnnnnnnnnnnnnnntaatatnnnnnnnnnnnnnnnnnnnnataattgaatggggcgcgtattttgacgtgctaggtagcatatcatagtttttttttatgaangctggaatgagggtggatg

SEQ ID NO: 11752 - DNA, 184 bp, Diabrotica virgifera
agggattactgatacaagcgaacccacatgaactcgcttatgtttgtcgctgtgctcctgtgaggtgctgtcgtcccgcaagccaaaaaagaagactccagcagctcgtccgtggaaaatgacttagtaagaccacaatgatagtacgaacatgtcaacaccacccttcttcttgatggtatca

SEQ ID NO: 11753 - DNA, 294 bp, Diabrotica virgifera
  misc_feature (15)..(36): n is a, c, g, or t
  misc_feature (45)..(75): n is a, c, g, or t
  misc_feature (81)..(103): n is a, c, g, or t
ccttcaaggcgtccnnnnnnnnnnnnnnnnnnnnnnttatccttnnnnnnnnnnnnnnnnnnnnnnnnnnnnnnntcgtannnnnnnnnnnnnnnnnnnnnnngatagaaaccaacctgagctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggaaatttattcttat

SEQ ID NO: 11754 - DNA, 830 bp, Diabrotica virgifera
gcaaaccagtcaatgagatcttgtcgtcaggaagcgcggaagggcggacggttaatgcagacaaacgcaaaggtttactgtatgtgtatcaaagtgatgactctttaatgcacttttgttggcaagacagaactacaggcattgttgaggatgatctgattatttttccagatgactgtgaatatgtaaaggttcctcaatgcacaacaggtcgtgcttacttgctaaaattcaagtcatcaaataagaaattctttttctggttacaggaacctaaaactgataaggatgaagataactgtaaaagaattaatgaactactaaataatccatcgagtgctgttcaaaatacaccaaatcctgatcaagatttgcagtctcttctaaataatatgtcccagtcccagctgatgcagctgtttggcagtggagttggccagatcggaggattgtcgagtcttctgggaaccattagaggtccaaatagtggaagcgctcgaactagcacaacacctgctattacacacagaactactgtacctactacccccacaccaacaccagcgaccaactctcaaactagtactacacccgcaccaggaactacaacccctcagaatccaattccaacagttactcctgatgctccaagggtaagaggaagtacgactagaccccaagatgagagttctccttcatcatttccttcttcaagtcctattcagttagcagatttgcagaactttctttcaggtcttactccaccacctggaagcaggagcacctgctggaggggctcaccaggctcaatcagttgatttatctactgc

SEQ ID NO: 11755 - DNA, 775 bp, Diabrotica virgifera
  misc_feature (197)..(219): n is a, c, g, or t
  misc_feature (369)..(381): n is a, c, g, or t
  misc_feature (383)..(395): n is a, c, g, or t
  misc_feature (678)..(678): n is a, c, g, or t
gcatcgcttcgaatttggaaatatgggcgaccgatcaagagataggacgacgagggtgtacgtcggagggctcaccgagtccataaaaaaagaggacctagaaggcgagttcgagaaatacggcaagctaaactctgtttgggtagccttcaaccctccaggtttcgctttcatcgagtttaacaaccataccgatnnnnnnnnnnnnnnnnnnnnnnngaatggtacagaattcctgggtgctaaactcagagttgaaattgcaaggggaagaccacgacgtggaggcccccggggtggttttagaggcagcagaggaagccggggtggaaggttcgaccgtttcgatggtggtcgagtcgaccgctnnnnnnnnnnnnnannnnnnnnnnnnngaggtcgctttggtggtagaagctttgacagaagaagagacttccctccaaggaatggttatggtggcagtggaccaagaggcagcagaggaggtggtcgttttaacgacagattcaggtccagatcaccaaacatgggagcaccaagacgtagggattaaggttttttaaagttatatttgtaggtgttagtgtgtcagtggtttggaaagtccattagtactttttcagtctcattttacgaggctaaattattgtaattttacatcaaatatcaattgtncatgtgaaagcaatattagttttgtaagaactttcgatatcatatcgatacatttttggcagggtaagtgacatttttgggcgaagtcatgtttttc

SEQ ID NO: 11756 - DNA, 746 bp, Diabrotica virgifera
  misc_feature (79)..(96): n is a, c, g, or t
  misc_feature (98)..(117): n is a, c, g, or t
  misc_feature (709)..(730): n is a, c, g, or t
caaaatattgtaaaaaatttaatagagtgcatttaacaaatatattagctagagattaaaaattgaaaatccagaattnnnnnnnnnnnnnnnnnncnnnnnnnnnnnnnnnnnnnncgaaaaaataatctgtaaaaacgaatagctactaatttaaaagttaaataacaaaaatacgtatctaaatacggtatctaatatttttgtttaactggttaatagtattatgtgattaaatattaccgaagcctgaactgcattttactattaccacttaccacagtctattacggtaggggagcccaagcggggatttttgcagttactggagcgcatcagattaccacatggggagaaaccttgtaccctgtaaatgtacctctaccatattggctcttaatacaagggagttcgttgaggggggtccgaaaagaaatctatccttagaaaaactcgaaatcgttagattaagataagttaagtttagtacatgcaaaacagtgtatattaaaaaaaaatctgacgatttgagtggggcgccaggaaatgggcgagtcacaaaatttcacaaaaaagcgaatatttcgcgaaatgaacgtcagatcaaaaaaagaatgtgtgtgtactttgtacgcacgtaagaagatattcttctgttattaatagttaatttaaacgaagtaaatatacttaaaaggttatttgtacnnnnnnnnnnnnnnnnnnnnnnctaactttcttatcta

SEQ ID NO: 11757 - DNA, 812 bp, Diabrotica virgifera
  misc_feature (12)..(30): n is a, c, g, or t
  misc_feature (305)..(330): n is a, c, g, or t
  misc_feature (740)..(740): n is a, c, g, or t
  misc_feature (757)..(774): n is a, c, g, or t
  misc_feature (797)..(797): n is a, c, g, or t
gtaactaacgcnnnnnnnnnnnnnnnnnnngtaaaaaataggtttaaagttgtttattaaaacgtataattccttctgaaatatactatgaaaaattacctttattactgaaatttgtctttttgcaaactatataatatagaaaaataataaattgttgtcaaaatttgcctaattgaggttagcttttgcttttatttgtatttataactttataaacataacttaagcaaaagaaggtaaaatgacggccccaatggaacgaattcaagtactagattctatagaaaaagatataataacgnnnnnnnnnnnnnnnnnnnnnnnnnntgtagagctcggtaaagaaaaatccagtttaaaacaagcagaaaaccacacacagatgttcctcaaaacattaagcgctgtagagaacaaactaaccgaccaaatcaattacttaacccaagtgtctactggacagcctcatgaaggctctggttatgcctcccagaaagtgctacaaatggcttggcatagactggaacacgccagatcccgagtgaacgaattggaaagatacaaaattaaacatatgcaaggaagaactgcacaaagaagtattacagccccagctaatgtaacgtcttcagcttctggtataagtgggcagaatataccaccaggttctgccacatagtgtttagttttagtaattggtgtacatattgtgaatgaagatttttttactatcttangttaagattttaatccnnnnnnnnnnnnnnnnnnggatgtggaaaatataaaattanagaactttttctttt

SEQ ID NO: 11758 - DNA, 515 bp, Diabrotica virgifera
  misc_feature (38)..(57): n is a, c, g, or t
  misc_feature (122)..(170): n is a, c, g, or t
  misc_feature (310)..(330): n is a, c, g, or t
  misc_feature (490)..(507): n is a, c, g, or t
agatattgtacttcatgatacctatcatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatcaaattgaggacatcgtccagcccaaagtggtcatcatccnnnnnnnnnnnnnnnnnncccattat

SEQ ID NO: 11759 - DNA, 127 bp, Diabrotica virgifera
  misc_feature (2)..(58): n is a, c, g, or t
  misc_feature (61)..(117): n is a, c, g, or t
annnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnntagttttttt

SEQ ID NO: 11760 - DNA, 822 bp, Diabrotica virgifera
gtttactactaaagtaattttctttaaattatttgaattctccagtttgattgaaaaatggcagattgggaagaggtcaaacgtttagctgccgattttcagaaagtgcagctgagttctacgactcaaaagttgtctgaaaggaactgtatacaaattatatcatggttgatagatcaaaaaatgttagatctgatatttaccagcgatggcaaggaatatcttacacctgctcagttagtattagatataaagggagaattgtacgatcacagtggtagaataaatttagtagagttagctaaaatcataggagtagatttggcacatattaatgctcacctaaatgatgttttaaaaagcaataaggatatccagtcagtattgggacaacttattgatagctcatatatacagagaatagccggagaaatcaacgagaagctggttcaacaagggcagatcagtattagcgatttaacgattcaatatgaccttcccgctgactttctccagaaccaagtagtagaaaaaaatttaggaaaaatcatatttggaaaacaagacaaaaacgatcccaaagtcttcttcaccgagtcttttattgcccgaacaaaagctaaaatcaagggagctttgacaggcttaactagaccaactccaatatcttctattttaaaccaaattgatatcagtgataagttgtttttctctctatttgatcaaactgttagttacggatctttaactggaaggatggccggtgctcagtatatcccaaatgtttatgccaggtctcagaatgaatgggtcagtcatttc

SEQ ID NO: 11761 - DNA, 840 bp, Diabrotica virgifera
  misc_feature (401)..(428): n is a, c, g, or t
  misc_feature (736)..(749): n is a, c, g, or t
  misc_feature (751)..(765): n is a, c, g, or t
atatgtttagtataaacaaatataactatagcttggaatgggaataactagaaatggggttggtataattgctgatagtgaaatgaaagataacgtagtagaagttgtaagaacgagtgatagttatatatgtttagtataaacaaatatgcaattcaagctggaacatctagtgactattttaagtatataatgaaagtcgttgttttttctttaaatgctaagattgctaaataatcactctatagacaaaaaatactcattacaatcaaatttcgggaaaattttggtctactcgtttttgtttgtcaatatgtatattatataaacgtggacatgtaaaaatattgtattttaaggtttctttaggcattttttaattatgtcgaaataaccaaatnnnnnnnnnnnnnnnnnnnnnnnnnnnnggccaatgattctaatgtagtatgtactaatgtgatattttaccgatgtagactaaaatagttgtttagacgttctcagacattttactctacatcttttacctttttaatttaggattcgtaataaattgacaatattagagttatttattaagaaaagtccttaaaacatttccattggtttaatgttgtttcacggattgtagctacttgtaaactttagttattttaccaaataaatctttgaaacatttaaatttttggaaatatcattgcgtcaaaattattttggtattgtgtgctatttnnnnnnnnnnnnnngnnnnnnnnnnnnnnncctaattaattaaactatacacaatataaaaatgtatcagttcttcttctagaaaagacttgattgttttattat

SEQ ID NO: 11762 - DNA, 1091 bp, Diabrotica virgifera
  misc_feature (2)..(893): n is a, c, g, or t
  misc_feature (898)..(951): n is a, c, g, or t
  misc_feature (962)..(983): n is a, c, g, or t
  misc_feature (993)..(1022): n is a, c, g, or t
  misc_feature (1033)..(1053): n is a, c, g, or t
  misc_feature (1056)..(1069): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnccatttttttnnnnnnnnnnnnnnnnnnnnnncttaaggggnnnnnnnnnnnnnnnnnnnnnnnnnnnnnnggtttaaaacnnnnnnnnnnnnnnnnnnnnntgnnnnnnnnnnnnnngggggtgttgatattaaaaagg

SEQ ID NO: 11763 - DNA, 528 bp, Diabrotica virgifera
  misc_feature (506)..(523): n is a, c, g, or t
atcattatctctactgatgttgattgtattgtccttttcatgatcatccttcagtgcgtaacaaataataggaaaaagggtaagtccgtgataatacaatcattatctctactgatgttgaatgtttttctaagaatgacattagaagtacagaaatagtcaagtgtgagtttaaattttctactaaattaatataactacgttgaacaattatatcgccgtctcactctgtcaattataaatatgtaactgcgtatgtcttggataacgtttttgcttagtagataacactcaataatattcgttattatatattcgttatatctctctcgtttgttatttatagaaaaaggcagcaaatccaaaatatgtgcttgatatgatcgttcatagtggtaaaaaggtttttgaaaatatatatatgatcattcatgggtattctttcatttttccgactgtatgttttgtattaaaccagtaatagttatattgtacagtgactgtgnnnnnnnnnnnnnnnnnncccca

SEQ ID NO: 11764 - DNA, 823 bp, Diabrotica virgifera
gttctacgaacaaacctattagaagacgacgatttcgaatgcctctatcgtagagattactgtgcgctacatacacgaaagcgatataacgttataataatgtttcttccattttgagtcaaaaggttaagatttgctagttttcggatgtttttgctagatttttctaatttttttgtctttttgtgccattaaatggcacctttcaaagtgtgttcttgaaaaacatatgtattttccagctgtatagaaatataatatgcaacctcatcttatatgaaaatcccggtttttgaaaatttatgaaaatttttgaaaacatactgtttgatgatgcagaaagtaaaaaagagtggtaaatccagtaaaaccccagaataacccttgaaaccctggtttttcgcataaacgatgattgtatttgcttctttgaggactaaaactattcttcatattctttgaataggaattagagacgcattgattcaggctataaccgatcctaatataatacatgtatgataatatgattaaccccgcaaaaaccttaaaaaccgtgatatggtttttttaggggttcaaatgtgttttgcccaatttttgaatgtcctaaaggaaccagctactttcaattatatacaacctataaataaaaaagtcttgatttgatctattttgagtctataaatgggacagtgcccaaaaccagttttcgggatcatgaagtggcgcatctgaccgaaaatctgtaaaaatcacactatagctatctccaaaaaaaagtatgcgcccttgtcgaaataaaaatcattttttatgattt

SEQ ID NO: 11765 - DNA, 596 bp, Diabrotica virgifera
  misc_feature (459)..(471): n is a, c, g, or t
  misc_feature (474)..(486): n is a, c, g, or t
tcttttaacacgcgtccgccaatatctaatatagacactctgccttggaaatagcaataatttgtaatgagatacctgatcacataaatgttttaatagtttttctcttccgttcattgaataggtcctagctatctcattgtttatgatttttttgttatccactgttaatacataatacagagtgagttttatgtgtggatgccatcagttgtctcggaaggggcttgcacgatttttatgaaatttggtgggtaagggttttctaatacggaaaagattatagtgctaattacattgttgtcagattctccatttttctgaagatctagtgaactttcttatttcaaagggaacatcctgtatatttttgcgtgttgaagtccttaaaaaatgctgattatttctcatgttatgttctctgtacctagatgccataatttcgaagttattgctacnnnnnnnnnnnnnggnnnnnnnnnnnnnttgtggaaatacatttttttggcctgggtagacattttaggttgtttggatcattgggaacaaaaaggatctttgtggtttttctctgaagttggtcgtttccgagttat

SEQ ID NO: 11766 - DNA, 163 bp, Diabrotica virgifera
  misc_feature (2)..(144): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtaaaatatataggttta

SEQ ID NO: 11767 - DNA, 159 bp, Diabrotica virgifera
  misc_feature (8)..(37): n is a, c, g, or t
  misc_feature (60)..(60): n is a, c, g, or t
  misc_feature (62)..(99): n is a, c, g, or t
  misc_feature (104)..(158): n is a, c, g, or t
taaatatnnnnnnnnnnnnnnnnnnnnnnnnnnnnnnatggccgcgtattttgacgtgcntnnnnnnnnnnnnnnnnnnnnnnnnnnnnnnnnnnnnnnaatgnnnnnnnnnnnnnnnnnnnnnnnnnnnnnnnnnnnnnnnnnnnnnnnnnnnnnnng

SEQ ID NO: 11768 - DNA, 918 bp, Diabrotica virgifera
gctcataaccagcgtggtgccactaacgtttttttgcaaattttgtctataagtacaattaaagagctattaacttctagttatcaacttctctgagactatcttaagcctgagaaacctataaacagacataataagaatagacaaggtaaggtatggaccgctctgtgcatcgatgtataacgccaatatcaaggacgtcatattggtgaatattcattttgagtgttctagccatctttgtcatgtcacatgcgtgagatcacgcggtaaatagagatatacagaccacctaccgactgctccgtgttacactgttttgcctactatgcctagtctattcttattatgtctatgcccgataaatcccgataatcgcttttttgtacactttttattgttttatctttcaagccaatacaacggtcacatcgacggggcttaatagctcaatgttaatcgatgtttatttgcgagtctatcaatctatgcgttcgatgttttggtagacggtttatgtcatgtcgaataaatcatagacttatatatttacataaactgagcagtctgtagagctgtgtcattcttacaactagtaaagctttgacagtgtctttgaagtgtggagaagtatcgcttctcgatataatgtgctagaaagagacagaacgaacaagcgcaagagatcttgacacggccggtatgctcagtctatgttaatatatacttatatggaataaatgttatatcaaaaatatctgtgataaaatattaaagtaaatgtcatttttatatttctaaatctgattatgtatttgtatcgcacttttatacgaaaatagtaaatatattgggcaaagtagtgaccctataacattatgaattgtgtaaggagccatcgaaaaaatcataattaaa

SEQ ID NO: 11769 - DNA, 891 bp, Diabrotica virgifera
  misc_feature (433)..(574): n is a, c, g, or t
  misc_feature (789)..(790): n is a, c, g, or t
  misc_feature (792)..(792): n is a, c, g, or t
  misc_feature (827)..(846): n is a, c, g, or t
ggtttgttgaaaagtgagtaattctttcgctatatttgattgctacgttctttctagttttctctctggtgattacttaccttaaaattcaaatctaaaactaaatattgacatctacatccatatctaaatctaaatctaaatctatatctgtatctgcgtctgcatctgcattctttccagcatacattaacttattcatacatatctttgtttcagactcaaataaggcatggcagttgcactacaagtcaccttgcccgacctcaatggcgccatcgaagctgggctcgctgtcggcgctgatccctctctggaagactccgtgaagctcccagtagtcaccgggggtgacttggcaactgcgtctagattcgctgcatcttgggcgttttccaccttccaacagagatctgcagaggttttgaaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaacccgagaggcaatgcagcatgcgataacggtgattattgctactaaagcaaattggtggggaatgaatcaccatactggtcagggcacctgccagggatatacgcggaaggtgctgcatacgatttatggagctgagccaacagctgaaatgacgactgctgcacacacgattggtcattggtgcagcaccttgcacgtactctccctggnncngattgcaggggggtagaagggtgggagacccgttnnnnnnnnnnnnnnnnnnnntcaccttgtcgatggatgccagactgagatttacgtcattgccag

SEQ ID NO: 11770 - DNA, 151 bp, Diabrotica virgifera
  misc_feature (9)..(64): n is a, c, g, or t
  misc_feature (68)..(143): n is a, c, g, or t
atggccgcnnnnnnnnnnnnnnnnnnnnnnnnnnnnnnnnnnnnnnnnnnnnnnnnnnnnnnnnatgnnnnnnnnnnnnnnnnnnnnnnnnnnnnnnnnnnnnnnnnnnnnnnnnnnnnnnnnnnnnnnnnnnnnnnnnnnnntttttaaa

SEQ ID NO: 11771 - DNA, 54 bp, Diabrotica virgifera
  misc_feature (6)..(20): n is a, c, g, or t
  misc_feature (23)..(51): n is a, c, g, or t
gctgcnnnnnnnnnnnnnnncgnnnnnnnnnnnnnnnnnnnnnnnnnnnnngaa

SEQ ID NO: 11772 - DNA, 341 bp, Diabrotica virgifera
ataatacaatattttctcagccatcagccaacaggaatcttattttatgacacgtagtaagtcattgtgtgagaatatgtcattatcatactggacatagcctatgtcggaccttttgtagcgaggtatatcagtgcgtaatcataaatgtattattgtcgaatcatcaagaattaacaaattatctattgtcattggatagtaaatagctcacataattgttttgcaatgatacgatatactgtcataaacagatctacatacctccgtgactacgattgaatatattccttaacagtatatcaatagtgaaatatttcactatgatgaccataacatat

SEQ ID NO: 11773 - DNA, 392 bp, Diabrotica virgifera
  misc_feature (24)..(46): n is a, c, g, or t
  misc_feature (92)..(112): n is a, c, g, or t
  misc_feature (231)..(262): n is a, c, g, or t
  misc_feature (292)..(391): n is a, c, g, or t
gaagttgtagaaggattaaattgnnnnnnnnnnnnnnnnnnnnnnncatgacaaaaaattgctcctataattataatcatatataattatannnnnnnnnnnnnnnnnnnnnttattgtaatttgctcattaattagaggaattctaggattaaaccaaattaggcttcgaaaattaatagcctattcttctattaatcatattgcctgaatattggctagtatattaacnnnnnnnnnnnnnnnnnnnnnnnnnnnnnnnntctattctattattctaatttctattatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 11774 - DNA, 169 bp, Diabrotica virgifera
  misc_feature (2)..(164): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggt

SEQ ID NO: 11775 - DNA, 611 bp, Diabrotica virgifera
  misc_feature (150)..(167): n is a, c, g, or t
  misc_feature (172)..(190): n is a, c, g, or t
  misc_feature (318)..(341): n is a, c, g, or t
  misc_feature (391)..(409): n is a, c, g, or t
ggaccgaacaaaaaataatttattggtaatggtaccaaaaaaccttattaactacctacctaaaaaaaataccgggattgggaacccccccacccatccgcgcatgagccccccactgaaacaaagagcaccgtgggccccaaaaattgnnnnnnnnnnnnnnnnnnacctnnnnnnnnnnnnnnnnnnnccacctaacctaaacggggtgggaaaaaaccccccaattaaataatggtttaaataaccattaaaaaaaatggtgattcttgcatcgggcatatccgcaggggtccaaaggaggggccaaaaaatccnnnnnnnnnnnnnnnnnnnnnnnnggatccggcccaaaggcctttatatattaccttattcctttaaaaaaccnnnnnnnnnnnnnnnnnnnccccctcccaaaaaaacattatttttcttcttgggggaaaggttccaaaatttttgcagcacttatctgatgaaacccatttctgggggtaaggaaaaacaaaagggtcccccttggatttatatagggattatactgcaccccaaccccttccaaaacccgggggttcgctccctatccttccccaatcacttctccactg

SEQ ID NO: 11776 - DNA, 755 bp, Diabrotica virgifera
  misc_feature (274)..(292): n is a, c, g, or t
ccttaaacgcgtccgaacaaatgtctgtgactgtgagtgactgaaaacgaaaatgaatgaaaagccctattgaaatattataaaaccaagcataataatatggatataaaacaagaggttaatgaggagacttctaaaacagaaatatactgtaatacgatggatgattcattaatggacacatgtaaaattgaaattaaagcggaggttaagaaagaaagtgtgcacgatgcatttgtttattcagatttacagcaattccctatgaagcttnnnnnnnnnnnnnnnnnnngtaaagttacaccagttgaagaaatacaaaaaaatgataaagataaagcggagggctctccaaccatctgttccacgtctctcttccggactctctaaagacggctgatgccaacgtcgagcacgaacccaaagacgttctgatccgtgtctatggacaaacccacggagaaggcgcattggaggccctcatcaccgaatcagtaatcttcaccttactctctgaacgtaatttaggaccaaaactgcacgggattttccccggaggaagaatcgaacagtacatcgatgccaggcctcttttaaccaaagagttgtcagacgaacgactgtcggtatcaattgccaaaaaaatggcagctattcattcgatggaggtacctctacacaaagctcccgaatggatctggaacactctcgataggtggttgaacagtttgaagaacatgcaactgaccaacatg

SEQ ID NO: 11777 - DNA, 840 bp, Diabrotica virgifera
  misc_feature (7)..(41): n is a, c, g, or t
  misc_feature (44)..(776): n is a, c, g, or t
  misc_feature (778)..(839): n is a, c, g, or t
ccttcannnnnnnnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnng

SEQ ID NO: 11778 - DNA, 777 bp, Diabrotica virgifera
  misc_feature (537)..(553): n is a, c, g, or t
  misc_feature (651)..(675): n is a, c, g, or t
  misc_feature (689)..(711): n is a, c, g, or t
catgcatccataaataaacactcggtccaaatttaccttttaaaacaagtaaatttaaagtaaatcgttactaaatcatcaaaaaaatggacgctgtcgaaaataatctattgagagtaacgcaagctatcgaaaagcaagttgatgcagtaatagaccaaatagacaatttggacaccaatgacctggaacagctaaaaataaatagaataaaagaactgaagaagctagaagaacagaaaaagatatggttaagtcgtgaccatgggaaatacgaagaattggcagaggagaaaatgtttttcgacctcatcaagaagtctgaaaatgttatcatacatttctatagagattcaaccctcagatgcaaaattgtagacaaacatctaaagattcttgctcccaagcacatcgaaaccaggtttactaaattagatgctgaaaaatgtccgtttttagttgaaaaattgaaagtaaaaacgttacccactattgttcttattcaaaatggtgttatggtagacaagattgtaggtnnnnnnnnnnnnnnnnncacagacgaatttacaacagacattcttgaatggagaatagcccaaaacggtataataaagtatgaaggagacctatcgatacccccagatcatactnnnnnnnnnnnnnnnnnnnnnnnnncaattaggagcagnnnnnnnnnnnnnnnnnnnnnnntagatatagaagagtatggcataatgagggaatctgccaaatccgaaaccagactcaaaaatgata

SEQ ID NO: 11779 - DNA, 621 bp, Diabrotica virgifera
  misc_feature (3)..(23): n is a, c, g, or t
  misc_feature (579)..(595): n is a, c, g, or t
ggnnnnnnnnnnnnnnnnnnnnngggaggaggtggaggagctggagatgacccatggccgttagcaactcctgacatgccccaaatcaagcatctgcaagtgcagtgtgaaaagactcatatgagggttaatattgagtttgataggccgttttatgggatgattttctcgaaagggttctatagtgactcgcattgtgtacatttaaaacctgggactggtcatttaagtgctacttttgaaattttcttaaatagttgtggtatgtcttcgtcagcgaatcataacgcagctagctatggtggaccaactcctagtggaagctatgttgaaaacaccattattatccaatatgatccctatgttcaggaagtgtgggatcaggctagaaaattacgatgtacttggtatgatttctatgaaaaagcagttacattcaagccgttccaagctgacatgttacatgctgtaacagctaactttcttggagacaacttgcagtgctggatgcaaatacaagtcggaaaaggcccgtgggcatctgaagtctcacgaattgtaaagattggccatactatnnnnnnnnnnnnnnnnnttaaagacgatgaaaatatattcaac

SEQ ID NO: 11780 - DNA, 74 bp, Diabrotica virgifera
  misc_feature (9)..(37): n is a, c, g, or t
  misc_feature (43)..(65): n is a, c, g, or t
ttaaatttnnnnnnnnnnnnnnnnnnnnnnnnnnnnnggggtnnnnnnnnnnnnnnnnnnnnnnnccttttttt

SEQ ID NO: 11781 - DNA, 613 bp, Diabrotica virgifera
  misc_feature (2)..(487): n is a, c, g, or t
  misc_feature (489)..(567): n is a, c, g, or t
  misc_feature (569)..(612): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnng

SEQ ID NO: 11782 - DNA, 914 bp, Diabrotica virgifera
  misc_feature (173)..(189): n is a, c, g, or t
  misc_feature (274)..(294): n is a, c, g, or t
  misc_feature (743)..(743): n is a, c, g, or t
  misc_feature (808)..(809): n is a, c, g, or t
  misc_feature (846)..(846): n is a, c, g, or t
  misc_feature (881)..(897): n is a, c, g, or t
  misc_feature (899)..(912): n is a, c, g, or t
cgttggaattgatctagtgaaagacagaacaactagggaacctaacacctctgacgttacctatgggaaatgggcatcctgtagcttgcgtcgttaccaccagagaaatatcaaagagttttactcagacaggagtggaatattttaatacgtatggtggtaatccagtttcnnnnnnnnnnnnnnnnncagtattcgacacgatagaagatgaaaatctaagagaaaatgccgtcgttgttggcgaatatttactggataactgtcagttatnnnnnnnnnnnnnnnnnnnnntaggtaacgtcagaggtgttggtcttttcgttggaattgatctagtgaaagacagaacaactagggaacctaacacggagtgtgccaaatttgtattacaaaggatgagggaagaacatattctcatcagtctcgatggacctcacggcaacatcattaagttcaagcccccaatggtcttcaccaaagaaaatgtcgatgaagtagtttctacgttagacagagtattcaaagaatggagacaccaagaagaattatatgatgttaacacccacaaaccatcgatacatgttggagaaagtacaaaaactacaaaggaacacagacctatgggatccttattcaaggattcgaatattaagtctatttaaaacgttaagttacaataatttaaatcaaattaacattcaaaaatagatacttcatttatttacaacatccattcacantattaggcaaatttaagtcttagcactaaatgataaatttagattctaattttgaaatattaaanntatgatggatgtctaatagtatttaatttatgtttangataattgtataaaaattgtagtatttaacattannnnnnnnnnnnnnnnngnnnnnnnnnnnnnnca

SEQ ID NO: 11783 - DNA, 791 bp, Diabrotica virgifera
attttacaatattgaatacatttgttaattatacatgttaagtttttgagaaagtgtagtttaggtgtgtaccatattgaaaggttatgttatgatctgatagtattttggtattagtcaaaaaaacattaataaacaatggtgaaaatatattgtctcagtgttttatacaaaggaccaacaactgcaacctggttgaaatcagccttcgaacttcaaagcttcagctttttccaaagagggtcaattcaggagttcatgtcattcttttgcaaaaccatagtggaaagaacaataccagcctcaaggcagagtgttaaagaaggagaatatttgtgtcatgtatatgtacgagctgataacttagctggtgttatcataactgatcatgaatacccatcaagggtttctcacacactaataacaaaaatactagacgaatttggtgccaaaattcctgcagctaactggcccagccttgaggagagagatgtaccatttccacaattaaatacctacttagcgaaatatcaaaatcctagagaagcagatgctattacaaaaattcaagaagatcttgatgaaacgaagattattttgcataataccatacaagcagttttggaacgaggcgagaaactagacgacttagtgagcaagtcggaaggtttaagcatacagtccaaggcattctacaagacagcgagaaaaacgaatagttgttgtagttttacatagataggcgtatatactcattcccaataattaaatgtaacgtttgtatttatttt

SEQ ID NO: 11784 - DNA, 434 bp, Diabrotica virgifera
  misc_feature (40)..(60): n is a, c, g, or t
  misc_feature (209)..(232): n is a, c, g, or t
ttcctcgaatgaaaggtaaaagattgtgagagccccgttnnnnnnnnnnnnnnnnnnnnntgtcagacctagcgggttgggccgatgaacagtaaacacatctctgttatcagacaaagccaaggaggccagaataaaattattattgtaaaattaccatttgctgaaatttctttgaaatgaaatgaaattcatttatcacaatatcnnnnnnnnnnnnnnnnnnnnnnnntccattgatcaacaacccctatctgattgaacagtcgtatatcattaatactacatatattaagggatgagcttatacagaaaatattacgaaaatattaccccaccataagaaaaaagatcaaaaattgtcccatttggagataggtaaccatttatctttctatattattatgattatgtggtcaacctgatgtataaaa

SEQ ID NO: 11785 - DNA, 398 bp, Diabrotica virgifera
  misc_feature (2)..(226): n is a, c, g, or t
  misc_feature (230)..(261): n is a, c, g, or t
  misc_feature (264)..(265): n is a, c, g, or t
  misc_feature (281)..(283): n is a, c, g, or t
  misc_feature (293)..(390): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgnnnnnnnnnnnnnnnnnnnnnnnnnnnnnnnnttnnataagaatttattttnnnagtaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggggtg

SEQ ID NO: 11786 - DNA, 829 bp, Diabrotica virgifera
  misc_feature (41)..(70): n is a, c, g, or t
  misc_feature (567)..(595): n is a, c, g, or t
ccttacccgcggccgaagaaaaactgataagttttgaaccnnnnnnnnnnnnnnnnnnnnnnnnnnnnnnccatacgtattacacatacagccaaataccataaatttttatggttcaagtaaaatggctaatttaccagaacagttggagaatttaaaagaactgagaattcaggaaaatattgtcaaatggcaagctgcagatgatcctttagcacccttatccagcgaacaattggaggtgatttatgaattaggagatcttatatccaacaaatccaagaaggttccagaagtagtaaaacaggataaaaatcaacctgaaactatacatacaataaaggactttgtaaagtggtcaacatcagttgaaaacaacattaaacatgaaaacctaaagaagtatcaagattattatgaacagttgtctgcatataagtctaatgctgaagatcttcttaatctgtctaataatgtactagattatctcaatgacttaaagtcgaattatgttagtgttacagaaaggacgaactatttgcatgaccttagtgaacaattaatggnnnnnnnnnnnnnnnnnnnnnnnnnnnnncaagacttaagtaacaaattaaagtattttgttaatttcaccaagtgtcaggaagaagttgagagaatgagaagtaaaatgaattctgaggaatgtattaaaattttagatgaaatcgatgagagtataacttgcctcaataatcatttacattataaggaatctagaatatacaaaatgaaatatgaaagctaattgataatcttcttaataaaatatatgactatgttaata

SEQ ID NO: 11787 - DNA, 652 bp, Diabrotica virgifera
  misc_feature (133)..(150): n is a, c, g, or t
gcgcaacgcacgtcaagcaagagtccctatactgggattattagaccggcggaatcgaaattaaatgcttttggataaggttctaaaaaaacttattgtgctttgaaattattcatttaaaaatgaataaccnnnnnnnnnnnnnnnnnnccgcgattaaacaacataggatataatggacctttactcacaaaacctaattttccgttggctataaaaagtggaccgaaaagtttaaaatatacagaacttgtaaatttccttacaaatgagataaaaactttagaggatatagatgaagaatttaatgctattacttcaccagaagatgctgtaacttttatcatggaagtcacatcattcttaaaagaattaaattgtccttataaatctcttctacaaggacatgtatctgaaacattacaaaatgtatctgatacattattgctgcttgattatctgatgaccgaactaatgtgggcccgtattttacaagaaaaaagacctaataaaaaaattgaactcaaacttcactaaactacagaaggtaaagacatgaggttgattcttcaaactcttcagtttcctaagccaccggctaatatatctattcgaacattgttccaaaaattggtacctaccattccaattg

SEQ ID NO: 11788 - DNA, 544 bp, Diabrotica virgifera
gacatataagcgattaaaaatttaaacattgcgaaatcggccatttttaatcctcaaaaactatatgaaaaactgaaaatttgaatgttgccaaggtaggtagacattctttaaacatcgattgatgaaactccggagagttttttgcaatacaatattccaaactcctttgttttttaattgctaatcaagcgtgcgcgactaatctaataagttctgtggccttaacgaaggccaacagtttttctattggtacttttatggcctagccatacacctagcacagtgcaatggcacagtatatgtatgacagtctcttcttccattttgcactttctgccccatggttcattcaccttacatagtttgtataggtgatttcttaaacggcaatgtatagtcaccatttcagtgaccgttttgatctctcgtttattttgaggttcattcaactgtccgagagttttttatcaatattgctgattattttcctagtctggatttgcccttgagttgctctccatttcttttgatgaatctttat

SEQ ID NO: 11789 - DNA, 709 bp, Diabrotica virgifera
  misc_feature (548)..(565): n is a, c, g, or t
  misc_feature (608)..(608): n is a, c, g, or t
  misc_feature (651)..(651): n is a, c, g, or t
tgaagcatttatgaaagttacgctagtaataatataaagatactattatttaaacattacagtcattcctgcaggatacagaacaatgtagctcagttttagacggtgttttctcgccaaaatgctataaaataactgccaaaagtaaaggcggaagtgaatacatcgctagaggttgtatggcaactggccttggtggtggctgcagcgctatggctaaaacactaagttggttctcctctgcggtttcaagtgacgatccagatagcctccaagtcttgggctgtgaaacttgtgaaacagataaatgcaattcggccacaaaactcactggatttgctttcatcggcctcgtattgtctgcaatggctttcttaatgtaaatgcaaagctcgctggagttattttatgtaactcaaataaatttaggctacgatgcttgttcaatcggaacacatctttggtcagaagaaaacattattggtctagaaatatatatgtatctagaaataattgaaacaaagctaaaatcaatatcaataaacgannnnnnnnnnnnnnnnnnctcaccagtcttcccaggtacactgcgtcgttggttcctaggncgagctttccacgtcctctctgacgtcatcttcagcgcttccnggggtctcagtcacctgaggctccagatactacactcactacaatactgaccaaaaat

SEQ ID NO: 11790 - DNA, 65 bp, Diabrotica virgifera
  misc_feature (8)..(64): n is a, c, g, or t
gtaaaagnnnnnnnnnnnnnnnnnnnnnnnnnnnnnnnnnnnnnnnnnnnnnnnnnnnnnnnnng

SEQ ID NO: 11791 - DNA, 922 bp, Diabrotica virgifera
  misc_feature (2)..(24): n is a, c, g, or t
  misc_feature (33)..(724): n is a, c, g, or t
  misc_feature (731)..(768): n is a, c, g, or t
  misc_feature (781)..(781): n is a, c, g, or t
  misc_feature (788)..(801): n is a, c, g, or t
  misc_feature (804)..(826): n is a, c, g, or t
  misc_feature (828)..(828): n is a, c, g, or t
  misc_feature (834)..(855): n is a, c, g, or t
  misc_feature (885)..(916): n is a, c, g, or t
cnnnnnnnnnnnnnnnnnnnnnnngctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatngtggatnnnnnnnnnnnnnnggnnnnnnnnnnnnnnnnnnnnnnntngtcgannnnnnnnnnnnnnnnnnnnnnagtttaacccggtgtgagccaggttggttnnnnnnnnnnnnnnnnnnnnnnnnnnnnnnnngaaggg

SEQ ID NO: 11792 - DNA, 843 bp, Diabrotica virgifera
  misc_feature (7)..(29): n is a, c, g, or t
  misc_feature (781)..(801): n is a, c, g, or t
cctatannnnnnnnnnnnnnnnnnnnnnnataatgcatcgctataatgcccgaacatagataaaaaagtaataattgattcctttttaaacatattctagtgtcctgaaactactataaaagtatataaatatcattttgtagtagtttcatgaacattcattaagtattatgtaagaaatgacattttaattctggtattttcaatgattttaatgtatattctattttctacttcataaattttagaaactctagatttattcaatattatttttatgcatttttctttatttcctgagcatgtttgtattgaattatctgagatccgtggagccgtagtcttactcggtcgagctgactggcatgtataacgaaaccgtatttaactttttaagccatacctagaaactggctttttaattatagtgccatattgtttaaaacatattatattattaccgtttggctttttgtattcgtatgaaaacttatgttttgaacatattgttttacatattatgtttgaacataattgttatgaacatattttcataaacctttttaaggaataccagtgaaaatgaaaacatctcaaactcgcttcatctttttattgtacatagtcaactatattttgtatatagaagtgttgaatgtgaatttattaacggagggacccaaatgcattttttaaatgaacaatataaatgtggcattcgtgtttgaaagagaagaagactacgttgactataaagtagtcaaaaatgcactgagtgaannnnnnnnnnnnnnnnnnnnngtaatattgtgatagtatttatgagtaaaaattattcgtgat

SEQ ID NO: 11793 - DNA, 835 bp, Diabrotica virgifera
  misc_feature (746)..(746): n is a, c, g, or t
caaatttccgaaaacaatctgatttgtgaacaatgttttatttgattgctaacaaatttaagtttactgcaaatgaattgaggattaaaccgatgtgtttttcttaattttctcacatgttttgtacctacatgtttcgttgcaagtggcaaacttgcttttgctgtcttcattaatttgatatgacgttagaggatcctttttttgtcgttaaagagtaagcaaaaaagaaacgttgcatgctcattttatagttgtaaataaagtttgaaccacatttgttttgcaaaagcaaattaatgcatgaggagtgtatagcgaggttttcaaagccttaaacaaaacacgaggtttgtttcttcgatggagtgagctacaagaagatggtatctgttgtacaaaggatgaagtcgaatggaccaacacagaattaaaaaactctttgagaagcatagagtgggatttagaagatttggaagacaccattgatatagtcgaaaaaaatccatccaaatttaaaatagacaataaagaattaaccaccaggaaacattttattgattcgactaaaaacgaagttaagtacatgaaagaaagcatcaacatgagcaggagtcgtagtaaagatcgttctgcacgtcagccactcttggagagcagtcctgtaagaattgccagtgctcgcgttacaactaaatactctaaacttgaaaatgattttgatagtccccaaagacaatttctanatgatacacttagccaacaacaatatttaactagacaacaagatgaacatttggaagctattagtgattctttaagatctttaaaaacc

SEQ ID NO: 11794 - DNA, 79 bp, Diabrotica virgifera
  misc_feature (4)..(30): n is a, c, g, or t
  misc_feature (36)..(54): n is a, c, g, or t
  misc_feature (66)..(66): n is a, c, g, or t
tggnnnnnnnnnnnnnnnnnnnnnnnnnnnattatnnnnnnnnnnnnnnnnnnngtaaaaagcttnaattttttttaaa

SEQ ID NO: 11795 - DNA, 245 bp, Diabrotica virgifera
aaactagtgtgatttaatgaattacctaatcacatgtttaccaataaaaatcacttaagtagataactagtgacacagttaatagtactaattaagattttctaattgtaaatataatattatgggtaggttgtacctctattgatgtgcattttgtaaagattattttcttaaaaacaaataaagtagcagctttcatatattttgtatggtttaaatgtaaataccttgataaaagtatttcg

SEQ ID NO: 11796 - DNA, 669 bp, Diabrotica virgifera
  misc_feature (147)..(165): n is a, c, g, or t
  misc_feature (624)..(624): n is a, c, g, or t
aattttacaaagaaattcaatatatttgatgtttgatcaaaatgattacacctaggttccagctaacgcaagatgataaatccctgacgatacaaatcagagccccttattgttccttacgagaattacaagtggaaatagaagacnnnnnnnnnnnnnnnnnnngcaaaccttacttcttaagattattcctgccaggtaaattattggataacgacaattacaaaagctctttcgaatgtgattcaggcgaattttcgtttacatatgacaaggctgtgcaaggagagcatttcgaagacctcgactttataacaaagtttcttgtgagtaaagtagaaactagttacgaaaataacaaaaagatactggttatcgataatgaagcaaaattagataacgatgaagaattatcccaaggatttggttttgctttgatgggacataaaaattttgtagtggttagttctgagttcagtgatgtttttgaaatagatcctaatgaagtcaatttgaaagacaggcggaagctgaggttacaatttgaacaaggtaaatttgacatgggtcattacttagcagattttatagaaaacgaagaaattctaagcctaatcgaattanagtctccttggaatgcgctagaagacagtgatattacttttgata

SEQ ID NO: 11797 - DNA, 717 bp, Diabrotica virgifera
  misc_feature (2)..(516): n is a, c, g, or t
  misc_feature (523)..(560): n is a, c, g, or t
  misc_feature (580)..(593): n is a, c, g, or t
  misc_feature (596)..(618): n is a, c, g, or t
  misc_feature (626)..(648): n is a, c, g, or t
  misc_feature (678)..(709): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggag

SEQ ID NO: 11798 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (142)..(142): n is a, c, g, or t
  misc_feature (167)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaccnggtgtgagccaggttggtttctatnnnnnnnnnnnnnnnnnnnnnnnnnnnngaaagg

SEQ ID NO: 11799 - DNA, 848 bp, Diabrotica virgifera
  misc_feature (677)..(693): n is a, c, g, or t
  misc_feature (695)..(734): n is a, c, g, or t
  misc_feature (742)..(742): n is a, c, g, or t
  misc_feature (773)..(774): n is a, c, g, or t
  misc_feature (796)..(796): n is a, c, g, or t
  misc_feature (804)..(822): n is a, c, g, or t
  misc_feature (834)..(847): n is a, c, g, or t
gcttttacctgaagttgcgtagaaggaagttacagagcaatatttgcggagtggcagggagggttgcccaagattgctgtgagtggcgaactttgaagggtcatatttcgaaaactttaaatcctaatgacctctaccaaacatcagtttaaagagaatatatgtaagttttttttctgtgaagcggtgtctgtgcctatatccccgtgaacaggagttgtgggacaaagaacaaggtttctttcttttgggtttctttgtgctttttcttttgaatgtatttttgtgaagagggtatctttgacattaaagagttatatttggatggggggtttagccaggaacaatttttatgtagacttgtttgtgccaaaagtgcatggaactcaccctagtgtaacctgtgcccagggactaattcacacgtttctcaaaggcgcgaccctttaaatggtggcgctccgcggttttttcatatatggaggttcattgaccatatgaaataataaaaccccgttaacgttgaagttcctttctatagtacataatcaattgcctatatttcgaatactcactccctcatcgtagactataatacaacgcatagatgcctttccccaccggtacgtttagaatctgtgacactgtatgtaaattttaaacaaccatatacatcnnnnnnnnnnnnnnnnncnnnnnnnnnnnnnnnnnnnnnnnnnnnnnnnnnnnnnnnnctacattntcttactgtatggtataactaataattttannagtatttttgaaaaaagcattnttttttcnnnnnnnnnnnnnnnnnnntttaaaaaccannnnnnnnnnnnnnt

SEQ ID NO: 11800 - DNA, 824 bp, Diabrotica virgifera
  misc_feature (8)..(822): n is a, c, g, or t
ggcttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnag

SEQ ID NO: 11801 - DNA, 1039 bp, Diabrotica virgifera
  misc_feature (121)..(138): n is a, c, g, or t
  misc_feature (789)..(823): n is a, c, g, or t
  misc_feature (838)..(854): n is a, c, g, or t
  misc_feature (856)..(882): n is a, c, g, or t
  misc_feature (891)..(927): n is a, c, g, or t
  misc_feature (938)..(990): n is a, c, g, or t
atggtacatgtactgttaacctcaattttcttcttcttattttcttttaagaatattttaacctcatttttctcaacatttaactagttagttttatctttgatattttatattacaaagnnnnnnnnnnnnnnnnnngatggataagaaaactctattattatcagctgcttccattgcaacatttcttaaaagaaaagttaaccttacaagaaccaatgtgaaatgtgacagtataacgaaaataacctaactgtgcatgcctgtgtactaaaaattgttatcaaataggacatgttctaatttgtataacattttctgttaacagattttgtttcctgttttacattgtgacaaaacttagtataccattttcttatgtcattttatgttatagtctaaaacatacttaatttatagttctgtatcccttttaaggcacactcctttttttcttaatttttgtctgtattatcttattccttatgcttttacttcatttaccccattgctttaacttgttttactctattttcaaaattttcatccatttttgaaagttatttgaactctgatggtctcctaaactgtttagactttcttgaaacagtataagtaaatacttatttgcattatattttattttcctttagtgatatgcatgaatttcttatatctttcgtcaattgttagtcccccacctagctttgactttagttttctttaatattctctttatgagatattttatactgcctttttggctgcaaaaaaaacgtgaaccctttnnnnnnnnnnnnnnnnnnnnnnnnnnnnnnnnnnntcggaaaaaaacccnnnnnnnnnnnnnnnnngnnnnnnnnnnnnnnnnnnnnnnnnnnnctcattaannnnnnnnnnnnnnnnnnnnnnnnnnnnnnnnnnnnncttggcacccnnnnnnnnnnnnnnnnnnnnnnnnnnnnnnnnnnnnnnnnnnnnnnnnnnnnncctcataaaaaacacggttttttcttgttttaaataattactttcaaaa

SEQ ID NO: 11802 - DNA, 803 bp, Diabrotica virgifera
  misc_feature (787)..(787): n is a, c, g, or t
ggcggttattttccaacttaacaccaattatacatacatacacatacagaatttcaattttagcttttttcatttctatttttgtttttaatttgttcaatggttttaaaaatctgttcgttagaacacctaatttaattacccaagactttttagtaattatggattctacctacccatctacttcaaccagtcctacttcaacaaattctcttccaggagcctgccatctttgcagcaaaatatttaaaaatgtggaattacgaaatcgtcatatcaaaagaatacacaaaacagatgttccgcctaggactaacaacaaaatgaatcaaaatcattatttgtcccttatgtgatcaagaaactaattttgaaagtcatgagaaattacgaaaacatctccaggactgccaccaggtgagtattgaactaataacttttgaattttctagcaaacaagaatatgagacatggaaagatatgcagaaaattgagacaagttatgcatgtagtaaaacaaagcgtggaaaggaacataagataatgtactatgattgcaatagaagtgacttacatggatataagcccaactataaaattaggacagagaaagctggtggatcaattagaataaaaggagtgtgtccttccagactggcttgcaaactgagagaccaaggacaagtttctgtcagttattggaaaacgcatgttggacataaagaagaattaagaacaatgcatctgtcaaaagcagaagaaaaaacggttgtagaaaaataatggnctgggtgccacccact

SEQ ID NO: 11803 - DNA, 526 bp, Diabrotica virgifera
  misc_feature (444)..(444): n is a, c, g, or t
attaaaaataggtttgtgccaaaatatgcctacatactttataacatggagaaaaataaatatgtttttgtactcacataaatattattagattttacattgatgccaagtttcgaaggtcaccaactgtatatctataaaaactcacaatataaatgtagaaattatgcatgcacttaaaaagtaatcttctgtttggggcttaatatgtactgtaataaaggttcaaatattttatcatcagcgtagatactaaagaactaaagtagatactgtgaattttatttatgtttaagtacattgttttaattataaaattactttcttctctttgctttcatcttttacaaaattctatacatagaagaaaatgggtcttttgaaatttaacattacttttttaaaattgaaactgattaagagattattttattgagcttttcnaagagaccattcatatatcaaatcggtttagaaaagaattttaaaatttggatatatgcaataaaaatcacacttaaacatg

SEQ ID NO: 11804 - DNA, 643 bp, Diabrotica virgifera
  misc_feature (609)..(609): n is a, c, g, or t
  misc_feature (616)..(616): n is a, c, g, or t
gattgtgtctacgactagtaggaacagtaaaggaatctgcgtcaatgcaaaatgtttaagcaatctgaaattcgctgatgatactactaatagaaacaactaagtaacgtatgtaacaaaagtttttggaaaaaattcattgtctgataatcagtcctaaatactttcgcatttagtcgcctttttttgtaagagtggaaatctaaaaacgataccaggtgaatcgtatttggcgtcagttggattcagaatagctggactacatccgaacgcaatatcgcttttaggggtcttgccccaggatacatccatatcacatagcaccctttcccttatcttttctctaggttacttttgttacttatgtttactcctgttgtctctctctcgaaaatctattttttaacgatttttgttacagcctccagcacttctttaaactaatttcccccccttcctactactgtcctaaaattgtatgctccaaagatacgtacctttgcatacagctccgctctttcttcgttgaacttactgcgtttgaacagtgttctgctgtatcgtttgttccgtagtccacacagctaccacctattgcctttgctaccnttgtcangtatgctctaaatgacccatgtcctgt

SEQ ID NO: 11805 - DNA, 706 bp, Diabrotica virgifera
  misc_feature (466)..(481): n is a, c, g, or t
  misc_feature (483)..(496): n is a, c, g, or t
  misc_feature (641)..(658): n is a, c, g, or t
cctctcctaaggcgtccgcatccttataacaggtaccacctgacatcctgtggattcgttataaggacctctttttaagtaagtttgtgcaaaaaaatcgaactggagtggtttgcctaacgggggcgacgatacagcctggactataaatatcacgatttgaacataatattagtaacatttaatttctagaatcggttgtttgtgtgaatcaacttttactaaatggtatcgggaagagtatactttaaccaacgttggagtctacttttactagtaaatgttgaataaaaatcttcattttatatttataatcaacttttactaaaaccagccgtttgagtcgactcgaattaggaaaagtcaactccaactggataatcaacttgaactgtaacatatacaacatcgacgccaactttaatggaaaggtgaaaattccatgttaagcattttatgttgcccnnnnnnnnnnnnnnnncnnnnnnnnnnnnnncatcaatattaccttttggtaggggagcaaagtatgctaaatgtgcagtcactcgagcgctttggggacctattgggttgtgattattaggtcctaaaaccaaaaaaagttaagtaaaattttccattttagcgggcgcttgccnnnnnnnnnnnnnnnnnnccattttcattaatcgttttttccgaatatagcgccctctatccataa

SEQ ID NO: 11806 - DNA, 740 bp, Diabrotica virgifera
  misc_feature (545)..(545): n is a, c, g, or t
aaaatatcttgtatctatataattccaacatacatttattatgtgcataaataacaaagacccatgtttctcaagcgctacttgcaaatattacatatacattttcactagtgaaattgagagttaatatgggaacagggttgttttgtgtggtgcttttatttgtgacaggttcaggttattgctcaagagaatacggaactgactatgttgaaacaactgagcctccagttactcaaaattattattttagtaaaacaggggagtctttttatgaagcagttcatacatgtctagaaaaatccatgcagctggtttctattgatgacgcaaagaaaaatagggagttagccaatttaatgaaggattcgggtggcgtaaatcggtattggacatccggtaataaaatagcaaaaaatacgttcttctggagtaaaggagagcctattgaatacgccaactggcaccctgatttaccagtatcacaggcaagctctaatcaaaaatgtattaaaattgctaaaagcgaagataaactatactgngagctggcgttctgcaacgagaaaaacctgtatatctgcgaaaaaacgctgaaggtttcccaaagtgactgtgatgatgtagtagaaaatttttggtccaaggggatagtcagtcacattataaatattacatcgctgaggagattataacatatcccaaagctattgacatctgccgatccatgtgcatggagc

SEQ ID NO: 11807 - DNA, 55 bp, Diabrotica virgifera
  misc_feature (6)..(36): n is a, c, g, or t
gcttannnnnnnnnnnnnnnnnnnnnnnnnnnnnnngagtttataaaattattaa

SEQ ID NO: 11808 - DNA, 103 bp, Diabrotica virgifera
  misc_feature (4)..(53): n is a, c, g, or t
  misc_feature (61)..(87): n is a, c, g, or t
gggnnnnnnnnnnnnnnnnnnnnnnnnnnnnnnnnnnnnnnnnnnnnnnnnnngtaaaagnnnnnnnnnnnnnnnnnnnnnnnnnnntatagagtttataaat

SEQ ID NO: 11809 - DNA, 930 bp, Diabrotica virgifera
aaaactcagcctttgccattacatactcaatatcgacgcgagtgaagtgttcacatcagtcctcacagctcatttactgaactactcccaaggatggaatgtgatgatagcatcgtcctgctcacttactcacttgtcgctttgccggcggcaagtgagcgagagtggctgaatgtgaacacgcactcgcgctgcctgtcctttgactttcgtgccaaaaacccgacaattgagggagcgccgtgcaatggcagctgcatgagtagtggcagtgcgagtgatctatttacacactcatcctgcccactttcctgctcagttctctgtccaagtggactgagtgtaaatccggcataagactgagctgctacttaatgtttaaaaacctatttaaaaaggatctgaataatttattcttaatcagatatttaaatttcgatgtcgtagattaaaatgtcgcaacatttaattttagtttgtcatattttcatatagcagaaatgtatctcgtctactaataattggagaataacaagcaagttataagtacagtgaaactccttccagtggaaaaataaattttccgcaataaacaggattttatattaaacaggttccaggttactcaagtttcactgcattagacaaatatagctcagattatatctaacggaggaccctgtaagctattttcagatagtcataaaatatgtgttaaatatttcattttccacttaatataaataggaagtcctttaaagacttacagcaatatttttattacaattttaagcaattttttgtgagtcatttttttccctattccaaaaggacgcttttatgaccaccaaactaaaccgcccaattttttatttgaataaaataaaaccaattccaacatccaaattcttttttttgttaggtggaaaa

SEQ ID NO: 11810 - DNA, 862 bp, Diabrotica virgifera
  misc_feature (192)..(214): n is a, c, g, or t
  misc_feature (584)..(602): n is a, c, g, or t
  misc_feature (711)..(730): n is a, c, g, or t
  misc_feature (762)..(780): n is a, c, g, or t
  misc_feature (809)..(859): n is a, c, g, or t
tctaaggcgtccgctcagggagaaatttaaaaacgcgaccttagcgaagtgaattttgattgaaaaaaagttgtaaaagttgttttgtaaaaaacagttgagtgtaaaaatgtctcttctaccatatttgtttggcgatggaccctacaacagaccatcaaggcttttcgatcaacattttggaatggtttnnnnnnnnnnnnnnnnnnnnnnnccggtgtccagaaatttcctcagatgtcctgctggttacatgagaaactggaggtctgtagcgtcaagaaacgatgatggttccacagtaaatttcggtaaagaccagttctcagccaatctagatgtccagcagttcaaacccgaagaaattactgtgaaagtaacaggagaccgggaggttaccatcgaaggcaaacacgaagaaaaagaggacgaacatggttctgtttatagacactttgtcagaagatatgttttgcccaaaaattatgatatgggtaaaatcgagtccaagctgtcttcagatggtgtccttttcattatggccccccaagttgaggatgaatccaaagaacacaagagtattnnnnnnnnnnnnnnnnnnnagccagttaaagcagtagaaggagaaaaaagagctgttcccgaaaagtaaaatattcaaatattttatttcgtttattcgcatttttgaacttgatcttgttacgttcnnnnnnnnnnnnnnnnnnnntgttttgtattgtcattatatttgcagggccnnnnnnnnnnnnnnnnnnngtggaagaaccgaattcatattttcatcnnnnnnnnnnnnnnnnnnnnnnnnnnnnnnnnnnnnnnnnnnnnnnnnnnnaat

SEQ ID NO: 11811 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (134)..(134): n is a, c, g, or t
  misc_feature (161)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagntttaaccggtgtgagcccagttggttnnnnnnnnnnnnnnnnnnnnnnnnnnnnnnnngaaaggacc

SEQ ID NO: 11812 - DNA, 468 bp, Diabrotica virgifera
  misc_feature (267)..(297): n is a, c, g, or t
ccgaccgcgtacgccgtattcattatttgatataattatagcttgtagaactagtatagaaaaacttgattgcatgatgaatcattattattgatgagacaatatgtttatatttgatcttaagttggaatctgatatattgttggaccgttgtcgatcgagccattcatgaataaaccattaattatttattagtatctaacttagaaggatctcgaaattatgatgattactgtaaaatagaaaattaagctaactttttggtgnnnnnnnnnnnnnnnnnnnnnnnnnnnnnnnattttactaaataaattgcttttcttactgaacactacataaagatgtaaatatttttcaattctttatattaaacatttatatggaccatctaaagaatattacctttgcttctgatgctttgtacataattataatgctgacattatctcataatatagtactggatat

SEQ ID NO: 11813 - DNA, 544 bp, Diabrotica virgifera
  misc_feature (31)..(49): n is a, c, g, or t
  misc_feature (64)..(145): n is a, c, g, or t
  misc_feature (163)..(227): n is a, c, g, or t
  misc_feature (234)..(290): n is a, c, g, or t
atattttgaccgggctaaggtaacataatcnnnnnnnnnnnnnnnnnnncctgaaatgaatgannnnnnnnnnnnnnnnnnnnnnnnnnnnnnnnnnnnnnnnnnnnnnnnnnnnnnnnnnnnnnnnnnnnnnnnnnnnnnnnnncataaaaccctataaagnnnnnnnnnnnnnnnnnnnnnnnnnnnnnnnnnnnnnnnnnnnnnnnnnnnnnnnnnnnnnnnnngatagannnnnnnnnnnnnnnnnnnnnnnnnnnnnnnnnnnnnnnnnnnnnnnnnnnnnnnnngaccaattattttgattataataataaattaccttatagataacaacgtaattttattgaagacatcaaatctataataaagattgcaacctcaatgtaggattgagatcataatggtggaataaactatattattaaggcagctccaattttaaaattttacatgaactgatattaaaccacatgagactcaggttagacctctatcgataaattatgaatacaatctataactaaaggatacaatatataac

SEQ ID NO: 11814 - DNA, 572 bp, Diabrotica virgifera
  misc_feature (3)..(27): n is a, c, g, or t
aannnnnnnnnnnnnnnnnnnnnnnnngccactccagcatttgaacaagaaatggttcccccccttaaagcgtgagagcacatttcatctatacggtagcctacttacagattgacgaaaaaagatattgattgaggataaccggaagatcttatccctttgcacgccggaggatcacgtggtgtgctctcacatattatttaatgtctgttattttctagttcaaacaactctcagaacagacctttttgttgtacaacagatacctcaacttctatgatagatcgaacaacggtaacaatatccgagtaaatctaactttctgacactgatgttgactgtatgatattaacaggacgactcatgaaagattttcgttatgttaatatcaaagcatcttccgccttaaaaatgtaactaaaaatatactatcactcatacataataaagagaaaccgtattcaagatgcgtacgtatacttatggatgtctcatcacttagtgtaatgggtgatgatgcgtgcttaaagggggacttacatgtgcatatccgataagatccatttaaaatc

SEQ ID NO: 11815 - DNA, 831 bp, Diabrotica virgifera
  misc_feature (10)..(178): n is a, c, g, or t
gaaataaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctttgctttgacagcttacaagatttctcatagatactggcaaatttaatagaccaagtgaggtataaaaatactttaaaatttaaagtaaatatctcaggtgcaacaaaatcgatccactaaaaatttggtcatttttgaagtttcgaatttcctaaacctgttgttggatttaactgatttttttaccacgttatagccttattcattgacaatatcgctgtaataatattgttgctagacagtcaaactgtcattgtataccgggtgtacgaatcaaactgtgcctttttctcaaagttcgcatcaccctgtggactatcacataaaaggaaagattgagggcaagagaggagtaggtcgcaattgtggtggctgcgaaatataaagaactgacaggcataaataacactggctaacttttgcataccgcataattcagacctttagatgcgttcttgaaaatcttgaaaatttgtacagtgcgaagaatactgaacatcctatgaagattttatagagcccgaagataattggaggtcttagaataatagaagatattgaagaaaaagataattttccagtaaatatgttttataggctcaaaatgatgatgacgtcggatgaccgacggaatattacagatgatg

SEQ ID NO: 11816 - DNA, 907 bp, Diabrotica virgifera
  misc_feature (765)..(765): n is a, c, g, or t
  misc_feature (775)..(775): n is a, c, g, or t
  misc_feature (817)..(818): n is a, c, g, or t
cccacgcgtccgcaacgcataattttgataatgacacttacaaggttaatctaaaggctagttcgcatataagtgcaggtgaacacattacgaccatgtatacgcactgtctttggggtactcaagctagaagggaacatcttagggaaacgaaatattttgattgccagtgtaaacgttgtagtgatcctacggaaatgggatcatacttaagcgcgcttaaatgtattggaaccaacgatgaaccttgtggaggcacccagctacctataaaccccctagacgacaaaacagaatggacgtgtgatcaatgtaccgtcaaaatatccaacgaagaagtaagttttttggtaaacggtataggagaagaggttgacaacgtacagcttgctaatcctacagttagagagctggaagcactgctcaataaaatgctgaccttcctacatcccaaccactaccacgtctatgctgtgaagcactcgttgatacagttgtacgggtaccaacaagggtacactccgacgcaaattactgatgactgtttggttcggaaggctgcaatgtgtagagagctgttggatattactaggaagatagatccaggaaattttaggttagccctttaccacgcagtactcctccacgaactctttctagcaaactggatcaccatcaagcgcaagtgggaccttggaatcaaagccaaagttaagtcggtgctgactacaatgaacgaatgcaagacctgtctcgaccagcttncagaagtgcntaagaacgaaagaacactccagctggagataactaatcattnnagtaacattctacgaagagttaataatttgtcgtaagaacaaattgactatcagggcaattaggaaaatcaattatggatctgattatg

SEQ ID NO: 11817 - DNA, 489 bp, Diabrotica virgifera
  misc_feature (170)..(193): n is a, c, g, or t
  misc_feature (341)..(363): n is a, c, g, or t
atagttttcagtttaatctatactatgattaagatttaaactgtgtgtgttcacatcccctctttgtgaacacacacacagtttaaatcttaatcatagatataaatgaatcacatgttttcagtgtataaagtacttaatgctgaaaatgagaacttgcaatgatgatnnnnnnnnnnnnnnnnnnnnnnnngaactaggaacaacctggttacaacgaattgacatgtttaatgagatttaaagttataatattttatagggataatgaaatgctcgaaacaaaaaatttacatatatatgatcatatgtgacctaattttcatatctgatcaaggtgnnnnnnnnnnnnnnnnnnnnnnnggtcttatataaaaattttataagatgttgttattactaattgagtacgatgagaatttattactattttaaggaaaggcatgagtcttatatacctaataatagcgaaattgttttatatatatt

SEQ ID NO: 11818 - DNA, 184 bp, Diabrotica virgifera
  misc_feature (38)..(70): n is a, c, g, or t
  misc_feature (72)..(104): n is a, c, g, or t
  misc_feature (106)..(126): n is a, c, g, or t
  misc_feature (128)..(168): n is a, c, g, or t
gtttaataaacgaattcggcaacattattttcacctgnnnnnnnnnnnnnnnnnnnnnnnnnnnnnnnnncnnnnnnnnnnnnnnnnnnnnnnnnnnnnnnnnnannnnnnnnnnnnnnnnnnnnncnnnnnnnnnnnnnnnnnnnnnnnnnnnnnnnnnnnnnnnnntatgttggatgataac

SEQ ID NO: 11819 - DNA, 814 bp, Diabrotica virgifera
  misc_feature (2)..(685): n is a, c, g, or t
  misc_feature (689)..(813): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11820 - DNA, 668 bp, Diabrotica virgifera
  misc_feature (2)..(452): n is a, c, g, or t
  misc_feature (459)..(496): n is a, c, g, or t
  misc_feature (531)..(553): n is a, c, g, or t
  misc_feature (561)..(582): n is a, c, g, or t
  misc_feature (612)..(643): n is a, c, g, or t
  misc_feature (650)..(667): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagttttaaccggtgtgagccagggtggttnnnnnnnnnnnnnnnnnnnnnnnnnnnnnnnngaaaggnnnnnnnnnnnnnnnnnnc

SEQ ID NO: 11821 - DNA, 513 bp, Diabrotica virgifera
  misc_feature (366)..(392): n is a, c, g, or t
aaaacatgttgtagatgaaatcaaccccttcaacgaatatctcaaaatgagtaaaaacaaaccagctaaagaaaaatctatacatgcatctaattccgataaggattcactcaaaatacaagaagatacaaaaaaacgaaaaagatattttgacgatcccgatgaaatagtgaaagaagtcatttcaaagagacgctgtagtgtagaaaccaaagaaattgttaaagttgtgaagagctcaaaccttaaagacgaaaaaataactaaatccacagaagaaaagcaatcagttgacgtagtcaatgaaaagaaaatgagagtcgaaaagagattccaggatgacccgcgaagtacataggaaacgcnnnnnnnnnnnnnnnnnnnnnnnnnnnactgacaaaggtgctatgggcgcaaagaggagataatcaacagatggaaattaagtcagtaagagagcgctttaatttaaccctggattataactccaatcattcataacaagagatggtt

SEQ ID NO: 11822 - DNA, 875 bp, Diabrotica virgifera
  misc_feature (35)..(54): n is a, c, g, or t
  misc_feature (220)..(254): n is a, c, g, or t
  misc_feature (781)..(782): n is a, c, g, or t
  misc_feature (794)..(794): n is a, c, g, or t
gaagcgatgatccaaacatgttactgatattcagnnnnnnnnnnnnnnnnnnnntacaggattattttaaagtacattaaaggatgacccaccattatgttgttacggctcataagccaactgcagttacagcctgcgtaacgggtaacttcacatcaccctcagacttgaatctaattgtagcgaaaaatacaagattggagatttatttagtaacacnnnnnnnnnnnnnnnnnnnnnnnnnnnnnnnnnnntacggaaaagtagctgttatgaagttgtttagaccacaaaatgaatgaaagatttgttatttattgtaacattaagatacaatgctatgattttggaatgtgttactgagggtgaaaacatagacattattacaaaagctcatggaaatgttgccgaccgaattggtaaacctcagaaactggaatattggctgtaattgatccaaaagctagagtcattggtctcagactttatgaaggacttttcaaagttattcctttagataaggataactacgagttgaaggcaactaattttaggatggaagagctccaagtatatgatgtagagttcttacatggttgcgtcaacccgacattaatattaatccatcaagatggcaatggccgccatgtgaaaactcgtgaaatatccctcagagagaaagaattcgttaaaatcccatggaggcaagacaatgtcgaaaccgaagcatcaattattatcccagtaccttcccccccttggaggagctattataataggnncagagagtattntgtatcatgatggtatactccctgtttgtgtgggaccacccggtataaaacaagtacaataatatgttatgcaaaagtcga

SEQ ID NO: 11823 - DNA, 67 bp, Diabrotica virgifera
  misc_feature (3)..(66): n is a, c, g, or t
gtnnnnnnnnnnnnnnnnnnnnnnnnnnnnnnnnnnnnnnnnnnnnnnnnnnnnnnnnnnnnnnnna

SEQ ID NO: 11824 - DNA, 217 bp, Diabrotica virgifera
  misc_feature (2)..(154): n is a, c, g, or t
  misc_feature (158)..(215): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnngc

SEQ ID NO: 11825 - DNA, 854 bp, Diabrotica virgifera
gtggcaacattgaaatttaattgttgtcttggtttgttttcgttttctgttttttattgaaagattgaagtaaatgtaaaatatggcagttgagatccaagtaaataaccatccgattttagccatccacagatctatatgcagaatttgtttaaatactacagaacccttgaatttgtggcaagattacgagaatttaaaacagttgtttgaaaaaataactggtataaagattgaaggtgtgaaaggggttgacagatatatttgcacaaagtgtgttggacaacttcaaaatatttatcaatttatagacaaagcaacttataacgatagtttaattaaagacacattgcatttttgtgatattacaccttttgggaatacacaaatagaaatacaccatgatgacagagacagaaacgatcttcatcaatcttctcaaaataataatttgaatggaactgagtcccatatagacttgactgaagatagccttgaagaaataatacagattaaatgtgaaaatgatgatgatattaatgaagtaagatcatctgaagctgatgattgttttatagaggaaaatttcgcaattaatgataccgattctaaactggagtctgcagatgtaaagccttatatgtatcagttttcaaagaaaaccacggacaccaacacagatcatacaatgaccttaagacgtaaaagaaccaaatctaataaactacgtgtaccggactacttacggccgttcgaatgccccatttgttcgcgcaggttcacccagaaggggaacatgcacacccacatgagactccacacgggcgaaatgccgttccaatgtactttttgct

SEQ ID NO: 11826 - DNA, 765 bp, Diabrotica virgifera
caacaatatgtaaagattaactcaccgctgatacaaaatgctgatttatatctcaaagtatttctgtgaaatcgaactatccgtatcaaaggagtgactcgagcttacttataaaagaaatgagttgattgcgctgttagtatgtctttttacgataatcaagcaactagttatccaggcggtacttttacgtcagccgaaaattttttcaccggatcgcaaagtggccacttttctggaaccactccagtcgatatatctcattccacattggagccaacagccagagagttctttcctacctctagtttttctgagactaataatggtgctgttaggaggagacctcaacaacataataaatttagagataataaggaatctggtaattggagaaataggtatggtagtgggagaacattcaacagctcaagatccaattttagcaataaaaccggcagagaagatcagtatgctcatgttcctgcaaactatagaagcgataattcatacaatacaactgattttcaaaatgatgaagaaagacagcctgagccagaaagaaattctcaaaaataccacgaagatcattacgatgatcacgtagaatataacgatttccaaagtagagatcaaggtaacaactcagtgccgcagtcctcaagatattacagagatactaagagatatgatgactattatcgaggacggtccagaggtaactacaatgacaacgattgcatgaactatgatgataaaaggagt

SEQ ID NO: 11827 - DNA, 1002 bp, Diabrotica virgifera
  misc_feature (664)..(664): n is a, c, g, or t
  misc_feature (904)..(946): n is a, c, g, or t
  misc_feature (969)..(996): n is a, c, g, or t
gtaatatttttgtactaatttaacataaatagtaattatggcaaataattctgaaacaggaattatcgatttactatctaagttggatgaagataatttactatctcttggaaggactgttactcaaggactcttaaaaataaattccaaagatgatgccataaaagccattttgaaacattcacctgatactttgagcatattaagaaggaaatcagtaaccagggaagttttgttttcatatttggatgaaaaagatatagttatgaaggcacctataactaaaaatgaattaattgacagaattatggaattttggaatataaaacgtgctgatgtaataactacagtcagttgtcgaaataatgaagaaacaataagtgaaactaaaccactaagagaagacagtaatagtatatcagctctagcagaacagtttgcaggttggttctattctctaatgaatgacgaaggtgttgggcctgagaatttttatccagatgcgaaaatgaaaattaatcttcattcaaataatgactgtgacactatcgttgttgaagacgatccagacggtttggcacagcaattacttaggattaagttacaacatggtattttcttcaatccaaacgttagtaaagagggtacccaaggaagaatggantcccatggattggtagtagttttagtttgtggcacactccatgtgcaaaagacatgcgtaggtgtttttgacaggtattttctctagctagggaccctttttgtgataacaattggaaaattaaaaactctgaaattgaacttacgaagtaaaagtgcggtggatgggaacacccacgtttgtggtgacagtggatttaccctccaaaataaaaattctcctcccttcttagctaaaggnnnnnnnnnnnnnnnnnnnnnnnnnnnnnnnnnnnnnnnnnnncaaatcaaaattacactcccacnnnnnnnnnnnnnnnnnnnnnnnnnnnncactcc

SEQ ID NO: 11828 - DNA, 631 bp, Diabrotica virgifera
  misc_feature (2)..(112): n is a, c, g, or t
  misc_feature (124)..(487): n is a, c, g, or t
  misc_feature (489)..(501): n is a, c, g, or t
  misc_feature (503)..(541): n is a, c, g, or t
  misc_feature (543)..(624): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnncnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnntggatga

SEQ ID NO: 11829 - DNA, 137 bp, Diabrotica virgifera
  misc_feature (9)..(82): n is a, c, g, or t
  misc_feature (84)..(99): n is a, c, g, or t
  misc_feature (110)..(136): n is a, c, g, or t
catttatannnnnnnnnnnnnnnnnnnnnnnnnnnnnnnnnnnnnnnnnnnnnnnnnnnnnnnnnnnnnnnnnnnnnnnnnncnnnnnnnnnnnnnnnnagtatcacacnnnnnnnnnnnnnnnnnnnnnnnnnnnc

SEQ ID NO: 11830 - DNA, 172 bp, Diabrotica virgifera
  misc_feature (4)..(95): n is a, c, g, or t
  misc_feature (99)..(170): n is a, c, g, or t
cgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnntc

SEQ ID NO: 11831 - DNA, 458 bp, Diabrotica virgifera
  misc_feature (3)..(107): n is a, c, g, or t
  misc_feature (257)..(294): n is a, c, g, or t
  misc_feature (353)..(377): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgagatgatattcgaatataaatatatctatttttttctgaaatacaagagctatataagtaaaagggatattcgcccctcacctactttcttatgacttgtatggagggaagaaatagtcgtccgtaaaaatatcaaataaattgcnnnnnnnnnnnnnnnnnnnnnnnnnnnnnnnnnnnnnnattatctatttttatatgtattaatattaaacatcgctatggacgaggttacggataannnnnnnnnnnnnnnnnnnnnnnnnctagaataaagataagaatatatactatcataacatatgatatgtatttaaattcatatatcataaaactcatgctttacc

SEQ ID NO: 11832 - DNA, 842 bp, Diabrotica virgifera
  misc_feature (3)..(53): n is a, c, g, or t
  misc_feature (55)..(135): n is a, c, g, or t
  misc_feature (137)..(223): n is a, c, g, or t
  misc_feature (232)..(284): n is a, c, g, or t
  misc_feature (288)..(348): n is a, c, g, or t
  misc_feature (350)..(458): n is a, c, g, or t
  misc_feature (462)..(475): n is a, c, g, or t
  misc_feature (478)..(513): n is a, c, g, or t
  misc_feature (584)..(603): n is a, c, g, or t
  misc_feature (618)..(671): n is a, c, g, or t
  misc_feature (681)..(786): n is a, c, g, or t
  misc_feature (793)..(838): n is a, c, g, or t
tgnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnngggatgagnnnnnnnnnnnnnnnnnnnnnnnnnnnnnnnnnnnnnnnnnnnnnnnnnnnnngaannnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggnnnnnnnnnnnnnnaannnnnnnnnnnnnnnnnnnnnnnnnnnnnnnnnnnntaaagtgtagtgtgataagtgattaatttgaattggtgggttattttgaaagtgtttaggtagaataatannnnnnnnnnnnnnnnnnnngtggaatgaagggannnnnnnnnnnnnnnnnnnnnnnnnnnnnnnnnnnnnnnnnnnnnnnnnnnnnngaaaaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnngagt

SEQ ID NO: 11833 - DNA, 103 bp, Diabrotica virgifera
  misc_feature (4)..(57): n is a, c, g, or t
  misc_feature (70)..(70): n is a, c, g, or t
  misc_feature (74)..(74): n is a, c, g, or t
  misc_feature (80)..(102): n is a, c, g, or t
gggnnnnnnnnnnnnnnnnnnnnnnnnnnnnnnnnnnnnnnnnnnnnnnnnnnnnnngtaaaaagcttanattnttttannnnnnnnnnnnnnnnnnnnnnng

SEQ ID NO: 11834 - DNA, 654 bp, Diabrotica virgifera
  misc_feature (345)..(410): n is a, c, g, or t
cgacaatatgacttcaggagtcaaacaaacggtcataaaaaatccaacatggtggaagcgacgtacaagtatggagaggtgtctaaccttatcaacgggtattgcccttcttattggaatctccttactcatagcacttgccacagtattatatagcagagatcaacatgttagtaataaaccgtacacagcccaaccactacaaggaaaaatagtcacaattacatcccaagatcacgaagatgaaaaagtatgtttaagtccaggatgcattcatactgcatcacgtgtattggaatatatggatgaatcggttgacccttgcgatgatttttatcaatttannnnnnnnnnnnnnnnnnnnnnnnnnnnnnnnnnnnnnnnnnnnnnnnnnnnnnnnnnnnnnnnnntaattggtgatgaacttcaagagcaattgagaactatgatcgaggaaccgatccaagaagatgaaccaaaaccattcaagttggatcaagcatctttgggtctgagacgggaattcttaatcaagggactcgatgaaaaaatagtcaaggtctattacgattatatggttgatttagcagtactgtttggagatgaacgagagagatgatctaaagaattataagcttctctagagattggaat

SEQ ID NO: 11835 - DNA, 269 bp, Diabrotica virgifera
  misc_feature (14)..(14): n is a, c, g, or t
  misc_feature (29)..(29): n is a, c, g, or t
  misc_feature (31)..(31): n is a, c, g, or t
  misc_feature (99)..(124): n is a, c, g, or t
tcttctaaggcggnccgacattttgaggngngggagggatgcctttaactcttaaaaaggagacgtaactgtagctggcataaatgtagaggtatctcnnnnnnnnnnnnnnnnnnnnnnnnnntcgatatgtgttagtgtttgttaggtatatgtgataggtgtaaagttgtttgtataataattttctatactcagataagtgcctacaccggtggattaggatttcgtatgtatcttgttctttgggagctgccaattaaacatta

SEQ ID NO: 11836 - DNA, 572 bp, Diabrotica virgifera
  misc_feature (33)..(33): n is a, c, g, or t
  misc_feature (189)..(206): n is a, c, g, or t
  misc_feature (318)..(356): n is a, c, g, or t
  misc_feature (501)..(522): n is a, c, g, or t
gcctccgtactcagatcatccgctctcggaggntgaggacccccatgtggatgagcgtcgggcgaatgggtctgagagagagtattttatttgtttgactcccaaatatattattcattgcttgtgatcgcagggagatttgttccaaagcagaaattgaggattcccagactagagaagatcttctannnnnnnnnnnnnnnnnngtaaatcacatttcgagataatttttatgtactgacgctgacattcgacttcccatatcatcttatttattatgatatacatgagattaatctgtgatccatatatccctannnnnnnnnnnnnnnnnnnnnnnnnnnnnnnnnnnnnnnccacgagctcaacagtaaaattttatgagaatttgatttctaactgaaaatgaggattaagaatttgcatctgttcaaaaaggtgagtatgtagtctgacctattattattgtaatgttctatagagtattgattcaaatatagnnnnnnnnnnnnnnnnnnnnnnaataatgagaatattactatcaaatgattgtgtatgtagtgcgaatatat

SEQ ID NO: 11837 - DNA, 893 bp, Diabrotica virgifera
  misc_feature (800)..(800): n is a, c, g, or t
  misc_feature (817)..(817): n is a, c, g, or t
gtggtaacatgatataaccttaaatattgtttctgttttatcttttatatggaaataagattgaaataaattagaatcatcatgggtaaattagaactagtacaaactctaaaaaaagataacggtagagtgtggaatctcgactggcatcctaaaggagacagtctagcctcctgtggtgaagaaaaatccatcagaatatggaccaaagacttgactggcaagtggtccaatagggtggtactaacagatggccacaaacgtacaataaggcaagtctcttggtcaccatgtggcaattacttagcctctggcagcttcgatgcaacaacctgtatatgggataagaaaagtggtgagtttgaatgtaatgcaactttagaaggacatgagaatgaagtcaaaagtatagcttggtcgaaatcgggacatttattagctacatgcagcagagacaagtctgtgtgggtttgggaagtagcagatgaagacgaatacgactgtgcagctgtattaaatgcccattcacaagacgttaagaaggtaattttccaccctgaaaaagatctactagcatcagcatcttatgatgatacaatcaagctcttccgagatgatcccaatgatggcgattgggtctgctgtgggaccctagcaggtcatgaatcaacagtttggagtataagctttgataaaactggtactagactggcctcttgcagtgatgataatacagttaaaatatggaaagaataccccccaggtaatccagaaggaattgctacacaggacggagatcngcatgggaagtgtgttnttgtacgtgtcgggacatcatgagagaaccatatatgatatacattggtgccatttaacaggctttatagctacag

SEQ ID NO: 11838 - DNA, 339 bp, Diabrotica virgifera
acgcgtttgtaggtagtaccgtatgtttcaaataaagtttggacatacattatttactgattttcaattaggatggggagacaatattttcttcttatagaccaggtttattctttaggcctagggtatcaaggactgttaactatgaccgatatctatagaatgttcaagactagaacagctacaacactcccaattccgttgtgatcatacgtatctccaacaagaacattgcttgtcaaagtgcttactcccgaattgtatcagactatatagtatgtgctgcttactcacatgttatgaccatatatgtaatcaaatatggtcataccatctatg

SEQ ID NO: 11839 - DNA, 333 bp, Diabrotica virgifera
  misc_feature (137)..(154): n is a, c, g, or t
  misc_feature (282)..(295): n is a, c, g, or t
  misc_feature (298)..(327): n is a, c, g, or t
ctattataaacaagattacaagaggtataatagcataaactttaaatttgtttagacattacttgttaatgctattataaacaagattacaagaggtataatagccctgtgcgagtagccatagttgccgagcacgnnnnnnnnnnnnnnnnnngatttgtaaataattattgttgacctctaaaagtcccacagattatgtattcaatgtgtttaattggaaattttatatatgtaattatctcgtagatatttataaacagttgttacatatctattagnnnnnnnnnnnnnngtnnnnnnnnnnnnnnnnnnnnnnnnnnnnnngttatc

SEQ ID NO: 11840 - DNA, 234 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (115)..(115): n is a, c, g, or t
  misc_feature (173)..(194): n is a, c, g, or t
  misc_feature (204)..(231): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttnaaattttacatgatctgagtttaaaccggtgtgagcccaggttggtttctatctttannnnnnnnnnnnnnnnnnnnnngaaaggaccnnnnnnnnnnnnnnnnnnnnnnnnnnnngat

SEQ ID NO: 11841 - DNA, 691 bp, Diabrotica virgifera
  misc_feature (360)..(379): n is a, c, g, or t
  misc_feature (654)..(684): n is a, c, g, or t
attgtatcatggatttaagagctttcctttgtcttgctcttgttgtctgtaccaacgcctctagcgtatacgagtactctcactctcatcatccaaaagttacaaaatcagtagttgttcaaacgtatgtacatcgtcccagaccaataccacttgctacacgagctttcgccggaatagcatctcaagtattagctaactatgcagaatcaaaagttccgacggtaggtattccagtgggtgcgaaaaagatttatcctgtggaatacgcatcgcattcgccacatgtagtgccatatgttactaaaagtaaaagctattatcactctgagttaccagtgtctgcctattcgtctccgnnnnnnnnnnnnnnnnnnnntggtggatcactgggctacgatagtcaccgtggatcactactatcaagtcattcctatggtggatcattggcgcatggtggtaatcatggttcactactgtcaagtcattcctatggtggttcacttgagcatggtggccatcattactattagtagtattaccagtcagtaaagaattataagttctaattaccagaataaggttagatgctgttatagagcataagtacaaggagaagagcgacaaatttggtaaattgtttaaggctgttannnnnnnnnnnnnnnnnnnnnnnnnnnnnnncgctact

SEQ ID NO: 11842 - DNA, 705 bp, Diabrotica virgifera
  misc_feature (2)..(22): n is a, c, g, or t
annnnnnnnnnnnnnnnnnnnntatatatgcatcatcgaaaactttagagttggaaattagatcctgtttgttagctgcgtcatatttggtccttaatactttttgtttcaaaggtgagtagtaactctttacctataacatttgctatgttcaacctttacagatttgaaaaaagaaaccttacatataaaaaatagtaagatcaatcttgtacaaatatttggtttttcaatatttagttctttcttcgatagctaaagtactaaagcagtagttagattcttcttttttttctttttctgtacctatgtatgagtgctaccttgataagatatacataatatgttaaaaaaagaaaaacccaaattttgaaacgatataatgggttctccattaagtcagttcctcagctaaattcctatttctgtctagaatttaattttaaatgtttaagaagtaaggcattctatcgttagaccactcgcctaattcatcatatcttacagagtgtgactatctatttgtaagtgaaaaatatacaataaaatttttaagattccagaccataaaaaatataaaagacagttttacagagtcatgtctcgtcatctaatgaccatacttggtgtagcaattagtgactgtaccctaaatatcatttaattgtctttattgttaatgaaagtggaaagaataaatattct

SEQ ID NO: 11843 - DNA, 304 bp, Diabrotica virgifera
gggatagttaacagaagaattatatgtttattatcttgcgaattaataagagcttctattcaataaaattttaattagtagattcatattgtaaatagttaaagttagtaagatatgtatttcgctttttaatatatcaatttttttctgaaatggatttgttatatttattgacaatgtactaattattagagatccctatattattaatactgaataatttccaggaagtctcttaaaaatcacattttattgaacatgaatttttatgtatgatgatagaataatatttttgttagaggag

SEQ ID NO: 11844 - DNA, 819 bp, Diabrotica virgifera
  misc_feature (23)..(40): n is a, c, g, or t
  misc_feature (74)..(96): n is a, c, g, or t
  misc_feature (322)..(342): n is a, c, g, or t
  misc_feature (421)..(440): n is a, c, g, or t
  misc_feature (505)..(553): n is a, c, g, or t
  misc_feature (646)..(646): n is a, c, g, or t
  misc_feature (693)..(712): n is a, c, g, or t
  misc_feature (735)..(735): n is a, c, g, or t
cttctccgcgcgtccgctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatganatattgtatcttctattggatcactaatttctttaattggggtattnnnnnnnnnnnnnnnnnnnnagaaagcttttctttttcacganaaagattaagacctttagaataacttcttcaatttgatgactacaattaaaccctccagctgaacacagataatctgaattgcc

SEQ ID NO: 11845 - DNA, 845 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(408): n is a, c, g, or t
  misc_feature (426)..(444): n is a, c, g, or t
  misc_feature (453)..(467): n is a, c, g, or t
  misc_feature (469)..(485): n is a, c, g, or t
  misc_feature (488)..(507): n is a, c, g, or t
  misc_feature (522)..(542): n is a, c, g, or t
  misc_feature (680)..(709): n is a, c, g, or t
  misc_feature (741)..(843): n is a, c, g, or t
tttnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnaatactaatattatcatcattactaaatttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncc

SEQ ID NO: 11846 - DNA, 125 bp, Diabrotica virgifera
cctaaaaattacaattaggaaatttgctatgctaaaattagtgatgctacaattgaaaaggacaagatcacaaccaagcacattgttgagagtatccaattctgttaatgacgtgaatatactaa

SEQ ID NO: 11847 - DNA, 818 bp, Diabrotica virgifera
  misc_feature (437)..(457): n is a, c, g, or t
  misc_feature (519)..(541): n is a, c, g, or t
  misc_feature (603)..(627): n is a, c, g, or t
  misc_feature (689)..(707): n is a, c, g, or t
  misc_feature (780)..(780): n is a, c, g, or t
gtatattcattcagttaatactttatactgagctatggaatttaaagttgaaattaaagaagagttggttgaatataatcaaaaagatctagagagccagctatccacatcaatagatctggaaaacttcaaaaatgagctagaactagaagataactcagaaatgggaccaaaagctgaaattaaggaagagtttgcagcagaatgttctcaagaatatagagagaatcagctatgtacatcccaagatcttgaagacttggttaataaagcagatgaagataactcaggttttcctcacaacgatttgaaacgccatttgatgagagtgcacactgatgaaacgccttacaagtgtgaaatatgttttaagcagcttacaagaagagctggtttgaaaacacacttgagagtgcacactggtgaaaagccttatnnnnnnnnnnnnnnnnnnnnncagttcagtcaagcacatagtttgaaattccatttgagaggacacactggtgaaaaacatcnnnnnnnnnnnnnnnnnnnnnnncagtttagtcaagcacatagtttgaaatcccatttgagagggcacactgatgaaaaacctcnnnnnnnnnnnnnnnnnnnnnnnnngtttagtcaagtaggtcatttgaaaacacatttgagagtgcacactggggaaaagacttatnnnnnnnnnnnnnnnnnnnaacagtttacttcagcaaatgacttaaaaaaacatttgagagtgcacacagggggagaaacccttacagtgtngaaatttgttttaaacagttcagtgtagcacataattt

SEQ ID NO: 11848 - DNA, 59 bp, Diabrotica virgifera
  misc_feature (2)..(58): n is a, c, g, or t
gnnnnnnnnnnnnnnnnnnnnnnnnnnnnnnnnnnnnnnnnnnnnnnnnnnnnnnnnng

SEQ ID NO: 11849 - DNA, 82 bp, Diabrotica virgifera
  misc_feature (2)..(14): n is a, c, g, or t
  misc_feature (24)..(41): n is a, c, g, or t
gnnnnnnnnnnnnnacacttggcnnnnnnnnnnnnnnnnnngaatgactatatcacaattggtctaattcctgtatccatga

SEQ ID NO: 11850 - DNA, 346 bp, Diabrotica virgifera
  misc_feature (2)..(57): n is a, c, g, or t
  misc_feature (70)..(107): n is a, c, g, or t
  misc_feature (113)..(135): n is a, c, g, or t
  misc_feature (137)..(182): n is a, c, g, or t
  misc_feature (184)..(221): n is a, c, g, or t
  misc_feature (241)..(259): n is a, c, g, or t
  misc_feature (272)..(295): n is a, c, g, or t
gnnnnnnnnnnnnnnnnnnnnnnnnnnnnnnnnnnnnnnnnnnnnnnnnnnnnnnnnggtttttttaagnnnnnnnnnnnnnnnnnnnnnnnnnnnnnnnnnnnnnngggggnnnnnnnnnnnnnnnnnnnnnnncnnnnnnnnnnnnnnnnnnnnnnnnnnnnnnnnnnnnnnnnnnnnnntnnnnnnnnnnnnnnnnnnnnnnnnnnnnnnnnnnnnnncctttagggaaaaaaaaccnnnnnnnnnnnnnnnnnnnaaaagttccaaannnnnnnnnnnnnnnnnnnnnnnnggacccccccccaagggtgtgggaatttaaaaggtttttttaaattttggg

SEQ ID NO: 11851 - DNA, 67 bp, Diabrotica virgifera
  misc_feature (21)..(21): n is a, c, g, or t
taacagcgtaattttattggnagagtcaaatcgataataaagattgcgacctcgatgttggataaag

SEQ ID NO: 11852 - DNA, 826 bp, Diabrotica virgifera
  misc_feature (2)..(715): n is a, c, g, or t
  misc_feature (718)..(735): n is a, c, g, or t
  misc_feature (740)..(818): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnngggtgatt

SEQ ID NO: 11853 - DNA, 688 bp, Diabrotica virgifera
  misc_feature (114)..(145): n is a, c, g, or t
aagcgtccggactagcctgctatataaagaatgagaatgcgctgacataaggacataggaagataggctgcatgatacacaaatggctatatactgtaactgtgcttggatatnnnnnnnnnnnnnnnnnnnnnnnnnnnnnnnnctatttgtataaaacccaggcgcttttaaatataaagatctaatccaaacaactataatatttccgtcatgagtcatcaaccccaaaaactattcaaacatctaccaatttgagatcataggccagaaaaacttctacgtgaacttgcaataagatgaccactcgacgctgaataaccctcacaacattaccttgggcgtgtggcacattttacctcatgaaatgctaagtgaactcatactacaacaacgactacaactatgatgctgttttacattaatgcaaactacagtgctctgttgaacatgcacgaaaatggacacagacagaactgattcactcggaacacatgaggagatgaggaaatttttccatatttcttccgtggatcacagaagttatgaagattcaacaaaaggtgagctaacctaatctaacgtattcgacgatatgtgaagattctacacatgcatgctgctgcgcaccaactccaaaatatacgtctgatgacactctctccgtactgcaatacgtacccattta

SEQ ID NO: 11854 - DNA, 390 bp, Diabrotica virgifera
  misc_feature (56)..(73): n is a, c, g, or t
  misc_feature (153)..(179): n is a, c, g, or t
  misc_feature (220)..(235): n is a, c, g, or t
  misc_feature (237)..(257): n is a, c, g, or t
aaaattaaatagagatattagaaagtggagtaattaggagtgagagagaatattgnnnnnnnnnnnnnnnnnngttatgttttgtaaattgagtatatgtaggtataaatttataatatatatatttattagattagtaataagatttgatgnnnnnnnnnnnnnnnnnnnnnnnnnnnatatatggtttatattgtttttgaaaagatatgttattgannnnnnnnnnnnnnnngnnnnnnnnnnnnnnnnnnnnntatatttaatatatatataagtatatgattagatatatatagtattaaaattagatatttttagggttgagattagaaatagaattttattatagtttaatttttaactacacatacgaataaaaattttcat

SEQ ID NO: 11855 - DNA, 386 bp, Diabrotica virgifera
  misc_feature (2)..(37): n is a, c, g, or t
  misc_feature (39)..(136): n is a, c, g, or t
  misc_feature (139)..(225): n is a, c, g, or t
  misc_feature (229)..(299): n is a, c, g, or t
  misc_feature (304)..(343): n is a, c, g, or t
tnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaannnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnnnnnnnnnnnaatcnnnnnnnnnnnnnnnnnnnnnnnnnnnnnnnnnnnnnnnncccataaggggaaaaaaacagggggtgaaattttttttttggg

SEQ ID NO: 11856 - DNA, 619 bp, Diabrotica virgifera
  misc_feature (67)..(67): n is a, c, g, or t
  misc_feature (472)..(493): n is a, c, g, or t
tccctactaaggtctccccgtctatttatatacatttccactcgcttccttttagagaatgaagggnagaatgattttattggtaatgttaatatgatgaaatattgataaatattgaatatttagagttaagttaggtaatttgggaggaggtgaaagtatagatttattagatttatgttttatataaggttttttatagttatatttggaaaatgataaatgtgtgaatattaaaataagtaaagtaaaatattgaggatttggtggaggtagtggaaatgttgaatatggagaaaatattggatttattgtaagaggtgaattataagataattatggtgttaatattaatggaattaaaggagggattggttttttgtataatggaagtagtataggatgtgaaggtaataaaggatttggagttaaagtatagttatgagataaaaatgtaagtgttagaggaggnnnnnnnnnnnnnnnnnnnnnnggtaatgttgtaaatgaaggaaatataggatttggattaagaggaatggataaatatgtaaaggattaagataagtttaatgaaaatagtggaataattaataatgaaattagaggaggttttgga

SEQ ID NO: 11857 - DNA, 705 bp, Diabrotica virgifera
  misc_feature (56)..(78): n is a, c, g, or t
  misc_feature (418)..(471): n is a, c, g, or t
  misc_feature (652)..(669): n is a, c, g, or t
agaattattattgtatttaatacatagcatagcataatatagaacagtaactgttnnnnnnnnnnnnnnnnnnnnnnncaactttgcttttagagaagtagccaacctgttgaaactattgcaacaaattttattttagctgaattacaaaagagtaacttacctgtgttacaacgaaggagatgaacttgcacaaagtgtttgtatatggaactttaaaaaaaaatgaacccaatcattcttggtttgccaaaaatgctgagggatattacaaatacattggtgatgctaagacagttgaaaaattgccgttaattatagctacaaaatataacgtgccatttattttaaaaagcccaggaaatggtactaacattattggtgaggtgtatgaagtagacgacaaagtttttgccgnnnnnnnnnnnnnnnnnnnnnnnnnnnnnnnnnnnnnnnnnnnnnnnnnnnnnnttactttggtaaatggcggttcttctgtaaaagtgtggatttacgttattccaaactttaatccgaagttattaaatgaaacatgttatgaaagttacagcaattcaggatctcatggaaaacgatatgatcccagagatgcatcaacacttgaagaattaaatgcataaaaactgaagannnnnnnnnnnnnnnnnngtttttctagtatttcttactacccaaacatatcca

SEQ ID NO: 11858 - DNA, 841 bp, Diabrotica virgifera
  misc_feature (11)..(33): n is a, c, g, or t
  misc_feature (81)..(99): n is a, c, g, or t
  misc_feature (171)..(196): n is a, c, g, or t
  misc_feature (201)..(231): n is a, c, g, or t
  misc_feature (263)..(295): n is a, c, g, or t
  misc_feature (302)..(352): n is a, c, g, or t
  misc_feature (370)..(387): n is a, c, g, or t
  misc_feature (389)..(432): n is a, c, g, or t
  misc_feature (470)..(623): n is a, c, g, or t
  misc_feature (625)..(711): n is a, c, g, or t
  misc_feature (713)..(744): n is a, c, g, or t
  misc_feature (761)..(787): n is a, c, g, or t
  misc_feature (791)..(812): n is a, c, g, or t
  misc_feature (815)..(839): n is a, c, g, or t
ctctctcttcnnnnnnnnnnnnnnnnnnnnnnncttaacgatagttaattagtatccgtgagagaatatctttatctcttnnnnnnnnnnnnnnnnnnncttttcgtacctcgtgtatcagggatctatctaattaataattatcatcatttatcattttcgaatcttaannnnnnnnnnnnnnnnnnnnnnnnnnatccnnnnnnnnnnnnnnnnnnnnnnnnnnnnnnntaacgaaacgttatctcgtttttaaatcatcnnnnnnnnnnnnnnnnnnnnnnnnnnnnnnnnncttatcnnnnnnnnnnnnnnnnnnnnnnnnnnnnnnnnnnnnnnnnnnnnnnnnnnncttttagggatcgagctnnnnnnnnnnnnnnnnnncnnnnnnnnnnnnnnnnnnnnnnnnnnnnnnnnnnnnnnnnnnnncattttaaaatacggtattcatttatcttttatcatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnngcttggaaatgaggggnnnnnnnnnnnnnnnnnnnnnnnnnnncatnnnnnnnnnnnnnnnnnnnnnncgnnnnnnnnnnnnnnnnnnnnnnnnncg

SEQ ID NO: 11859 - DNA, 85 bp, Diabrotica virgifera
  misc_feature (4)..(45): n is a, c, g, or t
  misc_feature (52)..(52): n is a, c, g, or t
  misc_feature (58)..(58): n is a, c, g, or t
  misc_feature (68)..(68): n is a, c, g, or t
  misc_feature (72)..(72): n is a, c, g, or t
gtgnnnnnnnnnnnnnnnnnnnnnnnnnnnnnnnnnnnnnnnnnntattttntagttnaaaagcttanattnttttaaagacgag

SEQ ID NO: 11860 - DNA, 725 bp, Diabrotica virgifera
  misc_feature (27)..(45): n is a, c, g, or t
  misc_feature (91)..(124): n is a, c, g, or t
  misc_feature (464)..(481): n is a, c, g, or t
  misc_feature (605)..(641): n is a, c, g, or t
  misc_feature (651)..(677): n is a, c, g, or t
tttttaggattgaacttacaaataccnnnnnnnnnnnnnnnnnnngttatataagatgtaggatgaaaaatgttcatattgagaagtacgnnnnnnnnnnnnnnnnnnnnnnnnnnnnnnnnnnacttataaatctttgattaaaatattcttgtggattattcaaatttaataatgacgagactataagcattagaaaattgtagatgtagaaaaaatagataagtttattgaagagattcgacatcttttttgtcacctgttgattaaaaaaataacctttttgttttagatattttgtctcagctggccattgattagtttgaatgggcccgagattttccccgcgcgaccgcaggataatcaaatagtttttttgttgaaagttggcatgaactggttgtattgaaagaaaaccaggtttaatttaatttatcaaaagatttgttcttgaagtaaaccannnnnnnnnnnnnnnnnngagggggaagacccgggtaggaggttattaaaaactttaataagcttttttgaggggtagattttctttatattaaaaacctgtttttcatcggggtagaattttctaaaaacagtattgggtnnnnnnnnnnnnnnnnnnnnnnnnnnnnnnnnnnnnnttttggggtnnnnnnnnnnnnnnnnnnnnnnnnnnngctttaactcccccctaagggcctaaaaacagcccaaaattttttttt

SEQ ID NO: 11861 - DNA, 816 bp, Diabrotica virgifera
tttttctactactagagacatttaatgcatctattcgtttagttgacgttgacggcaacgagtctttctgcactcctcaagagttccttcgagttgatatgactcgaagggttattaagaatattatactaagtactttggactctagctacaagtacgcaacatacaagatgatgccaagagcacaaaacgcacatgccatggtaaacgctgggttcttggtaaagctgaagaacaacgtcgttacctacgccaatatcgtatatggtggaatcaatccccagttcatacatgcctcaaagacagaaaaattcctgattcaacagaatttgtacaagaatgatactttacaaaaagcttttaatactctgaagcaggaattaattccggattgggtacttccagatcccactcctgagtttagaaaaaatctagctatttctttgttttataagtttgttttaaaaactagtccacccaatctagtcggagcgaggtataaaagtggtggtaccatcctaacaagagcactttccacaggagtacaacaatacggtacagataacaaacaatggcctttgactcaacctattccaaaggtagaatcgttggcgcaaacatctggtcaaattaagtatatactagatatgccggacataccacatgaatgtcatgctagctttgtaacagcaaaatgcgttgcaggctctaaaataaccaatgtagatgtttcacaggcgctgaaaattgaaggctatgttggctacgtcgacaaaaaagacataccttggtcgtaatacctgcacaccactttga

SEQ ID NO: 11862 - DNA, 271 bp, Diabrotica virgifera
  misc_feature (2)..(61): n is a, c, g, or t
  misc_feature (64)..(90): n is a, c, g, or t
  misc_feature (103)..(124): n is a, c, g, or t
  misc_feature (127)..(170): n is a, c, g, or t
  misc_feature (179)..(250): n is a, c, g, or t
  misc_feature (252)..(269): n is a, c, g, or t
gnnnnnnnnnnnnnnnnnnnnnnnnnnnnnnnnnnnnnnnnnnnnnnnnnnnnnnnnnnnngcnnnnnnnnnnnnnnnnnnnnnnnnnnngaccctatagagnnnnnnnnnnnnnnnnnnnnnnggnnnnnnnnnnnnnnnnnnnnnnnnnnnnnnnnnnnnnnnnnnnnatggggggnnnnnnnnnnnnnnnnnnnnnnnnnnnnnnnnnnnnnnnnnnnnnnnnnnnnnnnnnnnnnnnnnnnnnnnncnnnnnnnnnnnnnnnnnntt

SEQ ID NO: 11863 - DNA, 219 bp, Diabrotica virgifera
ccttcccccgcccccgggccttttcagcgctacaggaggtattttcagcatcgtaccccaaaaatcgacaagttctggtattttgaggtgaacacgcacgagaaaaatctttttttttcgaccatctcgggatctatgaggtctggcagatgtgtggatgaaggaatctcactagatgagcgcatatatgagaaagggggagaacacatctatcaaagt

SEQ ID NO: 11864 - DNA, 891 bp, Diabrotica virgifera
  misc_feature (762)..(762): n is a, c, g, or t
  misc_feature (847)..(847): n is a, c, g, or t
ctccacaagcctccgattcacatcaagatgaatacctacacctctcccaccccctcgcattagtggcattagtgggagttactctaactcaatctcgtgaaatcagtcgagacacacgtgaagttagtagtgatttggaagctgcggcgtctggccacggtcaccattggaaaaagggaggcggtcacgagggccactctgaccaccacagcagccacggtgaaaagggcgacaaaggctacaaaggtcaccatcaccacgaaaaaggatccaagggccatcacgacaaagaaggccacaagaaacactatgaagaacacggaggtcacaagaagaagcaccaccacgacgatggataccacgctgaacaccacaaaggagaaaagggcgagaaaggacacaaatacggtgaaaagggatcttacaaaaagggtcacagcaccaaaggaggacatgacgtacacaaactagacgaatacaagaaagaaaaacacttcttcgatgaagaccacgactccggccatcacgaaaaacacggaggccatcaccacgaagatggatacaagaagggaggccacaagaaaggtggccacaagaagggaggacaccatgaagaccactacggcaagaagggaggtcacgagaagggatcccactaccatgaatctgctggtcacaagaaagccggtggacacgatgatcactaccaccacgaccacaaatatggaaagaaaggtggacacgaagaccacaagaagtggngattcaaaaagggacattaagtaccccaactacaatgtgattcagttgatttttgttaagatagttgtgttttatttggtgttgntctgttttatggtgacagtttaaataaaacgattttattttttt

SEQ ID NO: 11865 - DNA, 764 bp, Diabrotica virgifera
  misc_feature (60)..(61): n is a, c, g, or t
  misc_feature (75)..(75): n is a, c, g, or t
  misc_feature (98)..(98): n is a, c, g, or t
  misc_feature (104)..(104): n is a, c, g, or t
  misc_feature (158)..(158): n is a, c, g, or t
  misc_feature (167)..(167): n is a, c, g, or t
  misc_feature (203)..(203): n is a, c, g, or t
  misc_feature (260)..(284): n is a, c, g, or t
  misc_feature (326)..(326): n is a, c, g, or t
  misc_feature (333)..(354): n is a, c, g, or t
  misc_feature (393)..(393): n is a, c, g, or t
  misc_feature (399)..(399): n is a, c, g, or t
  misc_feature (500)..(500): n is a, c, g, or t
  misc_feature (541)..(541): n is a, c, g, or t
  misc_feature (609)..(609): n is a, c, g, or t
  misc_feature (612)..(612): n is a, c, g, or t
cctcttataggggtccgcttggtttgcctattcaaataaaatgctttaaggagaatgtgnngggttagtagtttnaaggagttgtgtggtttgtgganttaaanaaaatttattgaggtgttagagttgtaaagtaatttgttattgtagtaaggatnattagttanaagattggaaaaagtataagttaatttgtaagagantttgaatatttgattttattgtggaaaataaataaggatatatagtggagaatttannnnnnnnnnnnnnnnnnnnnnnnnaaggaagattagaaaatgaaatattaagatttgtaggtgaanagttagnnnnnnnnnnnnnnnnnnnnnngatatttattgagaaatatttaaattttgttaatatagntatgtntattagtggaagtaatgttgtttagtgtaaaaataaaaatgttaaagattttttagagattattttaagttagtttataagtgttgaaaatgatgtatatntagaagaaatatgtagaaatgttatagaggatatgagtgantatggagtttgtgttataggtaaattttataaaagtagaaagttgtattataagtggaatttgtaatntgnatttttatttgatcagttgtaataggctcttgaaaccaagttcatctacttgccaagtacatcacttttacttgcattttacttagccatttacatgtatacacaagggctcagttacttacatctctacttaataattatattttgatggg

SEQ ID NO: 11866 - DNA, 498 bp, Diabrotica virgifera
  misc_feature (14)..(14): n is a, c, g, or t
  misc_feature (197)..(217): n is a, c, g, or t
  misc_feature (294)..(315): n is a, c, g, or t
ttcattaaaggcgncccgctttttttctagtaagaatatttaatccttctaaaggaagtaggaaaggatggagggaaagagagtttatgaaggagaagaagagatatttatagttgatatccctctaagggttattaggaatattagaataagtattttgaagtataggtataagaatatataatattagatgatgnnnnnnnnnnnnnnnnnnnnngaaatgataaaaggtggagatattggaaatgatgatgagtaatgtggttatatgtatttatatagttatatggtggnnnnnnnnnnnnnnnnnnnnnngtgtgatagagagagaaatttttgatttaattgagtttgtagaagattaagattgaaagaaaggtttttattatagtataattatgttttagtttaagaggtgggatgaaagaaatctctattcgagagattaggaaattgtgattgagtatagtgagattagaagatgctgaaattgttgag

SEQ ID NO: 11867 - DNA, 1000 bp, Diabrotica virgifera
  misc_feature (71)..(95): n is a, c, g, or t
ctgtgaatctctttatagccttctacggagtggtcggaaagttcctttcctaattttcttcatttgcggcnnnnnnnnnnnnnnnnnnnnnnnnnggcgcatcaacctatatggttattagcgccgctcggtattacaaagtttatgtttacaatttgttgatatatagatagatacataaattaacattaatacatatacatagattttcatatacattgatttttacagtgttgatatttggttgtagatccatttcaaaaaacttaaaactgacgaaaagtcacagtcctcttcgaaacactcacgtagcgttatcggtagtttacacttaagctgttaccgcacttaccgcacattggattaacacttccagtaaatatggtattcatttgattactagtctttgttaaactcatgtctaaaaagggttttctgacaatccttattcttgtacttgatcgctatctatttcggaggaggaatataatacatccagctgtttagatttttacgtttaatttttgtacaacgtgttttcatgattttttcatcgaacagaggatatatgttgtctaataattctagtaatccctcaatatcttttgtgaaagtttgagcaacattcaatgtgttagctgaaccatatgcgttttcaaagaagtgtatcgtttcttgataataaagaacagtgtgatttttttcctcttccaaaatgttttatttggttccatctggttcctttatattaaaaaaatctctttgtttaggtaattttcttcttttttgaaacttggatctggaaaaagggtcattttaaaggaattaaagaagaatccgggggtggggttttggttttgcggaaaaaaaatctttttgctcctggaatttggaagcgcccgcccacattcggtaaattttgggaaagggggaaaccaaaaaatccaattgatttttcgggggtcggagtaataatataaccggtctaaaaaccttataa

SEQ ID NO: 11868 - DNA, 337 bp, Diabrotica virgifera
  misc_feature (2)..(33): n is a, c, g, or t
  misc_feature (35)..(77): n is a, c, g, or t
  misc_feature (123)..(137): n is a, c, g, or t
  misc_feature (139)..(158): n is a, c, g, or t
  misc_feature (174)..(205): n is a, c, g, or t
  misc_feature (271)..(288): n is a, c, g, or t
tnnnnnnnnnnnnnnnnnnnnnnnnnnnnnnnngnnnnnnnnnnnnnnnnnnnnnnnnnnnnnnnnnnnnnnnnnnncggccactgatttatttgaatggtcgcggtatttttgaacgggttnnnnnnnnnnnnnnncnnnnnnnnnnnnnnnnnnnnggtgaatggaagggannnnnnnnnnnnnnnnnnnnnnnnnnnnnnnncttaagaattttccttttttcagggaaaatcttcaagttttttatataacgaaaaccccccaccgnnnnnnnnnnnnnnnnnncattttctttgctttttagtttctttttttaacaaattttctaaaacgg

SEQ ID NO: 11869 - DNA, 951 bp, Diabrotica virgifera
  misc_feature (533)..(554): n is a, c, g, or t
  misc_feature (650)..(672): n is a, c, g, or t
aataaatgcagttttaacctttccaggccattgtatcacatatttaattgttcccgtcaaattccagattactggaaagaaagttttcttaaacgtatatttaaagatggagataaatctcttgttgataattatcgtcctattagcatcattggtgtgatacccaaagtgtttgagagtctggtttgtgactttttaactcctttactcgagcctaaacttatcaatcaacaatttgggtttataacccatagatctactgagctgaacctattaacttatgtagattttttgtttgactccctggagaaagggtttcaagttgatacaatttatacagatttctccaaggcgttcgacaggatgtctcatggtctataagctcagaatgattggtgttgatgaaccaatgatttcttggtttagcagcagggttggcaggtttaaaccaacatgcttaaaaccttgatttacaccaactggttttttaagaaaaaaacctggttttttttattgaacctccaaactggtgnnnnnnnnnnnnnnnnnnnnnncagctgcctcaaatgaagaaaattaagataaataaattctatttttttactttcgaacttagctattttaaatattattacatttgaagatgattnnnnnnnnnnnnnnnnnnnnnnngtgtgtaaataaaaataaaagctgtcttaataatttttttcattgtttattactattacatatcttataatagttatttatgatataagtgttaaaagtacacgtttaaggcacgcatgtgaaagtttgcagaatgagcgatagcgagttctgcaattaacatgagtgccctaaaaatgtacttttttacacgcatatcatacaatattttttctacaaacgtaattacagggacatatctacaaaaacttttacttgaacttgactgacatccatttt

SEQ ID NO: 11870 - DNA, 100 bp, Diabrotica virgifera
  misc_feature (2)..(15): n is a, c, g, or t
  misc_feature (23)..(99): n is a, c, g, or t
gnnnnnnnnnnnnnnagacgagnnnnnnnnnnnnnnnnnnnnnnnnnnnnnnnnnnnnnnnnnnnnnnnnnnnnnnnnnnnnnnnnnnnnnnnnnnnnng

SEQ ID NO: 11871 - DNA, 952 bp, Diabrotica virgifera
  misc_feature (8)..(42): n is a, c, g, or t
  misc_feature (44)..(690): n is a, c, g, or t
  misc_feature (698)..(740): n is a, c, g, or t
  misc_feature (764)..(780): n is a, c, g, or t
  misc_feature (783)..(828): n is a, c, g, or t
  misc_feature (831)..(853): n is a, c, g, or t
  misc_feature (872)..(890): n is a, c, g, or t
  misc_feature (892)..(924): n is a, c, g, or t
  misc_feature (930)..(950): n is a, c, g, or t
cctactgnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcgggnnnnnnnnnnnnnnnnnnnnnnnnnnnnnnnnnnnnnnnnnnngaaagctgcaatgaaagggttggnnnnnnnnnnnnnnnnntcnnnnnnnnnnnnnnnnnnnnnnnnnnnnnnnnnnnnnnnnnnnnnnggnnnnnnnnnnnnnnnnnnnnnnncagaaggacccctataagnnnnnnnnnnnnnnnnnnncnnnnnnnnnnnnnnnnnnnnnnnnnnnnnnnnncttatnnnnnnnnnnnnnnnnnnnnnca

SEQ ID NO: 11872 - DNA, 785 bp, Diabrotica virgifera
  misc_feature (4)..(20): n is a, c, g, or t
  misc_feature (23)..(40): n is a, c, g, or t
  misc_feature (68)..(97): n is a, c, g, or t
  misc_feature (172)..(194): n is a, c, g, or t
  misc_feature (217)..(235): n is a, c, g, or t
  misc_feature (238)..(261): n is a, c, g, or t
  misc_feature (292)..(359): n is a, c, g, or t
  misc_feature (365)..(444): n is a, c, g, or t
  misc_feature (639)..(656): n is a, c, g, or t
  misc_feature (679)..(693): n is a, c, g, or t
  misc_feature (695)..(771): n is a, c, g, or t
gagnnnnnnnnnnnnnnnnntcnnnnnnnnnnnnnnnnnntgaacgtggagaatgagggatgagggannnnnnnnnnnnnnnnnnnnnnnnnnnnnnttaaaagagttgaagaattagatattttattgatagataaatatttatgttatatattgttgatggaagagatgnnnnnnnnnnnnnnnnnnnnnnngttaaataagaaatataaatgtnnnnnnnnnnnnnnnnnnnatnnnnnnnnnnnnnnnnnnnnnnnnagaataaaatgttttaagggttgagattagnnnnnnnnnnnnnnnnnnnnnnnnnnnnnnnnnnnnnnnnnnnnnnnnnnnnnnnnnnnnnnnnnnnnatgatnnnnnnnnnnnnnnnnnnnnnnnnnnnnnnnnnnnnnnnnnnnnnnnnnnnnnnnnnnnnnnnnnnnnnnnnnnnnnnnngagagatgataatattagaattgagaaattgtagatataggaaaaatatataggatgaataaaggaatttgttattattttgtttatatgtttattaaaattatgtgttttttgaattaatataaggtctcgcctgaccactgagttaattgaatggccgcgcgtattttgaacgtgctaacgtaggataatcannnnnnnnnnnnnnnnnnggtgggaaggaaggggttggatnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnncccttaataaaagg

SEQ ID NO: 11873 - DNA, 358 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(227): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnngagataaatatcaaaaaaaaaagactaccttccggaagagctctaggaggcaggtccatcaacgactttttactgtactccagaggaaatccagcatatttatgacatatggcaacaatctggaaacacca

SEQ ID NO: 11874 - DNA, 53 bp, Diabrotica virgifera
  misc_feature (5)..(51): n is a, c, g, or t
ccccnnnnnnnnnnnnnnnnnnnnnnnnnnnnnnnnnnnnnnnnnnnnnnnat

SEQ ID NO: 11875 - DNA, 741 bp, Diabrotica virgifera
  misc_feature (3)..(44): n is a, c, g, or t
  misc_feature (52)..(170): n is a, c, g, or t
  misc_feature (174)..(726): n is a, c, g, or t
  misc_feature (738)..(738): n is a, c, g, or t
ccnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaaagcttanatt

SEQ ID NO: 11876 - DNA, 1042 bp, Diabrotica virgifera
  misc_feature (917)..(939): n is a, c, g, or t
  misc_feature (1002)..(1024): n is a, c, g, or t
ggaaaaatagtaccagaatggtaatactcaaaatagaaaattaaaaattctagtatacttgtgtgggaattcagatatattttaatacaattcgtagcaataacttaccagacatggaatttaaagagaagcacattccaacacaaccttcaaccaaagtaccagatagaccattaacagtttctcattcctctgagccccaagcagaaggtgaagtagatctagacgaagatgaaatatctcaacaaatgacacaatcttacagcgagatttcgtttaaatctggtggtcagagtcctgaagacgacattcctatgtcttcaaccctagagtcactacaaatcggagaagaggttaaaagacccatgactttgccctacacaaatccaaaaccgttaaatttggaaggttctgtacatattgagggaaacatgacacattttgtagcagaagagatcgagcaaaaaatcagactgtctagccctgtttctaagaaagatactccaggtgtcagtacttcaagaacatgtacccccagtccgctataccgccagctattaataccgcaggttggccaactggattctgctttaataaatgatctagaagtagaggcacacagaatggcaacatctgtagatagcttgattgaaaacttatgtgaaattctacattccatctcttcaataactgctgacaatgttgatgtatacaaaaatgctgtttccaaaatgtctgatgccatggatggtaatattaagagtatgtatacaatgatggcccaagctgaagaagtgacacaatctatgaagattgtggaaggcttgtctgttcgtattaaggaaataaagagatttagtgatttgtttgagagcttcgtataaactgtgaaaaaaatttttatggtaatttatggnnnnnnnnnnnnnnnnnnnnnnncttggaatgaagttggagaaagggggggaagggaaaaacccttgaaataatgtaatttttgcnnnnnnnnnnnnnnnnnnnnnnngggtttattttcaagggg

SEQ ID NO: 11877 - DNA, 482 bp, Diabrotica virgifera
  misc_feature (314)..(333): n is a, c, g, or t
  misc_feature (428)..(460): n is a, c, g, or t
tgcgcattcccagtgagtattttatttgtatccacgacaaacctaatctaatgtgacctggcccgctccgcggatcgagaaataataatacaatattaattatctgcgaatctaaaagagctccacaatcaaaatactttattgatccgagaaatatagacaaggtaagctattgctgcagggaagagatattcctatttatatatcactaattgttaatgaccaaatgtagcatgtatttattaccaatacaggcataactgctatattttgcatactatataagattaggaagttgtaggtgagagcttagnnnnnnnnnnnnnnnnnnnnggaatgcttgactaaaaactgggactaagaatttcacatatgtaaaaatatgctcaaatatatttcgatatatcatcatgctcatcccccatacnnnnnnnnnnnnnnnnnnnnnnnnnnnnnnnnngatcctaggagagatgataata

SEQ ID NO: 11878 - DNA, 588 bp, Diabrotica virgifera
  misc_feature (454)..(486): n is a, c, g, or t
tgccttttaaggtcccccgcattcagatattggaactttatactcctttttcggaattggagcaggtgtggtaggaccttcagtaacaattttagtacgagcagaattaagagaggtgttctatctgccgatggaaacgaccagcttgctaatgagattggtacagattactagatgtattataatttactgtataagggatacaatcgattattaatatactatggatcctgacaatgatgcactggttgattgtcgtattggacttaatatctgcctgtctaaaacggcatctgatattgccaacttgaagctaggagtaagtccatatgaggtcttacgcctatgcacacgttgatacatgtcatgcaaattgtgtatgaaaaatttcttcttcaaatgtcattttaatgggaagctgctagcaatactggatatattaattatattgtannnnnnnnnnnnnnnnnnnnnnnnnnnnnnnnnctgttgcaacattagccattaatattttgagaaatttccatgctacttataaaaacctccatgagaatttgcatgttttcatttgattatttatattatttt

SEQ ID NO: 11879 - DNA, 859 bp, Diabrotica virgifera
  misc_feature (32)..(65): n is a, c, g, or t
  misc_feature (774)..(774): n is a, c, g, or t
cgtcactgtaccaacggagcagaaatcgattnnnnnnnnnnnnnnnnnnnnnnnnnnnnnnnnnntttgttagcagccctgtttcttaacgaaaataaagtgttcccctaaaatatctacaaaatttgaaaggtaaaaatctaactagatacaaataaagagtatttattgctttaaaatggtttatccaatcttagagtttgtcataaaagagtcagcagtaattcctgggtgatgtatattgaataataacttttaaaatgactacagaaggtttgtatttgcattgtataatatgcaatggggcttgggacccctctgctgactacatagaaatatttgctccagatacgaacagagaatcagacttacatatagtgtctttggtgtcaacactgttagataaagatattaaggaagatccagaaaatgtccaattaatttgcaataagtgtttttcctatataactgaactagaagaattacaaacaagagtagctgaaattaaaaatgaaatttttgaatcaaatggacaagaagaaagtgaatatacagaaactggcacaaagtgaaatcacacataaaaaaaatatttctcctaagaagatgttatttattccatcatctgatgaagattctacacaagtactaactgaaaacaacacttttcaaataaagctagaagaggacactaatgaagttgcatttgtgagtgatatagaacaaggagaagaaactgaggaaaatgcaattgaagaaaatattgaatatcanactttttcaaatgtcgacgcagaaattttagattctggagcatggataactcgtctgattcagatttgacccttccagtctgact

SEQ ID NO: 11880 - DNA, 581 bp, Diabrotica virgifera
  misc_feature (16)..(42): n is a, c, g, or t
  misc_feature (44)..(153): n is a, c, g, or t
  misc_feature (163)..(200): n is a, c, g, or t
  misc_feature (202)..(214): n is a, c, g, or t
  misc_feature (216)..(281): n is a, c, g, or t
  misc_feature (283)..(387): n is a, c, g, or t
  misc_feature (410)..(428): n is a, c, g, or t
ccctcaaggcgtccgnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtgtatnnnnnnnnnnnnnnnnnnnnnnnnnnnnnnnnnnnnnngnnnnnnnnnnnnngnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagcttaaaaagaatatatgnnnnnnnnnnnnnnnnnnncatcattggtaagaccaggaaatttaaaatatgtagttatgatataattctctccaactcaattgctgacaatatgttttacgtgtccccctcctgtaagctcccgctaccagcagcctgagctcctgatttcacttattagaagctctgtag

SEQ ID NO: 11881 - DNA, 1204 bp, Diabrotica virgifera
  misc_feature (14)..(67): n is a, c, g, or t
  misc_feature (92)..(128): n is a, c, g, or t
  misc_feature (140)..(185): n is a, c, g, or t
  misc_feature (188)..(201): n is a, c, g, or t
  misc_feature (246)..(264): n is a, c, g, or t
  misc_feature (266)..(287): n is a, c, g, or t
  misc_feature (289)..(337): n is a, c, g, or t
  misc_feature (373)..(407): n is a, c, g, or t
  misc_feature (414)..(444): n is a, c, g, or t
  misc_feature (577)..(598): n is a, c, g, or t
  misc_feature (659)..(684): n is a, c, g, or t
  misc_feature (708)..(708): n is a, c, g, or t
  misc_feature (724)..(756): n is a, c, g, or t
  misc_feature (760)..(779): n is a, c, g, or t
  misc_feature (794)..(832): n is a, c, g, or t
  misc_feature (835)..(873): n is a, c, g, or t
  misc_feature (881)..(951): n is a, c, g, or t
  misc_feature (954)..(972): n is a, c, g, or t
  misc_feature (974)..(1000): n is a, c, g, or t
  misc_feature (1022)..(1043): n is a, c, g, or t
  misc_feature (1064)..(1081): n is a, c, g, or t
  misc_feature (1109)..(1138): n is a, c, g, or t
  misc_feature (1157)..(1178): n is a, c, g, or t
tgtaaagatagaannnnnnnnnnnnnnnnnnnnnnnnnnnnnnnnnnnnnnnnnnnnnnnnnnnnnngattattgtgtattggggattgtgnnnnnnnnnnnnnnnnnnnnnnnnnnnnnnnnnnnnnaagagcttaaannnnnnnnnnnnnnnnnnnnnnnnnnnnnnnnnnnnnnnnnnnnnnggnnnnnnnnnnnnnntgttgttaagtatttctaattttttgataaataagttaattttgnnnnnnnnnnnnnnnnnnngnnnnnnnnnnnnnnnnnnnnnngnnnnnnnnnnnnnnnnnnnnnnnnnnnnnnnnnnnnnnnnnnnnnnnnngtaatttttatgtaaaatttaggatttaaaatttgnnnnnnnnnnnnnnnnnnnnnnnnnnnnnnnnnnngattatnnnnnnnnnnnnnnnnnnnnnnnnnnnnnnngtataaattttgattatttaattttagaagtgatgatattattagtattatagagttgaatatttagggaaagtatatgggttttatagaggaattaggtaacattttttttatctgtttattaaaggcatgnnnnnnnnnnnnnnnnnnnnnnagtatgtctgtatattgatttattggaatggaagcgggatttttgatgtgattaggtagcnnnnnnnnnnnnnnnnnnnnnnnnnngtggaatgtagggttggatgaaanaaaggttgattttagnnnnnnnnnnnnnnnnnnnnnnnnnnnnnnnnngaannnnnnnnnnnnnnnnnnnnaacgggaagaaattnnnnnnnnnnnnnnnnnnnnnnnnnnnnnnnnnnnnnnnggnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnnnnnnnnnngannnnnnnnnnnnnnnnnnngnnnnnnnnnnnnnnnnnnnnnnnnnnntttcagggggttaaacaagggnnnnnnnnnnnnnnnnnnnnnngaagaggtttaaaaaattcgnnnnnnnnnnnnnnnnnnggggcgggcgttttccaagtggttttgnnnnnnnnnnnnnnnnnnnnnnnnnnnnnnggggggggaacgagagggnnnnnnnnnnnnnnnnnnnnnngagtatgtgtgtgtgttgtgggggga

SEQ ID NO: 11882 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11883 - DNA, 446 bp, Diabrotica virgifera
  misc_feature (82)..(102): n is a, c, g, or t
  misc_feature (160)..(178): n is a, c, g, or t
  misc_feature (268)..(294): n is a, c, g, or t
  misc_feature (337)..(357): n is a, c, g, or t
  misc_feature (387)..(404): n is a, c, g, or t
gagagttaattagaattgagagagaatatttaatatatataagagatttatttagattttgggattagagtattatggatgnnnnnnnnnnnnnnnnnnnnngattatattgaatttttgaagagatgaaaagataaaatttgtattgagaaagaaatannnnnnnnnnnnnnnnnnnaatgaagtgatattagttttaaaatatatgaaagtgtttaagaaataaatgaaatttattgatgaagaatatatatatagataagtatgnnnnnnnnnnnnnnnnnnnnnnnnnnnatggatgagattaaaaataaagttttattatatgttaatttgnnnnnnnnnnnnnnnnnnnnngaatgttgatattttaaaatgtgttattgnnnnnnnnnnnnnnnnnngataggtattttgtatagattgtgtattagaagataaatttt

SEQ ID NO: 11884 - DNA, 494 bp, Diabrotica virgifera
  misc_feature (7)..(36): n is a, c, g, or t
ttttaannnnnnnnnnnnnnnnnnnnnnnnnnnnnnagcctttcggactaagatatattaataaattacaagatagaaacctacctgatgtcacaccggttaaaattcatatgatggctaatgctaaaagtccaacagacttaataattgagctgctactcgaggtgtgtacttttaatcctaaatcgaagtcctaatgaatattacccatgatatgatcacttactcaggtacgacagtaacgcgatattggatagcttagcctgtgacgatgattgatgaccagaggggcgagagaatcatgtggaaatgccagtccagtttcaactgtaacctatgataaaatctgaagtcactttaattatgttaaaagctgatgacaatgaagtggatgtcgaatgcctgtatttacatgtgggtcatgagttgcatggattttatgagaaaggagttttgctaaaattgtatgttgaccactaattttacattgggaa

SEQ ID NO: 11885 - DNA, 230 bp, Diabrotica virgifera
  misc_feature (8)..(8): n is a, c, g, or t
  misc_feature (34)..(34): n is a, c, g, or t
  misc_feature (91)..(111): n is a, c, g, or t
  misc_feature (122)..(145): n is a, c, g, or t
  misc_feature (186)..(218): n is a, c, g, or t
accttagnggatacagcgtaattttattgggagnaagtcaatcgataataaagattgcgacctcgatgttggattaaagttaataattggnnnnnnnnnnnnnnnnnnnnngtctgttcgannnnnnnnnnnnnnnnnnnnnnnngagttttaacccggggtgaagccaaggtttggtttctattnnnnnnnnnnnnnnnnnnnnnnnnnnnnnnnnncgaaaaggaccc

SEQ ID NO: 11886 - DNA, 650 bp, Diabrotica virgifera
  misc_feature (2)..(589): n is a, c, g, or t
  misc_feature (591)..(610): n is a, c, g, or t
  misc_feature (612)..(649): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnncnnnnnnnnnnnnnnnnnnnnnnnnnnnnnnnnnnnnnna

SEQ ID NO: 11887 - DNA, 374 bp, Diabrotica virgifera
  misc_feature (167)..(209): n is a, c, g, or t
  misc_feature (250)..(269): n is a, c, g, or t
tactgtacaaaaaacatcatgaatcatttgatcgcaaagacagatagcccactgcctagacaccagaaatatcacgtaagaaattatatacatatattcaaatatagtattgattaaagaaagtgacatttatgactatcaattattttgatataagtggatggtannnnnnnnnnnnnnnnnnnnnnnnnnnnnnnnnnnnnnnnnnntgagacatctcgtatgcatacactcgtcatgaattgcatannnnnnnnnnnnnnnnnnnngattaccaactgcttaataagctatctgacttgcaggatacatacagggcaatgacaaatttaatattatataaacagtctatatgaatgaatcattgataagat

SEQ ID NO: 11888 - DNA, 293 bp, Diabrotica virgifera
  misc_feature (34)..(34): n is a, c, g, or t
  misc_feature (49)..(69): n is a, c, g, or t
  misc_feature (71)..(71): n is a, c, g, or t
  misc_feature (75)..(75): n is a, c, g, or t
cgggcagtaaaggcgtccggaaaaagtagagggngatgaaaaatccccnnnnnnnnnnnnnnnnnnnnngnaaanttgtgtaatatttgttgaatatgaaattttggatgattattaggattatgtttaggaatttaaattattatagggatatttttaggtatatattaatgggtaaatgtagaattagtatttaatagagttgataatatttgatgagatgtaaattatggttgattaattaaaagatttgatggaattggagaattatttttatgtatttggttataatt

SEQ ID NO: 11889 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11890 - DNA, 1007 bp, Diabrotica virgifera
  misc_feature (14)..(844): n is a, c, g, or t
  misc_feature (857)..(878): n is a, c, g, or t
  misc_feature (892)..(928): n is a, c, g, or t
  misc_feature (931)..(975): n is a, c, g, or t
cctctcaggcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaaagacctannnnnnnnnnnnnnnnnnnnnnaggtttttttggannnnnnnnnnnnnnnnnnnnnnnnnnnnnnnnnnnnnggnnnnnnnnnnnnnnnnnnnnnnnnnnnnnnnnnnnnnnnnnnnnnctataaactttttgcaccccacttttttttgg

SEQ ID NO: 11891 - DNA, 389 bp, Diabrotica virgifera
  misc_feature (28)..(47): n is a, c, g, or t
  misc_feature (102)..(126): n is a, c, g, or t
  misc_feature (213)..(238): n is a, c, g, or t
  misc_feature (252)..(279): n is a, c, g, or t
  misc_feature (281)..(294): n is a, c, g, or t
  misc_feature (307)..(321): n is a, c, g, or t
  misc_feature (324)..(346): n is a, c, g, or t
ttgtggatttgtgtatgagtagataagnnnnnnnnnnnnnnnnnnnngattatattgaaattagaagagataataagataaaatttatattgaagaaagaannnnnnnnnnnnnnnnnnnnnnnnngaagtgatattagttataaaatatatgaaatgagttaagagataaatgaaatttattgattaaaaatatatatatagataagtatgnnnnnnnnnnnnnnnnnnnnnnnnnngatggatgagattnnnnnnnnnnnnnnnnnnnnnnnnnnnngnnnnnnnnnnnnnnagattataatttnnnnnnnnnnnnnnntgnnnnnnnnnnnnnnnnnnnnnnnagataggaattttgtataaattgtttattgaaagataaatttt

SEQ ID NO: 11892 - DNA, 529 bp, Diabrotica virgifera
  misc_feature (45)..(69): n is a, c, g, or t
aattacaccataacctcaaaattatgacatagaaaattttatagnnnnnnnnnnnnnnnnnnnnnnnnnacgcaaaagtggaaaattatattgctttcttccacttactggattatttgatgcagataaagtacagaacctaacgaagacagaacaaaacttggataaaactgagataagcagtaattcttcataaacaggatgtgataaatttgaagaaatgtgtgaattagatcagattttcatcctaagaaaactacttgggtacactgagctaatgatctgattgaggataatcctatacataaccaaatatggatatgtaactaatgatgactagtacgacgcagataatactcaaattgctagatattttttgaaatttatgatagatttctacatacaattgcccaaatttatgagcgtaccattgtaaatattgattcagacaaacggaagatatatgatagcataaattgcacttggattataccctgccatacttataagtgaaatatgatcaaactta

SEQ ID NO: 11893 - DNA, 883 bp, Diabrotica virgifera
  misc_feature (259)..(280): n is a, c, g, or t
  misc_feature (812)..(829): n is a, c, g, or t
  misc_feature (833)..(850): n is a, c, g, or t
ccctccacgcgcccgaaggtaaaaagcgaagtaataaagagcccccaactccgatgaagatgttgctatcgggcctgccataccagaggccgaaaagcccaaaaaacgtaaagtatccccacatgaacagctttatttggacagtttaccttctgcagaatcatatgagaggagctacatgcacagagacgtcattactcatattgtggtaacttgcacagattttatcatcacagctagttgtgatggtcacatcaannnnnnnnnnnnnnnnnnnnnnggcattgagttcgtgaaacactttagaagtcatttaggacccattgtgaaaatagcctgcaattgcgaaggaacactgctttgttcagcatctgttgatagatcgctgaagatttttgatgtagtaaattttgatatgatcaacatgattaggttagaatttgtacctggaacaattgagtggattcatggatctggagaaccgatacatactttggctgttgctgataaagccactgctaggatccatatatacgatgggaaagatggaaaagcacttaccgtttttgaaaaaattcataccagtcctgttacattgatcaagtataaccccaaatatgatgtagtgatatcagctgaccagaaaggcatgggtgaatattggcatggaagcaagcatgactatggtggtcccaaaaatataagatttgattccaaacttgacactgatctggttgaatttgccaaaaataaaatggttccaaatggattagttttttcccatggtggaaaaaaatttggcacaatttccnnnnnnnnnnnnnnnnnngggnnnnnnnnnnnnnnnnnnggagaaaatgatttttaaatttgggggggaaaa

SEQ ID NO: 11894 - DNA, 55 bp, Diabrotica virgifera
  misc_feature (12)..(53): n is a, c, g, or t
taagttttttannnnnnnnnnnnnnnnnnnnnnnnnnnnnnnnnnnnnnnnnngg

SEQ ID NO: 11895 - DNA, 438 bp, Diabrotica virgifera
caattacagtattatttttcatcctagctaaataatgattgataatgacgcggaacatagtgcgtaatagtctgaataccattacactggacatgggtcccgaggctgactagatagaaatgacgtgttaagtatatgcaaattagaatgaggagatacttggggattgactatcgcaataataaagcactcaataggttgatgctattgccatgttatctaatgagttcatactctaagacatggagtgtattaagttagcggctacctccaagatgagatatcgatagaatactgtctatataaatttctctgtagaggattgacgagggatgtgatgggctataaaggcataatggcgtgagaagtgaaaaagaaactaaggattaaataaacacgtacgccagacctatactgataatatgtggaaccagatat

SEQ ID NO: 11896 - DNA, 102 bp, Diabrotica virgifera
  misc_feature (4)..(100): n is a, c, g, or t
attnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngt

SEQ ID NO: 11897 - DNA, 144 bp, Diabrotica virgifera
  misc_feature (2)..(73): n is a, c, g, or t
  misc_feature (84)..(102): n is a, c, g, or t
  misc_feature (104)..(117): n is a, c, g, or t
  misc_feature (128)..(129): n is a, c, g, or t
annnnnnnnnnnnnnnnnnnnnnnnnnnnnnnnnnnnnnnnnnnnnnnnnnnnnnnnnnnnnnnnnnnnnnnngatgagggtgnnnnnnnnnnnnnnnnnnncnnnnnnnnnnnnnngaaatttattnnttagtaaaagcttaa

SEQ ID NO: 11898 - DNA, 615 bp, Diabrotica virgifera
  misc_feature (21)..(38): n is a, c, g, or t
  misc_feature (41)..(71): n is a, c, g, or t
  misc_feature (86)..(143): n is a, c, g, or t
  misc_feature (270)..(295): n is a, c, g, or t
  misc_feature (313)..(348): n is a, c, g, or t
  misc_feature (358)..(379): n is a, c, g, or t
  misc_feature (457)..(476): n is a, c, g, or t
  misc_feature (535)..(552): n is a, c, g, or t
  misc_feature (554)..(575): n is a, c, g, or t
atctatattttatatctatcnnnnnnnnnnnnnnnnnngcnnnnnnnnnnnnnnnnnnnnnnnnnnnnnnncgatacctcatcacnnnnnnnnnnnnnnnnnnnnnnnnnnnnnnnnnnnnnnnnnnnnnnnnnnnnnnnnnnctccggcactattacttaataattctctatttctcattctcaaatttaaaacagctaaaaccttcagattttcattgtaaaataaatatgtcaagtcatttttttgtaatgacatgctatccccccnnnnnnnnnnnnnnnnnnnnnnnnnncaacttaactctatttcnnnnnnnnnnnnnnnnnnnnnnnnnnnnnnnnnnnnctaatattcnnnnnnnnnnnnnnnnnnnnnnctcataacatcttatcaaaatctaattcttacataaaaattatgattaaaaactttcatcattttaacatatggtacnnnnnnnnnnnnnnnnnnnngatttctatgttctataaatttcctatcctcatatcaatgtaaattatttagagttatnnnnnnnnnnnnnnnnnncnnnnnnnnnnnnnnnnnnnnnncaaactatatatgactaatagaggaattccgcaacatttt

SEQ ID NO: 11899 - DNA, 509 bp, Diabrotica virgifera
  misc_feature (2)..(42): n is a, c, g, or t
  misc_feature (44)..(79): n is a, c, g, or t
  misc_feature (91)..(104): n is a, c, g, or t
  misc_feature (106)..(195): n is a, c, g, or t
  misc_feature (224)..(238): n is a, c, g, or t
  misc_feature (241)..(257): n is a, c, g, or t
  misc_feature (259)..(274): n is a, c, g, or t
  misc_feature (355)..(372): n is a, c, g, or t
  misc_feature (438)..(450): n is a, c, g, or t
  misc_feature (452)..(471): n is a, c, g, or t
gnnnnnnnnnnnnnnnnnnnnnnnnnnnnnnnnnnnnnnnnnannnnnnnnnnnnnnnnnnnnnnnnnnnnnnnnnnnncttttgtacccnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggtgatgaaccgatattcgtctctcgnnnnnnnnnnnnnnncgnnnnnnnnnnnnnnnnncnnnnnnnnnnnnnnnngtataattaaatctttttatattattcatattaaatatgatcagggatgagcttaatactaaaattttattaacatataannnnnnnnnnnnnnnnnngcttaaacatgtccatgtcttataaaatgttatcaattatatttatatatgatcatccttatttcnnnnnnnnnnnnncnnnnnnnnnnnnnnnnnnnngtgtaaattaagagcagatgacattgttgatattggaa

SEQ ID NO: 11900 - DNA, 715 bp, Diabrotica virgifera
  misc_feature (36)..(65): n is a, c, g, or t
cccacgcgtccggttagattataatattttagaggnnnnnnnnnnnnnnnnnnnnnnnnnnnnnnaatgactatgaatgccatattatcaaatttctccaggttaagtcttaaagccccaactctggcaaggacaatttgtacaaataaaccactagcttttaaattcactccagttttgctcgctgaacctttgaaaaagaagaagagacttgaccctgcaattgttaaagctcgagaagaaagaaaaaaacgaaaactagaaaagcaaatcagaagattggaaaagaatgcacggaagttaaagcctatagaagaatgcgaaccaccatttgaagttttagatacgatgcagacccgtaaaagaaatcttgcagccctttctactgaaactttagagcgtagagcactattgcagaagaaatggtgtcattacaagagagaggagcatttaagagatatgcagatgttagatagaatggtatattcccagcaaagggcactagatgaacttagaaaagagtctgaagaactttatcaagaagctatacaatttgattttcatttgatgccttttacaagccaaggaccagtcgaaacaccacctatagaaaattacaatagtccagatggagatttatcagatatatccaaaaagtggtagaatatcagttttgttaaataaattctagattaaacattaagttttaatggtg

SEQ ID NO: 11901 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 11902 - DNA, 1082 bp, Diabrotica virgifera
  misc_feature (95)..(114): n is a, c, g, or t
  misc_feature (153)..(185): n is a, c, g, or t
  misc_feature (194)..(803): n is a, c, g, or t
  misc_feature (815)..(897): n is a, c, g, or t
  misc_feature (918)..(994): n is a, c, g, or t
  misc_feature (1002)..(1080): n is a, c, g, or t
cgggtccgggaatccccgggccctcccctcggcgtccgcgagacgcggcgggttttctcttctctttccaatcacaaatcatctttttcgtaaannnnnnnnnnnnnnnnnnnncttaacggatagttaattagtatccgtgagagaatcatnnnnnnnnnnnnnnnnnnnnnnnnnnnnnnnnngtacctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgaagggtgnnnnnnnnnnnnnnnnnnnnnnnnnnnnnnnnnnnnnnnnnnnnnnnnnnnnnnnnnnnnnnnnnnnnnnnnnnnnnnnnnnncgagaaagaccctattagagnnnnnnnnnnnnnnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnnnnnnnnnnnnnnnnnngc

SEQ ID NO: 11903 - DNA, 248 bp, Diabrotica virgifera
  misc_feature (18)..(54): n is a, c, g, or t
  misc_feature (129)..(148): n is a, c, g, or t
  misc_feature (191)..(230): n is a, c, g, or t
acctttagggataacagnnnnnnnnnnnnnnnnnnnnnnnnnnnnnnnnnnnnngattgcgacctccgatgttgggattaaagtttataattggttggaacaagcttttttttttaaggtctggttcgnnnnnnnnnnnnnnnnnnnntgattttggagtttaaaaccccggggggaggcccaggttgggnnnnnnnnnnnnnnnnnnnnnnnnnnnnnnnnnnnnnnnnaaaccaaaaggggaccaa

SEQ ID NO: 11904 - DNA, 600 bp, Diabrotica virgifera
  misc_feature (22)..(42): n is a, c, g, or t
  misc_feature (44)..(401): n is a, c, g, or t
  misc_feature (403)..(456): n is a, c, g, or t
  misc_feature (458)..(516): n is a, c, g, or t
tataacgtgcgtccggttatcnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnattggatgaagaaacaactggctttatgtaatctataaagaattacttctctaccagaccacagctattggtattttatatcac

SEQ ID NO: 11905 - DNA, 780 bp, Diabrotica virgifera
  misc_feature (8)..(779): n is a, c, g, or t
cccttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 11906 - DNA, 549 bp, Diabrotica virgifera
  misc_feature (443)..(460): n is a, c, g, or t
ccttacacgcgtccgaattacctgacgaaatagatctcagtccttacattgaaggacgataagaatttcaagatctttcttgtacttcgttcaatattttggcatctccctcttctgatacgaaagtaatggctagacctttggtaccgaaacgtccagctcgggctactctgtgcaggtaagtgtcagaatcttcgggcatgtcatagttgaagacgatgttcactctatcaatacacattcctgggccaaaaaattttctggctactacaatcctcttctgaaatatattgaactgctcataccaacatccttcatatttttggcatgtacgtctgcctcttcctatcattggcatggatatgtctgagccaaaatatatcccagatcacacaaacttgtgcggatgttacaatacagtccaactgatagaactcccaaannnnnnnnnnnnnnnnnnactcatgattcatatcagattcttttactttcacataatgaagctgtacaacatgttctgtaaatatatcttcaacattaaaatatact

SEQ ID NO: 11907 - DNA, 860 bp, Diabrotica virgifera
  misc_feature (743)..(743): n is a, c, g, or t
ctcgggattcgaaaaaaaaagaatcccatttaaatagcattggagtcgaaagtttgcgcctatccccttaaacaaaataatatcaattttaaacattttcctccagtccacttgaatttatctgtatttctattctagcataacttgcaggtgttccatatttcaagtttgttatatgttgttcctgtttaaacgattccggacaatgttatcaactcttaagccggactcaaatgactcgtgtacttggcgaataatcgtcacttgcgtatacttgccatgtcgtctgagtgggttactcgtacaattatttgtcactcgttcgtcttctaactgttgtcggtaaaaatgacccgagtcaaagggatcacgattattcgtacacttgcgaagtacatacttgtctatacttgcagaggcggtcaaatgaaatgtataaataattggcatttactgcgactattcatttagaccagtgcatttagctctaaaaacacagggataaattgatttttaaatacactacctagagacttgctagttttgcattgcgttcagatgtcgggaaaaaagtctacaatagaaaaaggggtggaaatgcctaattaataattgctttttaaagttcttaacatgcattaaaaagtgtcaaaatgtcaaaataagcataaaaacacagggacaggaaaaaagtctacaatagaaaaatgggtggaaatacctaattaataattgctttttanagttcttaacatgcattaaaaagtgcataaacatgtcaaaataagcatattaagggccgagttttgtactcgcgagggttttgaggtcgctgaacatgactacgctatcaaaaccta

SEQ ID NO: 11908 - DNA, 235 bp, Diabrotica virgifera
  misc_feature (2)..(122): n is a, c, g, or t
  misc_feature (137)..(156): n is a, c, g, or t
  misc_feature (177)..(177): n is a, c, g, or t
  misc_feature (194)..(234): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggaaatgaggggnnnnnnnnnnnnnnnnnnnncttatttaattccataagaantttatttttacgttacnnnnnnnnnnnnnnnnnnnnnnnnnnnnnnnnnnnnnnnnng

SEQ ID NO: 11909 - DNA, 610 bp, Diabrotica virgifera
  misc_feature (16)..(35): n is a, c, g, or t
  misc_feature (55)..(473): n is a, c, g, or t
  misc_feature (483)..(502): n is a, c, g, or t
  misc_feature (504)..(516): n is a, c, g, or t
  misc_feature (537)..(557): n is a, c, g, or t
  misc_feature (590)..(609): n is a, c, g, or t
cttaacttggtgttgnnnnnnnnnnnnnnnnnnnntgccgccctttttagggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcgcctggnnnnnnnnnnnnnnnnnnnngnnnnnnnnnnnnnacgtggtaaggtaggataatnnnnnnnnnnnnnnnnnnnnngtggagtgaagggtgggatgaaaaaataactgnnnnnnnnnnnnnnnnnnnng

SEQ ID NO: 11910 - DNA, 294 bp, Diabrotica virgifera
  misc_feature (226)..(244): n is a, c, g, or t
  misc_feature (254)..(275): n is a, c, g, or t
atggtggtggtttaggatatggaggtggctatggaggagatattggtggaggtggatatggaggaggtggttttggaggatggggtaggtttattgatgttaaatttttaggataaaggggatatttataagtgaaataagtgtgaggaaatgttgatgtttttagtatttgtgaaaatttagagattttagaataagttaagaaaaaagatatagttatttatgnnnnnnnnnnnnnnnnnnngaaatggaannnnnnnnnnnnnnnnnnnnnngtgaagttttttgggttag

SEQ ID NO: 11911 - DNA, 341 bp, Diabrotica virgifera
agaaagggtggagggtaggggggaagggagggagaaagagtgggtttttctgaaaaaagaaaagggaaggagagggggaagagatagaggggagagaaaggaaaagaagaagggaaaaggaggaaagaaggagaaggtaatcaaaggagaagagaagaacaagggggaaaaaaggggggaggagcggaaggggatatatagggtaaggcatagggtgatggggtagatgtggagaaaaaagagagagatgtagaaggttatgctgaggagggggaatgtagagggtgtgatggatgaagaaaggtatattggaatgtgtggtgggaagagaaaagggaaaa

SEQ ID NO: 11912 - DNA, 476 bp, Diabrotica virgifera
  misc_feature (64)..(83): n is a, c, g, or t
  misc_feature (148)..(196): n is a, c, g, or t
  misc_feature (336)..(356): n is a, c, g, or t
cccacgcgtccggcaacaacataataggtatcatgaagtacaatatcaattgaggagtttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 11913 - DNA, 420 bp, Diabrotica virgifera
  misc_feature (223)..(235): n is a, c, g, or t
  misc_feature (237)..(251): n is a, c, g, or t
  misc_feature (253)..(266): n is a, c, g, or t
  misc_feature (268)..(281): n is a, c, g, or t
  misc_feature (336)..(360): n is a, c, g, or t
cgcttgtgtgtcatggattattacccctccccatatattaataatttacaaatttctaagaggtatagaattaaaattctcgattgcgaaataaatatatcaattaattctcgttgcaacgaacatgtgattcctaatttaaacatatctaattctataagaaataacttaaatttctctattaccactatattaatgataaaatattattctattattcaannnnnnnnnnnnncnnnnnnnnnnnnnnngnnnnnnnnnnnnnncnnnnnnnnnnnnnncatacatatttggattaaggattttcatatttcatactatgtcattatatattgnnnnnnnnnnnnnnnnnnnnnnnnnatcaatttttcattacaatatccctttgaattatttacatttagcaatgatgataatatt

SEQ ID NO: 11914 - DNA, 629 bp, Diabrotica virgifera
  misc_feature (15)..(81): n is a, c, g, or t
  misc_feature (105)..(128): n is a, c, g, or t
  misc_feature (206)..(223): n is a, c, g, or t
  misc_feature (577)..(595): n is a, c, g, or t
ccgtaaaggcgtccnnnnnnnnnnnnnnnnnnnnnnnnnnnnnnnnnnnnnnnnnnnnnnnnnnnnnnnnnnnnnnnnnnntggtctttattccccaaatttccnnnnnnnnnnnnnnnnnnnnnnnnacacaaaacatatttaaattcctaacccaacttaaaaataacatggctttaaaaaaatattatcacaaaacttccctnnnnnnnnnnnnnnnnnncacatttcaaaaaaaccttataactataacaaaaagccatgagcgaatcccatactcaattattaaaaaaaccagtaatctaggaaaaaaagggtgaaccccccaaaaaggacggaaaaacgggtttattttaaatttttctacgggtaaatttttcttaaaaaaattccttccggaaccccccctttcatccatttaaaggggggaaattgggggttttgggagcctccaccgctgtttcctactctaaaggggtgacggattttaaaaaaaacttaattctttgaagaatttcaaaagtaaaatgggaccattttgaaaaatgaagggaattatcccaaaaaacgaattgannnnnnnnnnnnnnnnnnnacagggggcattttcctcttgggcctccatcaaa

SEQ ID NO: 11915 - DNA, 343 bp, Diabrotica virgifera
cctttaacgcgtccggggaggagacagcgcaaatgcccccttttaagagtggaaggagaaataactgatacctgtggtacgtggaggtggagggctgaggcgggagttgttcgcctagggagcagatggcgattcgaccatgggctgtgggaagaaaacataggacagataagatatttgatttagcactgaagcccactccaacactccaattattacgtataaaattgcatactggatggattaaatattggccaataagaatttctaagataatgatcaaataagatgacgtcaatccctaagaccatgtttagcatgcagacatttatagagtgagcgt

SEQ ID NO: 11916 - DNA, 751 bp, Diabrotica virgifera
  misc_feature (2)..(45): n is a, c, g, or t
  misc_feature (53)..(84): n is a, c, g, or t
  misc_feature (90)..(166): n is a, c, g, or t
  misc_feature (179)..(731): n is a, c, g, or t
  misc_feature (747)..(747): n is a, c, g, or t
cnnnnnnnnnnnnnnnnnnnnnnnnnnnnnnnnnnnnnnnnnnnngtacctcnnnnnnnnnnnnnnnnnnnnnnnnnnnnnnnntcatcnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaagctttaattnttta

SEQ ID NO: 11917 - DNA, 793 bp, Diabrotica virgifera
  misc_feature (56)..(80): n is a, c, g, or t
ccctccacgcgtccgaatgtgtggcttcttaacacggggtctcgtttatgcatttnnnnnnnnnnnnnnnnnnnnnnnnngctcacacggccaagattattaaaaattgtaaaggtaaggaaacaaaaacaggattatacataagagtaaaaggacttaacgattgagaaagggaagagagcgggaaaataacaaaaaacggcggctcttgtgtaaagggctgtgaatttgctgtatcagatgcttcgtattttgttcttactttgttaactgaccatatagcattgaagtcttttcatgtacaaattctccagcatgttgtatttctttggaatgaagaattccgctgaggatggatttggctgcggttgattttttgaggaatatttgtatacattttgaactatttattggacaaagtatctttgctgagcaaagtagacttttttgcttttccctttttggaacttggtaaacttaaaacgattgaaaattcttgccaatttgcaaacgtgttgtaaatggagtctagtttacgaagaaaaaagtctgaaaggtatattgaagtactccacttgccttcagccatggcacccactaaaaactaacaaagtggtgcacgtctgtggatctggatgaaaacaaaaaaagacccatatgattgcatatgtgtaacacactttaatttttgttgtggaccgctggcttataaaaaatacttaacacaattgacaaaagaaaccccttaaagactccccagccccatggaaatttgccttgtggccccaaaaat

SEQ ID NO: 11918 - DNA, 343 bp, Diabrotica virgifera
  misc_feature (17)..(17): n is a, c, g, or t
  misc_feature (27)..(28): n is a, c, g, or t
  misc_feature (52)..(52): n is a, c, g, or t
  misc_feature (55)..(56): n is a, c, g, or t
  misc_feature (65)..(66): n is a, c, g, or t
  misc_feature (74)..(74): n is a, c, g, or t
  misc_feature (80)..(80): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (95)..(95): n is a, c, g, or t
  misc_feature (104)..(104): n is a, c, g, or t
taaagttttaaggtggntattaatganntgttaaatatcttaaaaccatatnatnntgaattacnncgagatgntagaantctgttananantcnaaggaaaantattctacaaccaataaattccggtcactatgttcactttggattgagaaattgtttgcaaaaactactgtctcagtattctggaacagagtctcttgatactgtagaaattttaattaatatagatggtcttccactttcaaaaagttcatccagccaagtgtatccaattttatgcagtttatatccgaaacaggggccacatgatataattgcaacatttaccgactcatgaaaat

SEQ ID NO: 11919 - DNA, 388 bp, Diabrotica virgifera
  misc_feature (127)..(139): n is a, c, g, or t
  misc_feature (141)..(153): n is a, c, g, or t
acaatattaattgatgactctgcaccatttcattgtgactcatccactaggaaaagaatatgctatctagaacactatccatcctactagatttaccctattgacaggtataccataaaataactgnnnnnnnnnnnnncnnnnnnnnnnnnnagatattgtagtaaaattaaccttcttccatcaagaatttttacgaagaataggaatacctatagcaatatcagattatcctgatgtatttatataatgaaatattgtatcttcaattggattactaatttcttaaattatgatataattcttaattattattatttgagaagctttttcatcaaaacaccatagaaaaaaacctataacacaaacttcatctctagaatgacca

SEQ ID NO: 11920 - DNA, 826 bp, Diabrotica virgifera
  misc_feature (86)..(103): n is a, c, g, or t
  misc_feature (433)..(451): n is a, c, g, or t
  misc_feature (658)..(658): n is a, c, g, or t
  misc_feature (684)..(684): n is a, c, g, or t
caaattgtttattacaagtttattaccatgagagtgtatataatattatttagcgtcttttgcttgagccattgcgctccacaggnnnnnnnnnnnnnnnnnncagaacaataccaaggtcaacacataccaattgtaaggcaagaacaagaagtgaattatgatggcacctacgaatacaactttgaaactggaaatggcatagtccaagaagaaaaaggatttttgaaaaacgccggtacaaaggaagaagctcaagtcgctcaaggtttttcctcatatacttcccccgaaggagtaaaaatagaactccggtacatcgcagacgaaaacggtttccagccaatcggagaccacctaccgactccgccaccaatccctgaggctattttacgagcgctaagtgtactgaaacagttgggtaatttgaatnnnnnnnnnnnnnnnnnnnacaacattagatgaagagagagtgtgatcaaatcgttattttggataagtcccttcatatttcaaaatggtaccatactaactatgaaatacttcaaagaattaagatctttttaaaatacgtcaacactttagagtaggaaacagcggtggaacctcgcaaaatgtacacaagttcggttttatttttttgcaggaaaatcaaggngtgcttataatgaaactaacattttnctaaaaaatttcgcccctgaacccccctttttatccctttgaaggggggtatttgtggtttttgcgaaacgaagcccttcctgtatacgttttacaaaagaatgtactaaatagtaaaatgaagaggactataatttgctac

SEQ ID NO: 11921 - DNA, 612 bp, Diabrotica virgifera
  misc_feature (2)..(232): n is a, c, g, or t
  misc_feature (240)..(256): n is a, c, g, or t
  misc_feature (258)..(305): n is a, c, g, or t
  misc_feature (307)..(327): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttacnnnnnnnnnnnnnnnnngnnnnnnnnnnnnnnnnnnnnnnnnnnnnnnnnnnnnnnnnnnnnnnnncnnnnnnnnnnnnnnnnnnnnngattttagggaagggcatcacaattaaacgttgcttgcaatttaatttctagacaaaacttgggaataaagtttcacatattgtattagtaagtgattattactgcgactatattattagaccaatgcattacactctttttctcaggatataattgttgtattatttacactacagatatgctggctatatttgcattgcaatactgtgtgtttaataagtctatattggataaaggcgtggaattcgctaacttatttttgctcctgcttattcttaacatgc

SEQ ID NO: 11922 - DNA, 585 bp, Diabrotica virgifera
caagggagaggctcgaaacaccagaagagggagaggagaagaaaaaacggaaacaggagaaagccaaactgtgaagccttgggaatgttattaaagcatgcaagaagactatatggattatgttgcggaatcgaaacagtgaaaagatcatcatgcttattggaaaccgcatatttgaatgagacggctttcgtgtgacgtgtctatgtcagctcaagctctccctgagtcatctactatggaaaacatgtgaattaataaacacctatatatctaacttgatcttaccatcttgtaaatattagacatagttacagatcgggagctaaatgataaagttgtgttagaacttgactcttaactctcgacactgagctccttatctctgtattttctattaaggaacctatagtatacgccatcaagagtctacagaatgttctacatcggtttgagcaatgatgaagaatgatctctgcttactgaagaaaccccatctggcgaagatcctgctgacgaagctggtgatggaaaaatgtctcccgtatgaaaaaagaacaataaatgctttcattttaagagcat

SEQ ID NO: 11923 - DNA, 622 bp, Diabrotica virgifera
ttaaggtgtcctggaagaagagtgagagaaatacaatcccctctaatgaaatactcgactgttacgacatcactaagccggttgatttgaatttaagccaatttctcttttactttttctgttccgtatttaatttattgaaagtttttgttaattgttcgacgagtgtattcaaaatgccgccaaatgtaacaactgtgtccactgtatctccactaaaagtagccatcatcggtcaaagtgccttcgctgtcgatgtcatgcacaaactaaaccaacatggacacatcattgtaggagttttcactattgtagataagggaaagagagaagatcctttagctaaggctgcagcggaaaatgacataccagtattcaaaataaaactatggtgaagagacggaaagcctataccagaagtacttgaacagtacaaaagcgtgaatgctgacctcaacgtactaccatactgctcccagtttattccaatggaagtgattaactaccccagactaaagagcatctgctatcatccatccatcttatcaagacaaagaggagaaagatccatcaattggaccctcatctgaggggccaaaaaggaagggcttttcatcttttt

SEQ ID NO: 11924 - DNA, 609 bp, Diabrotica virgifera
ccctctcacgcgtccgatttagataactttgaatatatataacctgttacggagatgttgaagaggaagtacgacaacaaagcattaaaagcaagtaaagcggcggaatctcttaatgacaccctctggatgaacaaacacctaagatgagacacaaatttaacaatctatacaggtgactttatacctatattgtcctaccctcacggacacaatagctgatacatctaaagagagaccgctacttgactgttcagctacgaaatcctccgtacgactatctattcaaatatgttgattcataatagaacgcaatgcatgcaatcgttgattgtgcaggatataaggcattaccagaacctccgtaacgatagaaatgcagaacaggttataagaaagctacaaaatgtaccatctgggcttatacggacattggcggttacgagctgtaataagatattactgaagtctaatgcaagaagggaagcatactactattaatgttttggtgaacaaccactaagatctgtctataaacacacgttgttcatgtgtcgacagcattcattatgaatctcgttactctggtagagcgagttgaccacattt

SEQ ID NO: 11925 - DNA, 741 bp, Diabrotica virgifera
gtgaagcgtggctcgaaatcgtggaactttcgagactcgctcgaactgtagatccttccttgtccctgtacttagttagacttaactggacttaaccttactttgtttattgttttgttaagcttagcttaagctcgatgctactttctagacttagttcattaaatcggtataagaatttaaatataaaaacttataataattaccagtgctattttgtaaaatatatccaatcaaaagcaatggctgttacaataaatgatgcagtaaggatattaaaatccattgctcctttaaatttagccgagggctgggacaacgtaggtcttttggtagaaccctcagaaaataaaacagttcgttcattgttattaacaatagatttgactgaagatgtggttgaggaggcaattgaaaataaatgtcaattaattgtagcctaccatccaaatatttttaaacccctcaaatccgtcaaccaagaacattggaaacaaagaattataataaagtgtatcaaaaatgatatagcagtatttagtcctcacacttcatgggactcaatgcgtaatggtgtaaatgaatggttatctacagcatttgaagtggaatatagtagacctataactgttaatgcaaacgattcttctgggcgaactggcataggaaggtacatcacattacaatctgccatatcattgaaaactgctatagagttggtcaaagacctcataggacttc

SEQ ID NO: 11926 - DNA, 243 bp, Diabrotica virgifera
cccacgcgtccgctattatcgcagatgatacgtctagtttggagtggctagaatctgactcagaggatgaagatgttagtgatgataatgacgatgaggaggaggacgtcgacgaagatgaagactcggatgagtcagaaatggaagttgattgacagtgttattgaaaagtgccgataaaaggaaaatattttgttataagttgtctgtgttacattttataataaaagttataactcttct

SEQ ID NO: 11927 - DNA, 280 bp, Diabrotica virgifera
ccctttctcacctcccccgaaagggggtataagaatattccctccccctctctagcattcatggggccattttgtaggtccttggcgaaccatcagccttgcgggagagcctaatatttgtataaaacattttcgcgacgagatgttgacctttgttagcaatatctactcttataagaaataacttaagtgtctctcttatcacgatattattgagaaaatatttttacattaccaaaaccaaacatggtgagggaggggctctcctagaagcattact

SEQ ID NO: 11928 - DNA, 88 bp, Diabrotica virgifera
  misc_feature (13)..(13): n is a, c, g, or t
  misc_feature (40)..(41): n is a, c, g, or t
  misc_feature (64)..(65): n is a, c, g, or t
tttgatccaattntttttgatataagaaataattaccttnnagggatagcgtaattttattggnnagagtcaatcgataataaagatt

SEQ ID NO: 11929 - DNA, 892 bp, Diabrotica virgifera
  misc_feature (53)..(76): n is a, c, g, or t
  misc_feature (292)..(315): n is a, c, g, or t
  misc_feature (328)..(345): n is a, c, g, or t
  misc_feature (379)..(401): n is a, c, g, or t
  misc_feature (627)..(647): n is a, c, g, or t
  misc_feature (726)..(745): n is a, c, g, or t
  misc_feature (774)..(774): n is a, c, g, or t
  misc_feature (812)..(859): n is a, c, g, or t
caaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgngatttatccaatgatttcctttatttacaggtataaannnnnnnnnnnnnnnnnnnnnnnnnnnnnnnnnnnnnnnnnnnnnnnnggtgtaaatttaccttcttccctcaacattttt

SEQ ID NO: 11930 - DNA, 794 bp, Diabrotica virgifera
atgttattcaacgagacattaagagtaattgttattctctatataactagctgcataatacaatcaaagcagtcgttattcgttattaatacgttgattagtttgttaaaataatgtgtgggcaagcttgtgaagcagtctcattcgtttgtgcacttcccattaaatttgatctgataagccacatgcatcagcaataattgtttgtttattaatcttaaatgttgtatttctgtaatttggattagtttggtgtgatatcaattataaacagtgggtgtttaataataataaaactgttttgaagttcttttacgagaaaaatatatttttcgattaaaccaaatatactgcgtgagaagcctacgataggaaagtagaattaatggttcccccacttttattctattgttgacactggtgttcagaaaacttcaacatatccaaaatggacaacgatcaaatgaaattggagcctatgggtcccaagggacgacaaaacaaccaatcagccgagaatggaggtgatgactttgatcctcatatgtatagacaaaatgaccgcccaacaacgaacatggaaactcttatccatctactgaaaggtgccataggaaccggaatcttagccatgccagaagggttcaaattagccggaatgataaacggaatcgtttctacaattgttataggacttctcagcacatattgtttgagagtattagtacaagctcaatatgaattatgtaaaaggaaacgagtgggactcttaacttatccagattctatgagag

SEQ ID NO: 11931 - DNA, 663 bp, Diabrotica virgifera
  misc_feature (16)..(16): n is a, c, g, or t
  misc_feature (18)..(18): n is a, c, g, or t
  misc_feature (31)..(31): n is a, c, g, or t
  misc_feature (34)..(34): n is a, c, g, or t
  misc_feature (43)..(43): n is a, c, g, or t
ttcttactgagggggncnggtgtggaggagnggnggttgaagngctctttgaatggagagggaatgaggtattatatagtgtgatgtaaattgaagtgggtgggggtagttttagaaagtgttgagtgggagagtattggggataagaagatgagtggtgttggaggaaatttgaatttaggagattggtgaaataaggaagaggttagaaatgatagatattaagaatagttgtggagatggaatggtgaatgggatgagttttgtagatggggaattaagaagtggagggtgtggtggaagaggtagatgtgaaagttaaagttgagggaggaagtagaggagatagtttgtgttgagtgtatatttttgttgagatgttagaggaattgttgagtagagatataaattgggggatatgtttagggtggggattgagggatttaggggattggagatgaaaaaaattgattaggatgatgattgaagtaatgggagattattttgatagatggtttgttggagattgatgatggagtgtatgttattaatagtgaagtattgttgaatattggaataatagttaagagtattttggtatattgatttgatttataatgtattttggagagtgaggattattggataaaaaatgaggtgatg

SEQ ID NO: 11932 - DNA, 911 bp, Diabrotica virgifera
  misc_feature (176)..(195): n is a, c, g, or t
  misc_feature (268)..(288): n is a, c, g, or t
  misc_feature (291)..(303): n is a, c, g, or t
  misc_feature (466)..(494): n is a, c, g, or t
  misc_feature (739)..(739): n is a, c, g, or t
aggttgtgtatcctgtatgtatcatttaagtaagtagtaagtgcaagttgatagcaatattcttaagtatagtggactaaaaacttggcttggatcgcatttcatcaacgcgttataactatactgaaaataacttaaatgaggcaaagcattttttgataagataggttaacagnnnnnnnnnnnnnnnnnnnnatttctatttttagtgtataaaaattctgtctgtctgtattttgtctgtctatctaatcaaatggtaattgannnnnnnnnnnnnnnnnnnnncgnnnnnnnnnnnnngagtgtgacaatctattttaagcaatgtttctatagtatcatagaatattttctagtttttaaaatcaaagtatatctttggttgacacagaccaatactagggagttataatcagtcggtctttaactagatctagtattataaatctaatgataattgacnnnnnnnnnnnnnnnnnnnnnnnnnnnnntcgtagtttagtcttacaggtatctcaaaattccgagttgaatttgtgcagattgtaccgacttaaaaattcttttttgggataaacggtgttgaaaataattttggagatgcgtttgcaattgaaatgaatagaaaatatgttgaatgttttgtattttgagaatgattttcgaagtgtagatcctaagtgaaaagtcaaataaacttattttaaagtaaaattgtggcttattcccgctgaanatagtaaattgcatgaagatgcccacagaaaataggctaagaaaatattaagatcgggaaacattaagtctctgaatcactatcttcactttgatactgtgaaataatactgatattactggtgacacccgtgtattaatggtaaaattccagggttttcaaaaaaggtatg

SEQ ID NO: 11933 - DNA, 911 bp, Diabrotica virgifera
  misc_feature (195)..(212): n is a, c, g, or t
  misc_feature (216)..(235): n is a, c, g, or t
  misc_feature (354)..(372): n is a, c, g, or t
  misc_feature (401)..(416): n is a, c, g, or t
  misc_feature (418)..(437): n is a, c, g, or t
  misc_feature (439)..(486): n is a, c, g, or t
  misc_feature (488)..(583): n is a, c, g, or t
  misc_feature (587)..(735): n is a, c, g, or t
  misc_feature (737)..(804): n is a, c, g, or t
  misc_feature (812)..(909): n is a, c, g, or t
ccttaaggcgtccgttttattttattgtgaattttgattccttttcttgcggttctttagtaacacaccgatactttttatttaattacttaataattcctattacattaattgtgtgataaatatttatgtaatgcttttgcagttctttggttatatttactcttcaagaatgttgaaaacatgtttttgagnnnnnnnnnnnnnnnnnncccnnnnnnnnnnnnnnnnnnnngaaaattatctaattaacgtggaatctaaaatgactgtctataaagtcaacatttcaaaataccatacgatatcaattttgtgtatatgattatatgttataattgtggtttatatagnnnnnnnnnnnnnnnnnnngaaatggttattaaaatatacctttaagnnnnnnnnnnnnnnnngnnnnnnnnnnnnnnnnnnnngnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnggggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 11934 - DNA, 875 bp, Diabrotica virgifera
  misc_feature (442)..(460): n is a, c, g, or t
  misc_feature (645)..(666): n is a, c, g, or t
  misc_feature (788)..(788): n is a, c, g, or t
  misc_feature (808)..(808): n is a, c, g, or t
gaacaacaaatcattacacaaatctcgtactcaaatctggtaacgaataacttcaattatcttttgctgttggaattctgtagctccattcttttgccgctgttttcagtgccgtgaacgattgaaccaggtctgcttttcttcttcctttgatatcaatgtcgtactgcatacgctagtatttctacactcctattaataatggttcttcttgttgttattccagattcactaatagctttctctagggaaattttaaatagaagccacgacagactatctctctgtcaaagtcttgtttctgtctggaaaattcttgatactccgttcagcactcaggccgcacatcaaagaaacatgaaacgtgaaacactaaacgtgaaacatgaaacaaataaattgtaaaaaacgtaaccgtttcatgtgatatgctaatcgatgnnnnnnnnnnnnnnnnnnngtagtctgcaatggatagtgacgtggtcgttgctgtcggcgccgctctttaattgcttttttattaaaggaacgtaaaacataaaacgtgaaacatgaaacaaataaattgtgaagaacgaaaccgtttcatgttatatattgtagaaaacagaggttgaatttcccaaactcgacacaagtccnnnnnnnnnnnnnnnnnnnnnnatcaagggatgcttttaatgagactaactttttcttggaagatttcgccccggaacacccattttcatccctttaaaggggatagtttggtggtttttgcgaaacgtagcccttcctgtacngtatttgcacaaatttcttnatagagatatgaagaggactatatttcctacgatttattccgcgacagcatatatctatcacacacc

SEQ ID NO: 11935 - DNA, 594 bp, Diabrotica virgifera
  misc_feature (155)..(188): n is a, c, g, or t
  misc_feature (222)..(252): n is a, c, g, or t
  misc_feature (302)..(322): n is a, c, g, or t
  misc_feature (327)..(351): n is a, c, g, or t
  misc_feature (380)..(425): n is a, c, g, or t
  misc_feature (433)..(455): n is a, c, g, or t
  misc_feature (461)..(501): n is a, c, g, or t
  misc_feature (572)..(589): n is a, c, g, or t
ctttaccggagcgtccggaagttatttataataaacgcggtttctttttggacaattctaagtatttctgaggatgatagtataatatgattaagatggaatattgaatatgtatttcagaaaatagaatgtatttgtacattgtgtattggggnnnnnnnnnnnnnnnnnnnnnnnnnnnnnnnnnngaatttataagagctaaaattttaatagttttannnnnnnnnnnnnnnnnnnnnnnnnnnnnnngttgtaaaatgaatattgaattattaaatatatctaagtatttatgaagnnnnnnnnnnnnnnnnnnnnngaagnnnnnnnnnnnnnnnnnnnnnnnnnaggaaatttaaatatatgaaggaatgagnnnnnnnnnnnnnnnnnnnnnnnnnnnnnnnnnnnnnnnnnnnnnnggcttagnnnnnnnnnnnnnnnnnnnnnnngtatgnnnnnnnnnnnnnnnnnnnnnnnnnnnnnnnnnnnnnnnnngaagttatgtaaacataagaagaatattattgagatttagttatgatgataatattaggaagatagaatannnnnnnnnnnnnnnnnnggtac

SEQ ID NO: 11936 - DNA, 553 bp, Diabrotica virgifera
tgtacccattgtttgtttgttttttcggcattgatgattttttattttaacaatgaatataatacatgattcagatttattgcaaagcaatgagtacactttaagttctcattctcatagtcatctaggagaaagtgccgatgtcactagacgtagaagctcaaatcgttctattaagcgaaaaaagttcgatgatgaactagtggaatacagccttgggatgcccggtatttctaacataaagggtggtcgagctcgcacacaatcagctcatttagaacttggggtagcttcaccttctacgcctcccgttcttccacctcaaccatctacttctcaagtcttcatagatcacaaaagaaaacaagtgtcaaaaaatgtattaccttcttcaaaacgtggaaagaaaactggtaaacttggagggcagtacactgcaaaagacctgggaagatggaagccagtagatgatttggctctgattattggagtacaacaaaccaatgatttgcgcactgatcacttaggtacgaagtattactgtaagtgcact

SEQ ID NO: 11937 - DNA, 728 bp, Diabrotica virgifera
  misc_feature (2)..(44): n is a, c, g, or t
  misc_feature (52)..(164): n is a, c, g, or t
  misc_feature (174)..(671): n is a, c, g, or t
  misc_feature (673)..(673): n is a, c, g, or t
  misc_feature (679)..(679): n is a, c, g, or t
  misc_feature (681)..(726): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngntggatngnnnnnnnnnnnnnnnnnnnnnnnnnnnnnnnnnnnnnnnnnnnnnngt

SEQ ID NO: 11938 - DNA, 807 bp, Diabrotica virgifera
  misc_feature (7)..(583): n is a, c, g, or t
  misc_feature (585)..(605): n is a, c, g, or t
  misc_feature (607)..(630): n is a, c, g, or t
  misc_feature (632)..(645): n is a, c, g, or t
  misc_feature (649)..(673): n is a, c, g, or t
  misc_feature (778)..(796): n is a, c, g, or t
ccctatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnncnnnnnnnnnnnnnnnnnnnnnnnngnnnnnnnnnnnnnnacannnnnnnnnnnnnnnnnnnnnnnnngcctgccccctgattaatttgaatgggccccggtttttttgaccgcggttagggaacattaatcattagctttttttttgaaagcctgttcttaaaagggttggnnnnnnnnnnnnnnnnnnncttttatttgg

SEQ ID NO: 11939 - DNA, 769 bp, Diabrotica virgifera
  misc_feature (13)..(32): n is a, c, g, or t
  misc_feature (468)..(486): n is a, c, g, or t
  misc_feature (631)..(631): n is a, c, g, or t
  misc_feature (755)..(755): n is a, c, g, or t
gtaattattacannnnnnnnnnnnnnnnnnnngatcacccttcaaggccccttcgttccagttttcatggttctgttgcctttggttctctaaatatttctaatatgccagttatctgcctcaccctatatagtatagtttgttccttttgactgagtcgtatacctgtttgaagtcaacaaacacgttgtgaacattaagcctgtctgatactctccaataatattttctgctagtgattggagccgctggtttataatatatgtgaggactttatatgctgtacatagtagagaaattcagtcaaaacagaactacgagtctgactcggctgagattttgacataagccttttacaagaatgtattgataggaaatttctcttgtggtggtggcgccatcgggcggagaggctaagtacttatcggaccacccactatattgatctgtccatattttattgagatnnnnnnnnnnnnnnnnnnnaactttggttgtgatttttcttttctgatttctagcagctattctgcttcgtgtacttttatattatacctcaataagcttatgttttagccgcgttcatgtaattttaatcgtacacctgtacagtggcgcacctagaattgtncttctgggggggggggcaccgaaatttttttgtattgtttgtgaaagacaagttacattttctcttattactatgttactattattcatatatttttttatgggtctgggggggggggttttanccccccaaaacccc

SEQ ID NO: 11940 - DNA, 1215 bp, Diabrotica virgifera
  misc_feature (217)..(235): n is a, c, g, or t
  misc_feature (316)..(336): n is a, c, g, or t
  misc_feature (340)..(365): n is a, c, g, or t
  misc_feature (405)..(442): n is a, c, g, or t
  misc_feature (444)..(466): n is a, c, g, or t
  misc_feature (476)..(505): n is a, c, g, or t
  misc_feature (527)..(595): n is a, c, g, or t
  misc_feature (621)..(645): n is a, c, g, or t
  misc_feature (671)..(694): n is a, c, g, or t
  misc_feature (763)..(778): n is a, c, g, or t
  misc_feature (780)..(899): n is a, c, g, or t
  misc_feature (1129)..(1147): n is a, c, g, or t
  misc_feature (1169)..(1201): n is a, c, g, or t
ccgtacacgctcccgccagcgggcataaaatcgtgggaatcctctctttcgctgccccgagtcactattttttagggaatgaacttatgaaagggctggctagagacggacatgaagctactattttgacggttttggaatgaaagacaccacctaatgaatactatcagtagaagtaatatgttaggtttctctattcaacaatagatttataatnnnnnnnnnnnnnnnnnnnaatattcaaacatttttagggagcgagcttaagaataacattttctccaaatttactttttaaataaacaccaggattatnnnnnnnnnnnnnnnnnnnnncggnnnnnnnnnnnnnnnnnnnnnnnnnnctttatttgttataaatgttttactacaatatacctttgnnnnnnnnnnnnnnnnnnnnnnnnnnnnnnnnnnnnnncnnnnnnnnnnnnnnnnnnnnnnncatataggcnnnnnnnnnnnnnnnnnnnnnnnnnnnnnnccctgattattaaaaacacgcnnnnnnnnnnnnnnnnnnnnnnnnnnnnnnnnnnnnnnnnnnnnnnnnnnnnnnnnnnnnnnnnnnnnncctaaagcagcataatcattacttcnnnnnnnnnnnnnnnnnnnnnnnnnccggatgaaacaaaaactgcctttcnnnnnnnnnnnnnnnnnnnnnnnncttagttaaaaagcctaaaattttttttcaaagacccgaagaccctataaagatttataaaaatcatcnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaataaattaccctcaggggatacagggggaattttattgggagagtcccaatcccaaataaaaaattgccccccccccaggctgtgattaagatcttctaaatgggggagagcggctaatttaattaaaggcgggtcaccatttttaaaattttcacaatgaaccggaggtttaaaacccgcgggggaggccccgggggggggttcttttcttccttcttttttttannnnnnnnnnnnnnnnnnntcccccaaaaggggcccccacnnnnnnnnnnnnnnnnnnnnnnnnnnnnnnnnnttctcttttacaac

SEQ ID NO: 11941 - DNA, 624 bp, Diabrotica virgifera
  misc_feature (151)..(172): n is a, c, g, or t
  misc_feature (226)..(248): n is a, c, g, or t
aaggaaagaaagatcttagtttaacgcacccctaaatagcgagtgggacgaggatattctactctttataaaagagacagttatgcttatgtaccccgtgaatgaggggtattaagtccataaccatatatttataagtctcgaatggaannnnnnnnnnnnnnnnnnnnnncaattggaaaataaatacctgtagaccagtgtttgtgtaatagaagatgcctannnnnnnnnnnnnnnnnnnnnnntgaatcctttctgggtaatacgagactgcatctattcattcacaatgtatttatagtctagtattattattaatattagatatctttacgcatgagcttaagccatgatatttcattagaatcgatctttctcaatcagaatcaagactccagattctcatatgtcaaaatatgccactattaagctcgatacattattattctactcttctataaatatagtactaacaaatcaatgtgactgattcacccagtgggagtgatgatgcatattaacattaagctcgtgtctctttgataaacatatacaggtctagtcatagaattccgccacatatttttcacctgcgtcttaacaacacgcctgtttggatta

SEQ ID NO: 11942 - DNA, 126 bp, Diabrotica virgifera
  misc_feature (8)..(9): n is a, c, g, or t
  misc_feature (16)..(78): n is a, c, g, or t
  misc_feature (80)..(124): n is a, c, g, or t
ttttattnnttaagtnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnngg

SEQ ID NO: 11943 - DNA, 171 bp, Diabrotica virgifera
  misc_feature (4)..(56): n is a, c, g, or t
  misc_feature (66)..(167): n is a, c, g, or t
gggnnnnnnnnnnnnnnnnnnnnnnnnnnnnnnnnnnnnnnnnnnnnnnnnnnnnngtaaaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattg

SEQ ID NO: 11944 - DNA, 857 bp, Diabrotica virgifera
  misc_feature (586)..(604): n is a, c, g, or t
  misc_feature (715)..(715): n is a, c, g, or t
  misc_feature (793)..(793): n is a, c, g, or t
  misc_feature (804)..(804): n is a, c, g, or t
ctattgttaaggatactttacgtattgcctaaacagaaagtactaagaggaaaatctcttatacagtcgacctatattcatgtaggtagccatgtacataggtcgtctactctttagcattcttttggatattatacctacatttttggggttccagttttctcatattctttactcctacaatccacgtttcgattatgtacagttttgaatgagctatatcctcattcattacctaagtgtttttactcattttttcgatacattcatttatttagtaaacattacaatacctaggaattatagcttacgccatcgcattcaaacccccattattgggtgaggtggattgctcatctatgtcatttatagcttgctgtgtgtccttgatgctgtcgtggctctttttcatttctgcctgtccttgcactgaactttccaatctttaacattgattgttcatatatgcctcatcatccagccattttttctatgtcttcctctacacctgggccatagtggtatccaattagttatccctcttaacatatctgagggtgggtgtctctttatatatcttatccannnnnnnnnnnnnnnnnnngtatctgactttggctttagttattcttcaatttcggcatttgttttcactcttctttctccctctcttgttacattgtggcccagtatcattctcattatttttctttcnaatttcagaaggctatcttcctcttttttgtaatcattgatgtttccatcccatatgtaacgacatgtcttatatagngtcatctttgntctcttacttagaatcttgcttctcagcagattactggtcatttcatgttttt

SEQ ID NO: 11945 - DNA, 817 bp, Diabrotica virgifera
  misc_feature (615)..(639): n is a, c, g, or t
  misc_feature (737)..(755): n is a, c, g, or t
cgagtttgtttttggatgttcctttcaggacccaggcttcactgccataacatgttattggttgtgtgtgcagcctaagtgtgattaccagaaagattttttattgagccagtccggttgtaacttttcgccctagatgacagataacaagatggcttcctctacaaaacgacagttcaaaggcgccgacgagtgtcactattgcttatttttaatactgtggtttaggttagaatatctcagaaaccagactcaatttggcaatttgaaattcggattctgcgcacagaaaacggatagcacctgaaaagtatattcggatctctgggttcgaatattggtcaaattttgtcgacttgtgttattataaaaaagtattttacttattaaacattttgtgctatcttggttcaaattgtaagggacgtattgtcgaagcgaagatcggtggaatatgcgcattttatcaatgaaattcgatatttttaagatattccagaagccgctatagataaaatgttttaacgacctattaatcattcataattattcaacggatattagtacggttaaaataattaagacgataaccggacaacattgatttaatgagtnnnnnnnnnnnnnnnnnnnnnnnnngacaaaaagagcaagcccattagcagaacccaattaaaaattattttgcacatcatatttgaaacattatttggttgaaaaatctcatttttgttggnnnnnnnnnnnnnnnnnnngtttggactaaattaacgttgtgcttatcttaaaaagatatgttagtatcaacattcgcaca

SEQ ID NO: 11946 - DNA, 602 bp, Diabrotica virgifera
  misc_feature (72)..(93): n is a, c, g, or t
  misc_feature (124)..(153): n is a, c, g, or t
  misc_feature (156)..(171): n is a, c, g, or t
  misc_feature (331)..(348): n is a, c, g, or t
  misc_feature (446)..(465): n is a, c, g, or t
cccactcataccaatattttttattctgaggagagaagaatttcatctaatgatagttacttattattgtgnnnnnnnnnnnnnnnnnnnnnnccagaaacattccttttttgcaccttgagcnnnnnnnnnnnnnnnnnnnnnnnnnnnnnnccnnnnnnnnnnnnnnnngcagagctcacagatcacaatttttattgtacataaatattcaaatactctttttgaatgaagtgttattcgtttttaaatatctctacttttttaaaaagtcacttcaatttatctattaccaatatattccatgattccatatttttcatcattatcnnnnnnnnnnnnnnnnnnggacatgaccttagcaataatattttattcacctttcattttcaaatagaacttaagattaaacagtttcctattgtacaacatgctattatttatcnnnnnnnnnnnnnnnnnnnntttcctatacattttctattaaaatataaagttagattattataacctaccgaccgatcataatattatgactgagatgctgtatatatagaatgcatatgtaagcataccattcgcattcggcatcatctttttca

SEQ ID NO: 11947 - DNA, 779 bp, Diabrotica virgifera
  misc_feature (545)..(565): n is a, c, g, or t
  misc_feature (692)..(692): n is a, c, g, or t
gttccttcagtcgaaataacaagtggacaggtttaccaatcaagtttgtcttttctttttcgtagagttccgattccgaagggcggtattttataacgaagccgacagttgattcgtagcgttagtagctcgattttcgtgtgtttgtaaaaacaaatttgtgatttttgttgtgcctgaattggttgtagtctattaataccggcgccatgggagagagctttagtagagctgtccaaccagaagagttggctgtgttcaagaaactgccgacgaatactctcttggacaacatcgaaattccagaaaggcctgaaaatcggacacccaccgatcgaaaatttattattgtctttgcagtcgcgataataattctgtttccgttccttatatacaccatggtgtactctgattttagccgttttaagggctatgaccaatgtggtaatgtctgtggaaagcaaaataagaagtacgaccagtggtcttgtactggagcagattacacaaactttccgtatttacaatacgagaccagcgatagnnnnnnnnnnnnnnnnnnnnnattgttaaccagtagaaaatgtgttgcacagtgcgaaagcggacatgttaaagtaggtctctactgttacaaggacggctcgcattcaagttttaattctcggtacaacagttttaattctcgtttncagagagatacctacgaatctgtggaagagattgaagcaggtctatctgctttcttaacaaacatgcctggagaattgtattggcct

SEQ ID NO: 11948 - DNA, 287 bp, Diabrotica virgifera
  misc_feature (5)..(40): n is a, c, g, or t
  misc_feature (42)..(67): n is a, c, g, or t
  misc_feature (73)..(95): n is a, c, g, or t
ccttnnnnnnnnnnnnnnnnnnnnnnnnnnnnnnnnnnnncnnnnnnnnnnnnnnnnnnnnnnnnnntcgtannnnnnnnnnnnnnnnnnnnnnngatagaaaccaaccatggctcacaccggatttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 11949 - DNA, 621 bp, Diabrotica virgifera
ccgacgcgtcggctgaaacgacgacctagaacacatctcagaacactttagagattcagctagaaacccccaccgatgcccccactgaaacgcaccccgaaactcacccaaatcatcacattcccgccaccgtaaacacgacactcgctgagattactgcaaagaatggcacaaagagaatcaccaaaaaaccaaaaggaagactctgatgaaaaaatcaagcaccgagcaaacgagtgtctatcaaaggatcactagattgcaaactttacaacgaccaaaaaactttcatctaaagtctctacagatgtagataaatccaacgataaagatgacttcgaaaaaaccatataactcaccatacatgtcaaactactcttcttactactatcagtatgcaccttcgaaaacacctacgacgacatgaacgtcatcatcatgtctttcatcctcccttacttccaccgcgactcacacatcaacactcgaatcaaatgcagcatcaatatcatcataatgattggaatgatggcatgaggctacgtatgagactcattagcacactcataggtgcttatagagatgctcattgtgagtgccctcatgatagcactatgtata

SEQ ID NO: 11950 - DNA, 445 bp, Diabrotica virgifera
gaaattgtctgaggttgaaggtatcgacttattcgactaatctttaaaagaatgtgtagagcgcctgaacccccgtagttgcgtctcagcgctcttttgccaaaggtgccaagcgacaatacgatcgcatgcttcttcttctcctcgcaagctacgtatattgtagctgcactttagacgataaatctctattactctcttagatcatgtttatgtagatgattctactatgcttctctcatcatctctcacattgaaagtagccgtactttgtgcgtacttaatgcctctaccatatcctcataatcgatagatatggagacgcgattataagagaactacccaatgaaccatctgactcctactcgcataggtggttaggagatgatatgatcgtttacgaaattcgaatgcaagaaatatcgcatactaccttaaatatttt

SEQ ID NO: 11951 - DNA, 781 bp, Diabrotica virgifera
  misc_feature (3)..(678): n is a, c, g, or t
  misc_feature (680)..(769): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatctttagtt

SEQ ID NO: 11952 - DNA, 645 bp, Diabrotica virgifera
cggacgcgtgggatgatttttaacgaacagttgtgttgttaggttatttaatgtctaaacttccaattctcgtgattttcaacaagagaagaaccagaaacagaaaataatacaaatgaacagatgagtcagtcagaaatacttttattttaaataggtaacctatttttaagatctttatttataggatctctagaacgaacgagaaaactctgccggaaaagttatgatataaaagcatgtgaggttaagtctcgggtaagaaagtagtgaattaaattgatataaaatttcaatagaaatggaaaatgaaattcaagctgaagtttttaaagaacaaggaaatactgcatttaagaatggtgattgggaccaagcaataaacctttactcaaaagctattaacctctctaaagaaaatactaaaattatatctgtttattataaaaatcgggctgctgcatatttgaagcaagaaaactatgaagcagcgctacaagactgtgataagtgtttacaaattgttccaactgatgctaaagcactctttataagatgtcaagatctggaagcactacaaaggtacgaagaagcatataaggatgcgacacctatattcaaagatgatcccacaaataaacgcat

SEQ ID NO: 11953 - DNA, 238 bp, Diabrotica virgifera
  misc_feature (7)..(44): n is a, c, g, or t
  misc_feature (57)..(57): n is a, c, g, or t
  misc_feature (81)..(103): n is a, c, g, or t
  misc_feature (111)..(134): n is a, c, g, or t
  misc_feature (165)..(192): n is a, c, g, or t
  misc_feature (207)..(236): n is a, c, g, or t
taacagnnnnnnnnnnnnnnnnnnnnnnnnnnnnnnnnnnnnnntgcgacctcgatngtggattaaagtttataattgggnnnnnnnnnnnnnnnnnnnnnnntgttcgannnnnnnnnnnnnnnnnnnnnnnnagtttaaaccggggtgagccaaggttggttnnnnnnnnnnnnnnnnnnnnnnnnnnnngtacgaaaaggaccnnnnnnnnnnnnnnnnnnnnnnnnnnnnnnat

SEQ ID NO: 11954 - DNA, 881 bp, Diabrotica virgifera
  misc_feature (540)..(560): n is a, c, g, or t
  misc_feature (789)..(790): n is a, c, g, or t
gatttctgtatttatcgatcttcgatgtggttttgggattttggggtttataaacagtattttatacttagtttaagtattgtccatttcatagtgtaaaatacataagacgtgattaaaatcaaatgaaatggaagtaaaacaagaatatggtgaagacgcccgtaaagcagaaatatattctaataacatagatgacgatgctcttttaaatacccttaaatgtgaaattaaaaaggagcccagtagagaaagtacagatggcacttttgattatttagacttaaaagaattccctataaagactgaagcaaaagatgaaagtgaactttggcaatttgaagaaaaacaaaataatcaaaaggatagcagaataaaagctgaaattaaggacgagtttgatgaaggtgatccaggagatatagagagtcagctatcgacatcacttgatctggaagtctgtaaaaatgagtatacctcagggatttctcagatgaaattattggaaatggaagttatgaagaggattcctgaagattnnnnnnnnnnnnnnnnnnnnntaactgtaagctctgaagaaactgcattaaaaaattctatttgtgctaaagattcccccaacaaaaataatttaaatcaacatacgaaaagttggattggagaacctcacgaatgtgaaacgtgtttcaagcagtttaatgaaacacgtaaattgaaaagacattgtttaaaagtgcacattggagaaagatcgcataagtgtgacatttgttctaaggagtttactanncacagtactttgaaaatgcatatgagagttcacactggcgaaaaaccttataagtgtgaaatttgttctaagcaatttagtcaagaggaaa

SEQ ID NO: 11955 - DNA, 772 bp, Diabrotica virgifera
cttctgggcgcgtccggtgaatgcattcaagtggcattggactgagattttgcgcctatctcctaagtttttactgcgaagatattgtttccaacgctttacatattagtgtaattcatttccatttgattcatttagttgatttttggatcaatccactcctacattgggaattcacttgccacctagatatttcttggagcatataggtcgttccaatttattccattccaaccaagttttaagggttgatggtgtggagcaaatcctgaccaatgcaattgtctgacatacaaatcatttagatatttcaaaaaggtaattgctgaaacagctgtaagagaaaaggcttctgtaaagaacactaactcgtacttacttgtggagagattcctacccaaactataaccaaccaatcgccaaatggaagcctttgagtaatacaaactggctgatattctttttcatatctgttgacgtccatctgaccaattaaagaaaaaacacgacccttttaaaaacattatagtgatcaaatccttagtacctattccaggatagtgaactttctgaatatgtagaaaaataagaaaactgcttatttggggcacatattacgaggagaacgataaactctagcaactggtactagaaggaaagagagagggtaggaggtttacgacgcaataagatgtcatggatgcgcaatattcttttataagtttatatctatcacatatacttttcttccaaagacgatcataaactttta

SEQ ID NO: 11956 - DNA, 540 bp, Diabrotica virgifera
  misc_feature (194)..(211): n is a, c, g, or t
actcacctcttctaaataacatctttaggattacatcacatatttagaagaggtgagtacgaaaaataaatactataatatggtaaaatcagtcatactgattaaatactctagtctctagtggacaagacgggaaaataacatcacaaccaaagaaattattctcttaagcaaatcattatattttcttcgtnnnnnnnnnnnnnnnnnncacttaaaaatacctttaacttacacaactgtatggtaatataatcgcatattaaaaggtcagttgattttttataactacgtgaatctaacgactactatacatatatataactaatatacgtgttcaatatcaatgtaatattgtaaattatgtatgaatgtcgactaaccttttaatagtcttataaaagtaaatttggaaatctatcgcctaaagtctaagctaagacattggaactttacacctccgctgttataatatgttatgtaaagttgacgtctgtattgaatatttgatattcttagtttagaagcatacaataggtg

SEQ ID NO: 11957 - DNA, 486 bp, Diabrotica virgifera
  misc_feature (136)..(155): n is a, c, g, or t
  misc_feature (292)..(328): n is a, c, g, or t
aaattttaggtaatgacattacagtagtattgtgagagaaccttggatttctataaaagaccacttaatttctagtaccgtgtgtatcaggtattagaaattacgaataatatagtcactattatcaaagttcgcnnnnnnnnnnnnnnnnnnnntttctcacggctaatcaagattttagatcattctcttggaacgaaatgatattcgattttaagtatatctaattctttaagatcacaaatatatttctgtattaacaatccattaataataaactatttttatatgnnnnnnnnnnnnnnnnnnnnnnnnnnnnnnnnnnnnngaaatctcattaaaatttgatcttataaataaacatgaggagtacacattgtcataatttaaaatatgttgctaattattctcatctatgattatcatttattatctataaaatctttattagaatataaatggtacttattccgagttagtaatgtc

SEQ ID NO: 11958 - DNA, 495 bp, Diabrotica virgifera
caattagttactgatgaagaaagtaaacgcaacattgatcctctacatggacgagagccatcgctatgcgccatccatcatgttgcacgcatcattactcattgactccttatccattggacatagcgatctagtaagagacctgctcccgctgctgagcaaagacaatccataccgttcctggcagaatcacatatactaactgggcgaatacgacactttctctctctccttatggacacacgatagatacttaaaaccatctacaatcatttttgtagaatttgctcctcggtcaaccgaagatgcctctagctacctggaccactcaattcacgcccgtggaggtatgatatccaatgtactaaagtataagactcacttctatactcttctcgatatctcgctgaatcaagcagtatcactggatcgcttatggaggttctctcctctggacacgcttctatgcattacccaagaggcatatccatattc

SEQ ID NO: 11959 - DNA, 911 bp, Diabrotica virgifera
  misc_feature (56)..(95): n is a, c, g, or t
  misc_feature (749)..(749): n is a, c, g, or t
gtagacttagcggctcgtatttccctgtgaattaatacaataaataataccagagnnnnnnnnnnnnnnnnnnnnnnnnnnnnnnnnnnnnnnnnggtcaaacgaaacattcgccttattaatagccaaaactacagaagatttgagcaaagtttctttagataattttatcacgaggagcaataattttagcgtcaaatttcctgtcgacagtggaagatgcaaatctttaaaagctagtgttcctccggagatacttgaacgaaatatatattccgtatattgtctgcttcatgagaatgtattagaactgtacagtaaatttatattacttaaaagaaaatatggatctaaggtcgaacagaatttttataaagatataggtctatatgaatttattgataggcttttaaagaatagagcagtcatgtttatgggaaaattggataagtacgtccttctggatggaaagaaaggacaaaatgattgggtaacaattggatccgtaaacgaacgtccacctcttgttctgaaaaattacatctcttacgatgaaataaaattatcagccttgctatcagtaagttcttattcatactttgtaaaccaaggcgacagaaaaaatatggcaaaattttccaccgatcgtacatctatcgctgatgaaggaattatagtaggagtaataggaccaagaatgaagaaaaataatgtaatggaataccaagaaattgtggctaccagaacancaaacacaaaagataatggttatggcactaacgttcaaaatagtgtcccataactcttttcagatttctacgaagaagattgcttagattttgaagaaacactaaaatatatcaaagatctaaaaaataaaggaaaaagatatgtgacattaaaaaccaaat

SEQ ID NO: 11960 - DNA, 746 bp, Diabrotica virgifera
  misc_feature (721)..(722): n is a, c, g, or t
aaataattaaacaataattattttagtattcactaaataaaattttactaaatatgttataaaatgtatagggaatgatgaatcctaaaaataatacaataagaatcacagtggtgggtgatggtgatacgggaaagacatgtatgttgatagtgtataaagataagaaatttgatgacagatatgtaccaactgtatttgatgtatattcaatgcttattccgataaatggagtcgaatataaagtgatactctctgatactgcaggtcaagaagagttcgataaactaagacgattagcttacaaagatgtggactgctttatcgtgacatacgctgtaaatgaaaagacttccttcgaaaacgttttcctaaaatgggctccagaactaaagagattctcgccaaaagccaaaataattttagcgggaaccaaaatggatctcagacgaaatcatccctcacatattacaactgagcagggagaagagttagctagagacattaacgctcacggttttattgaaaattcatccaagactatgagctttatagatgccacattccaaatggccatttcggctgttatgtataatagcaattaccttaaggtgaaaagggaatcatcgtgcatatgtttataaattatgaacatcattttaagaataaatactaaaacgtattttcaatgaacctatttatgcatattattaaaagattnncagtagaaaattaatctattactg

SEQ ID NO: 11961 - DNA, 472 bp, Diabrotica virgifera
cccacgcgtccgcctttgataacgctactggtatcttaggtccttgttattgtcggctgtaatacgccgaggccgaggataagaatagcgtataaggcgatgacatgaaacctaataaacgtggtctcctcagcttatgataccgatatggtggagattttgatattggttaccacttaggacaatgtgaatacgggattgacggtggttacactctatgattatgccagctagactatatgatcactacttctattgataagaccattactttggataaaggagaacctataccatacccagtatagagacacatcccttacccagataccaaacacgtaccttacccagtataggatcttgtaccacaaccatacccagtagataaaccaatattctactcagatatagtacatgttagagtaccagttccagttcctcaaccctaccccgctgtaaaaattgtccacgt

SEQ ID NO: 11962 - DNA, 123 bp, Diabrotica virgifera
tccttaaacgcgcccgagaactacttcaagcatggctgcctcttttagggaatggggttaaacgtgcatggggattatttgcaaataaagttattaattgcagattaattcctctgagggctc

SEQ ID NO: 11963 - DNA, 133 bp, Diabrotica virgifera
  misc_feature (44)..(66): n is a, c, g, or t
  misc_feature (96)..(127): n is a, c, g, or t
agttaataatatagctgctacaccaattataaagtctgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11964 - DNA, 728 bp, Diabrotica virgifera
  misc_feature (5)..(84): n is a, c, g, or t
  misc_feature (86)..(186): n is a, c, g, or t
  misc_feature (192)..(238): n is a, c, g, or t
  misc_feature (241)..(254): n is a, c, g, or t
  misc_feature (256)..(389): n is a, c, g, or t
  misc_feature (405)..(433): n is a, c, g, or t
  misc_feature (435)..(454): n is a, c, g, or t
  misc_feature (456)..(469): n is a, c, g, or t
  misc_feature (471)..(484): n is a, c, g, or t
  misc_feature (486)..(543): n is a, c, g, or t
  misc_feature (587)..(678): n is a, c, g, or t
tttcnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaacnnnnnnnnnnnnnnnnnnnnnnnnnnnnnnnnnnnnnnnnnnnnnnnccnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttactttttaaatacnnnnnnnnnnnnnnnnnnnnnnnnnnnnncnnnnnnnnnnnnnnnnnnnncnnnnnnnnnnnnnncnnnnnnnnnnnnnncnnnnnnnnnnnnnnnnnnnnnnnnnnnnnnnnnnnnnnnnnnnnnnnnnnnnnnnnnncatcacctcgtatatttactcaaaatatataggtctactcaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcgcggtattctgaccgtgctacggtatcatactcattagtttttttat

SEQ ID NO: 11965 - DNA, 526 bp, Diabrotica virgifera
cgccctcacgggcccccccttggaaagcgaacgacacccgccccctttaattgccaaagcagaaaattatttcacagacggtttttacattgtggcgtgggaatattttgtgaaaaaacttccgcaatttgcctttagaacctcgaggcgcagatgtccagaccttcgacttccaggctgaaatcgctccaatggagaacttgagacacaacacattctactctcatgaagaaaatcttctttgcagagtttgttgcaacctcctgacaagccttgtcaaaccatatcgaaataatcaacaaccagatcatattgattcatcactgggaaagatatgcacagttatcttgtataccactaccgagggaggggccttaggaatgatttgaagtgagagaggttattgaaaaagacatttgggtctccaacgagggacactcgttaaactaagaagtaaatggatttatttgattcctccaatatggtgatgcttcttgatgatttgtcattttgtgaaaagtttcta

SEQ ID NO: 11966 - DNA, 842 bp, Diabrotica virgifera
  misc_feature (7)..(24): n is a, c, g, or t
  misc_feature (32)..(52): n is a, c, g, or t
  misc_feature (82)..(117): n is a, c, g, or t
  misc_feature (132)..(150): n is a, c, g, or t
  misc_feature (152)..(164): n is a, c, g, or t
  misc_feature (215)..(234): n is a, c, g, or t
  misc_feature (245)..(276): n is a, c, g, or t
  misc_feature (279)..(307): n is a, c, g, or t
  misc_feature (315)..(355): n is a, c, g, or t
  misc_feature (363)..(376): n is a, c, g, or t
  misc_feature (378)..(408): n is a, c, g, or t
  misc_feature (446)..(464): n is a, c, g, or t
  misc_feature (492)..(543): n is a, c, g, or t
  misc_feature (553)..(592): n is a, c, g, or t
  misc_feature (656)..(683): n is a, c, g, or t
  misc_feature (696)..(757): n is a, c, g, or t
  misc_feature (774)..(793): n is a, c, g, or t
  misc_feature (799)..(839): n is a, c, g, or t
gggattnnnnnnnnnnnnnnnnnncgtaagcnnnnnnnnnnnnnnnnnnnnngtttagaatttattgtaattgctttatatnnnnnnnnnnnnnnnnnnnnnnnnnnnnnnnnnnnngaatattttcttttnnnnnnnnnnnnnnnnnnnannnnnnnnnnnnngttctttaggtttagcaattttaattataatagttcgtgtttatggtaatnnnnnnnnnnnnnnnnnnnnttctttatgannnnnnnnnnnnnnnnnnnnnnnnnnnnnnnnccnnnnnnnnnnnnnnnnnnnnnnnnnnnnnttcaatgnnnnnnnnnnnnnnnnnnnnnnnnnnnnnnnnnnnnnnnnngtagaggnnnnnnnnnnnnnncnnnnnnnnnnnnnnnnnnnnnnnnnnnnnnntcttatagtttaattttactaagattttgagtttgtannnnnnnnnnnnnnnnnnnaggaaaattatataaatatggaatttannnnnnnnnnnnnnnnnnnnnnnnnnnnnnnnnnnnnnnnnnnnnnnnnnnngtattttctnnnnnnnnnnnnnnnnnnnnnnnnnnnnnnnnnnnnnnnngattagtaccagttttattattaattattggttgaggttatcaaccagaacgtttagaggctgnnnnnnnnnnnnnnnnnnnnnnnnnnnnaatatcattaccnnnnnnnnnnnnnnnnnnnnnnnnnnnnnnnnnnnnnnnnnnnnnnnnnnnnnnnnnnnnnnatttaagtttaaatagnnnnnnnnnnnnnnnnnnnntaaatnnnnnnnnnnnnnnnnnnnnnnnnnnnnnnnnnnnnnnnnntgg

SEQ ID NO: 11967 - DNA, 99 bp, Diabrotica virgifera
  misc_feature (4)..(4): n is a, c, g, or t
  misc_feature (10)..(97): n is a, c, g, or t
attnttttannnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 11968 - DNA, 384 bp, Diabrotica virgifera
  misc_feature (57)..(74): n is a, c, g, or t
  misc_feature (325)..(342): n is a, c, g, or t
cccttccacgcgtccgattaaattgatttacacaataaatttctttaattggcgtgnnnnnnnnnnnnnnnnnnctattctaatataactatattaataaaccattatatgatccaactattttgactattataatatactaccttaagtgtaacagcgtatttttactgcatacgacccttcatactaatataatgatttgcacacctcaacggtgtattaaaggttattaattgctagtaacaactatattcatataattctgattcaactccctcacttttacatgatctgagattaaaccgtatgagagccttactgaatnnnnnnnnnnnnnnnnnngatatttataaacccaaggacacaactttataaaataatctc

SEQ ID NO: 11969 - DNA, 865 bp, Diabrotica virgifera
  misc_feature (722)..(722): n is a, c, g, or t
cctgcagcctgatttgcgataatcaaataacagtttttgtaatgttaatttattaatgatcgctatagtgatacaaagtagcaataagcattagagccaagcaaaatacgtaattaggtagttgaaacataggaattacgaatagtctcaataaaataaggtcaaaataaaattaagatgaaaaacgatacagtagaagatgaagatgtcgatgtatatcaactcattctaaaattaaggcatgaaacactacttgttaggacggagaaacgcaaaattgaagatttaaataggatacttagtgagaaaacacatgaaatcataagggactcatggattacaacgaagcagcgcttacttttgtaccaaagggaaagtactattcacaattaccaaaaagttgatcatctgcttaaatctgaattcattgatgctaaacaaaggataggatttcaaaccaccataaaattaggaaatctattgcaagttttgagatctcaacctgtgcagttagctaaatggttaatagcaggagaacagttggatgaagcacagacatactcattttttctagagaatatcatagtaggcttgtatggctgtctcttgttttccgaagacataaagtacatgttgtctttgctttatgaggtcgccaaactgcagttattgaactgtgaagatcccagaagaatcatcaagcaaagaacatgctcctttanacatctatactttttgttccatgaagtattacaatctgcaaaatttttcctgagcgcagctatggagatacctatagtccagatgatgtcatatactgattattatctagatctagatccagaaaagacaattatgagattta

SEQ ID NO: 11970 - DNA, 662 bp, Diabrotica virgifera
  misc_feature (16)..(42): n is a, c, g, or t
gcgtccgcgaaagatnnnnnnnnnnnnnnnnnnnnnnnnnnnaagtatgactattaatctataagttaaaatgagtgtatctttgatcaaagagtatttaatttattaaccttgatttatgctccgaaaataatttacaagaatagatgaatatttaagatgtaaaaataggaaatctaaacaatgttcgcgtaagctgctcgatcaatagtattagcattatctggatgtatgataaactatgttgttcttgaatagtattatcgtaattagtacccttttagacaggactttgagataacattatgccggtttatgatgattgctggacatggactcatttttacctagaagtttggaagagaatagacaaaaataacatgaagtggttatatgactttatgatgattattcttcgctacaagagagcggaacaatctgcggtttgagtttactattccttgtccttttgatatgtttctttagatgatgttcactgacatgtacatatgatatatggggattatgaggactagaataacgaaatagtgctctaaaatatataacatatcaaaaacttttaaatacctctggatattataagttgaacaagatactgaagcgtcaaaagatccaaatgcaggtgctgactgagaattaat

SEQ ID NO: 11971 - DNA, 804 bp, Diabrotica virgifera
  misc_feature (262)..(283): n is a, c, g, or t
  misc_feature (347)..(371): n is a, c, g, or t
  misc_feature (783)..(783): n is a, c, g, or t
cgtcagtaaaaaatacagttatttgacgttacaagtgtttttgatcgtttgaactattttaagaaacagaagactttaaatttgtacttcaaagttattatgaatttttaaagcgtgaaattttgaaaatctcatttttatacaaaactgaacattactatgtaataaaaaaatgtgcaagttccctattattgaaattaagtagattttatactttaacagaccagcagcaggatttttaacacatttcatatttcgcagnnnnnnnnnnnnnnnnnnnnnngtcttaaaataaatataatctacctgtaacactagttttactaatttacagttataattcaggnnnnnnnnnnnnnnnnnnnnnnnnntttcgttgtcatatttacagaaatatacactgtttttcagaaccacttatttttgggaaaagcgcaggaacacgtcaaatagtgtttgaatggggagacattgtgccatatttaagcttgctggggaaggcaccctctcattccctaactcaaggctttcaagcgccccggggcaagtaattttaagcgccccttttctccttcctttgtaagtagtcttttgcaacttaatgaatcggtatacggtatacctacaaactatttgatatgtgttaggaaagtaacatcatcacaatctagccgttatcgtccactgaaacacatagacctcctctaattttctccatgtctccctatcttaagctaccatcatttagttgccggcagttctttttacatcgtcactccagcngcgtggtggccgatctctgct

SEQ ID NO: 11972 - DNA, 237 bp, Diabrotica virgifera
  misc_feature (8)..(42): n is a, c, g, or t
  misc_feature (44)..(57): n is a, c, g, or t
  misc_feature (102)..(115): n is a, c, g, or t
  misc_feature (118)..(140): n is a, c, g, or t
  misc_feature (148)..(170): n is a, c, g, or t
  misc_feature (200)..(231): n is a, c, g, or t
ccctacannnnnnnnnnnnnnnnnnnnnnnnnnnnnnnnnnngnnnnnnnnnnnnnngagagttcaaatcgataataaagattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 11973 - DNA, 233 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (202)..(230): n is a, c, g, or t
tgacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaaggannnnnnnnnnnnnnnnnnnnnnnnnnnnngat

SEQ ID NO: 11974 - DNA, 136 bp, Diabrotica virgifera
  misc_feature (3)..(6): n is a, c, g, or t
  misc_feature (71)..(90): n is a, c, g, or t
  misc_feature (99)..(134): n is a, c, g, or t
ctnnnngccctcacggcgccccggccccctcgagacgaatgggaaaaccctttaacattcttaagtaaacnnnnnnnnnnnnnnnnnnnnctgatcggnnnnnnnnnnnnnnnnnnnnnnnnnnnnnnnnnnnnct

SEQ ID NO: 11975 - DNA, 157 bp, Diabrotica virgifera
  misc_feature (3)..(30): n is a, c, g, or t
  misc_feature (32)..(45): n is a, c, g, or t
  misc_feature (134)..(156): n is a, c, g, or t
ctnnnnnnnnnnnnnnnnnnnnnnnnnnnngnnnnnnnnnnnnnnaccttacggataacagcgtaattttattgtagagctcaaatcgatcataaagattgcgacctcgatgctgcattaaagttataattgtnnnnnnnnnnnnnnnnnnnnnnnt

SEQ ID NO: 11976 - DNA, 846 bp, Diabrotica virgifera
  misc_feature (61)..(79): n is a, c, g, or t
cgagaaacatgaggagactgttcattgtatttttcgtaactatcgtgtcatcccagaatgnnnnnnnnnnnnnnnnnnnctacaattattggtcagaacttgtgaaaaataatcttaacactacaacattttctgactcatgtagccaacaatttagcgaattatttacaaatgatttacaggatgtatggaatctttttgacgctacagcaaaattcccttggagtggcttagctaccggctcatattttgattggggaaattatgatcaatgcattaaaattaggcatgaatacacacaagacagaatattgggcaaatactgtacacacggtttactaataccatcccccaaagtgaacatttctaatccagattttcaggatttttataaattacgactatgtatgccagatgcctgcacagcagccgattataatgaactcgttcaattaataaatctcaacggtttattcatttttcaagatcgagcatgtcatacgaaagaagatctagacagatattcatgggaagatattactatggtggtcgtacttgtaatatttgcatgctttatggtggtatcaactatgtacgatgtataccttaaattgaataaaaaaaaatctatacatcccatatgtgtggcattttctgtatatacgaatggccggaaaattattcacacgtctaaacataacaaagaacaaattcaaattattaatgagataaatactatcagcatggctcgtgtcatagctggccatgggatggcaggatggaatcattttcactaacaactaatgctgctatcgaatttaaaccaaacatgcgagtacattctac

SEQ ID NO: 11977 - DNA, 78 bp, Diabrotica virgifera
  misc_feature (72)..(72): n is a, c, g, or t
ccctcagggcgcccgccccgcggccgagagaagggaactccttcaggagggagggaagggagcaagaacggnaggaac

SEQ ID NO: 11978 - DNA, 730 bp, Diabrotica virgifera
  misc_feature (5)..(98): n is a, c, g, or t
  misc_feature (101)..(264): n is a, c, g, or t
  misc_feature (278)..(302): n is a, c, g, or t
  misc_feature (304)..(513): n is a, c, g, or t
  misc_feature (520)..(557): n is a, c, g, or t
  misc_feature (577)..(590): n is a, c, g, or t
  misc_feature (593)..(615): n is a, c, g, or t
  misc_feature (715)..(729): n is a, c, g, or t
ttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtgtttatttgnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttataattttacatgatctgagtttgaaccggtgtgagccagggtggtttctatctttaatttgtcaatatattttagtacgaaaggacnnnnnnnnnnnnnnng

SEQ ID NO: 11979 - DNA, 569 bp, Diabrotica virgifera
  misc_feature (516)..(553): n is a, c, g, or t
ctgccttttctaccggctcgggacttctatctatgaaagtgatggacgaagacgggagaaaaagcagaaacagcctagaaaaaataggtaattgagaatgtcggtcgtaaggcgtacgaatgagattctactgacagctgccagactatggtagatagggagtaccacatcaggtcacgatgacgatgtaatgagtatattaactcagatgataataatggtatgaaacataacgtagtaccgatgtggaagctgtagattgaagatatctatagcgatacatacaagagaaataacatgtaaatctgaaggcgactcatggattacaacatagaatcgaataatttcgtaccaatgggatagtaggattggcactgctcagaaagatgatcatctgataacatctgactacattgaagctaatgaaaggataggatttcaaaccacgataacagtaggaagtatattgtttggtctgagatcgcaaactgagaatcaaggtaagatggctaatannnnnnnnnnnnnnnnnnnnnnnnnnnnnnnnnnnnnnttttctagagaatatc

SEQ ID NO: 11980 - DNA, 774 bp, Diabrotica virgifera
  misc_feature (51)..(70): n is a, c, g, or t
  misc_feature (263)..(314): n is a, c, g, or t
  misc_feature (616)..(630): n is a, c, g, or t
  misc_feature (695)..(695): n is a, c, g, or t
attttatgacatcattctcggctttccattaaatattgggatgtgtagacnnnnnnnnnnnnnnnnnnnnagcttaaaatagtaaacaaatagaacaaactgcacttacttttgtactactagatatatttaaataatggaagcgtacgacgtaattgttaaccaacctgttgtgatagataatggaacgggtgttattaaagctgggttcgctggtggccaaattccaaaatgtagatttcccaactatgtgggtagacctnnnnnnnnnnnnnnnnnnnnnnnnnnnnnnnnnnnnnnnnnnnnnnnnnnnnctaaagctgaagaacacagaggcttactttccatcaagtacccaatggaacatgggatcgtaacagattggaatgacatggaaaagatttggagttatatttatagcaaagatcaactttcgacgttctcagaagaacatcctgtattacttaccgaagctcctcttaatcctaggccaaatagagaaaaagctgctgaaattatgtttgaaacatttaatgttccagctttatttatttccatgcaagctgtacttagtttatattctactggtaggactactggtgtagttctagactcnnnnnnnnnnnnnnntcattcagtgcctatatacgaagggtttgctctaccccacagtattatgagatctgatattgcangaagggatatttctagatatttaagattgctttctaagaaagaaggaatcattttccgtactactgctgagtttgaatc

SEQ ID NO: 11981 - DNA, 123 bp, Diabrotica virgifera
  misc_feature (2)..(28): n is a, c, g, or t
  misc_feature (38)..(88): n is a, c, g, or t
  misc_feature (90)..(103): n is a, c, g, or t
cnnnnnnnnnnnnnnnnnnnnnnnnnnncaaaagcttnnnnnnnnnnnnnnnnnnnnnnnnnnnnnnnnnnnnnnnnnnnnnnnnnnncnnnnnnnnnnnnnnaaaattcatttatataataa

SEQ ID NO: 11982 - DNA, 536 bp, Diabrotica virgifera
ttttgttattgcaaattgtcggcccgagttattttgtacaatggagtgtctacttggtatcaaatttaatgactacgttcttgttgctgcagatatgactgcagcgcaaagcataattgtaatgaaaacagatgaaaacaagcttcataaactttccaataagcttgttatggctgtttctggtgagtctggggatactacacagtttgcagagtatatagcaaaaaatattcaactttacaaaatgaggaatacctatgaattgagtcccaaagaagctgcagcatttactagaagaaatttggcagatgcactcagaagcagaagtgcataccatgtaaaccttcttctagctggatatgatgacaaagaaggtcctcagctatattacatggactacctagcatccatagcaagcgttgattatgctgctcatggttatggaggattcttttcactgtcaattatggatcgtaattatcggcaaaacctttagtaaagaagaaaggtacgaacttttgaaaaaaatgtgtgaa

SEQ ID NO: 11983 - DNA, 510 bp, Diabrotica virgifera
  misc_feature (23)..(63): n is a, c, g, or t
ctcttaaacgcgtccggactagnnnnnnnnnnnnnnnnnnnnnnnnnnnnnnnnnnnnnnnnngtttattagtattcttgtaatttttcttcttgtattcgattgttgaaatgtgtgtttgacgtaggtacgtccttgaataacgacgaactatcttcttttgtttttccgaaatgtttatcagggtacatcgtaaactagagtggtacattttgtttcttatttcagtgatcatcagatatcctcgtgtcacattttctattatctattgagttggttttgtcaactttttattgagagttagatatgtttgacattatgtttatgaatttttctcttgtacgagccgcgtattctcaaataataaaacttcattcactactgaaaagaaggaatgatactgcaaatagtgtactgtatggaattgtataaaattaaatatgatgatggatgattattagaaattagtatgtacaaccatagatcatcactatttcaacttattaatgt

SEQ ID NO: 11984 - DNA, 729 bp, Diabrotica virgifera
cccttcttcgcgtccggttccaatgaatacagcaaaacatcccgtccactgggatgatacggaaactgcatttaattcaagaattatgaccggtgttatttcaaatcttaaacacagggatcctgcctcatttctagaagattgcaaagcaatttttaaacgacgcttgcagaatgcacttaaaaaaaatgaagcagttaaggttaacactgttttcggtggtgaatttgtgatcgctaaaggggaccagaccataaatgcatataaatattttactaccccgaatgcacccatttatagagacaccaatttagataagtggttcaacggaaaagtagtcgagcctattatgagagatctaagtgagtttcaggagcaggatagtggttgggcgttaaaagcaattgttaatttaggtgttaacgttaataaatatgtacctcaacgtggatcctcttatattgagctcccttttcaaataaagagaaaacaggcatgcataaatgttaaaaatgaggatgaggcgtgctttgcgtgggcagtaatttcagctttatttccggttgaacaagatgcccaacgagattcaaaatacccgcactactctcaggttttgaaattgaaaggcatccaatttccgatgacaatgaggcagattccgaactctgagagacaaaacgatatatcgattaacgtatacattttaaaaacggaaaagaatatgattca

SEQ ID NO: 11985 - DNA, 54 bp, Diabrotica virgifera
  misc_feature (2)..(53): n is a, c, g, or t
gnnnnnnnnnnnnnnnnnnnnnnnnnnnnnnnnnnnnnnnnnnnnnnnnnnnng

SEQ ID NO: 11986 - DNA, 762 bp, Diabrotica virgifera
  misc_feature (90)..(105): n is a, c, g, or t
  misc_feature (108)..(121): n is a, c, g, or t
  misc_feature (740)..(757): n is a, c, g, or t
gattttaagtaggtatcctttagaatttattttatatatcattcattcccttaaaaggacttccacagctagcaaaaatgtatgaacaannnnnnnnnnnnnnnnggnnnnnnnnnnnnnnggaaaatagttagctttatggtgttttttttaataattcccttgacagtatatttaaataaacaaatgctgatggcacgaaaatgaaagtgtaatatttttggttcaaaactttatagactctatctaatacatagaaggattaaaatttcaaaaacctttgtttcattgtattaacctgtttatattgttaataccatatattatgtcaatatatatctgttaaattgaagtgtacttttgaatccagaattttaacaaatcctaaacttttccacaatttctcaagcatgatatttgtgcattcaaattaattgaaattacatcttaatatgtatctatacctactaaaaatatttatttctaaacaaaaatgtctggagactaaattagttataaagaaaatttatgtttgattattgtaactaacaatttaaaattagttacaaattataatatttaaattcctttttacaaactttttgtaataactccagcttcaataaatgtccttttttcatattgatttgggccaaaccattaataatcgatatctgagaataaacttttatctaggaatcctttttaaaataaaacaggacatacacatacaacttagnnnnnnnnnnnnnnnnnnctaaa

SEQ ID NO: 11987 - DNA, 363 bp, Diabrotica virgifera
  misc_feature (2)..(19): n is a, c, g, or t
  misc_feature (21)..(55): n is a, c, g, or t
cnnnnnnnnnnnnnnnnnntnnnnnnnnnnnnnnnnnnnnnnnnnnnnnnnnnnnctacaagaagagggtatagagattggggagaggatcggaatgcaaacttggagggattcttctcgatgagttactagtgaacacggcaagatttatataactacttacaaagagatacagttatctctccacgtaaaaaggacaaataggcctaaatatcaatgaactgaagtagataagatgaacacgcaagaatgtacttgtagcggagtagatggagtcatttacattatacacaataagaaggagaagtcattaattggctagttatcgacaaacaccaagaataaagataatacatagtgaaa

SEQ ID NO: 11988 - DNA, 101 bp, Diabrotica virgifera
  misc_feature (9)..(46): n is a, c, g, or t
  misc_feature (56)..(95): n is a, c, g, or t
atggccgcnnnnnnnnnnnnnnnnnnnnnnnnnnnnnnnnnnnnnnttttatttgnnnnnnnnnnnnnnnnnnnnnnnnnnnnnnnnnnnnnnnnattatt

SEQ ID NO: 11989 - DNA, 103 bp, Diabrotica virgifera
  misc_feature (4)..(64): n is a, c, g, or t
  misc_feature (69)..(69): n is a, c, g, or t
  misc_feature (74)..(74): n is a, c, g, or t
  misc_feature (80)..(102): n is a, c, g, or t
gggnnnnnnnnnnnnnnnnnnnnnnnnnnnnnnnnnnnnnnnnnnnnnnnnnnnnnnnnnnnnngcttnaattntttttnnnnnnnnnnnnnnnnnnnnnnng

SEQ ID NO: 11990 - DNA, 365 bp, Diabrotica virgifera
  misc_feature (285)..(305): n is a, c, g, or t
ggccggaattcccgggccttcccccccgtccggcccttttgaaagaatataataaatcctacgttccaggggagtaaagtaaaattgtaggatatttaatgacagaggagtaaagatttgtctttctgttttagtaagaatctttaaagtgtggagtattgagtatcgcttatttatacgaagttgagcattacgttgggtttaatgaatgtgccacgacccagataagtaataatttgtggaggcaatacaggagaataccttttcttgggcattgaaacgatnnnnnnnnnnnnnnnnnnnnnttttgtggagatcgcgatatatttatgaataacataccataaatactagattttttggtt

SEQ ID NO: 11991 - DNA, 882 bp, Diabrotica virgifera
  misc_feature (55)..(826): n is a, c, g, or t
gtctgggtggtgcgattttatatccagaaaatatcaaatagctgctcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttagactccaaaaaccccaaactccgacaaaagcaaaatggatcactcctgacc

SEQ ID NO: 11992 - DNA, 620 bp, Diabrotica virgifera
  misc_feature (184)..(204): n is a, c, g, or t
gtgtcccctatttgacaaaaggggaagccatataagcatcgagagaagagatttaaaaacttgaatccgcactgtaacgtgtcattttaaatactatcttcacaacgtcctcactcaacaaaacaaaaaataatcagtctaatttgaaaaaaagataggtcacgtagtcttttttcttcgaatnnnnnnnnnnnnnnnnnnnnnctagcttttttgagtagaagtctcttgttttaacttatattaaacacagcactgcactataggccagaccccggggacgtatgaaccaaacttctacgaccagaaggaaaaaattgcagatcgaagttttatgattattggataatatctctaaatgggaatcgaaattcggcacgggaaatgccaaagcgaatcagtgatatcgttatgcgatcaggaacggtttgcttcctttgtttaaagctaaaaatttaaatgaactgcccttgaaagataaagatatcctaaagaatcacataacctattattttgtagatgatgttacttatctatataaggtaactaaaccggtgataaatggttatggtaaaaactatgcggtcccatattgttcgcctgtcttttataaacacgtt

SEQ ID NO: 11993 - DNA, 391 bp, Diabrotica virgifera
  misc_feature (2)..(329): n is a, c, g, or t
  misc_feature (335)..(377): n is a, c, g, or t
  misc_feature (379)..(380): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatnnnnnnnnnnnnnnnnnnnnnnnnnnnnnnnnnnnnnnnnnnntnnatttttgatcc

SEQ ID NO: 11994 - DNA, 218 bp, Diabrotica virgifera; identical to SEQ ID NO: 7300
  misc_feature (6)..(28): n is a, c, g, or t

SEQ ID NO: 11995 - DNA, 103 bp, Diabrotica virgifera
  misc_feature (6)..(6): n is a, c, g, or t
  misc_feature (15)..(70): n is a, c, g, or t
aaatanatttaactnnnnnnnnnnnnnnnnnnnnnnnnnnnnnnnnnnnnnnnnnnnnnnnnnnnnnnnngaataaattacctttagggatacagcgtaattt

SEQ ID NO: 11996 - DNA, 300 bp, Diabrotica virgifera
  misc_feature (2)..(33): n is a, c, g, or t
  misc_feature (47)..(124): n is a, c, g, or t
  misc_feature (126)..(291): n is a, c, g, or t
gnnnnnnnnnnnnnnnnnnnnnnnnnnnnnnnngcccactggattannnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggat

SEQ ID NO: 11997 - DNA, 781 bp, Diabrotica virgifera
  misc_feature (2)..(721): n is a, c, g, or t
  misc_feature (725)..(779): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnngt

SEQ ID NO: 11998 - DNA, 754 bp, Diabrotica virgifera
  misc_feature (2)..(163): n is a, c, g, or t
  misc_feature (176)..(553): n is a, c, g, or t
  misc_feature (555)..(584): n is a, c, g, or t
  misc_feature (598)..(624): n is a, c, g, or t
  misc_feature (626)..(743): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncgcccaccgattannnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttttta

SEQ ID NO: 11999 - DNA, 983 bp, Diabrotica virgifera
  misc_feature (5)..(348): n is a, c, g, or t
  misc_feature (350)..(786): n is a, c, g, or t
  misc_feature (793)..(830): n is a, c, g, or t
  misc_feature (852)..(852): n is a, c, g, or t
  misc_feature (865)..(887): n is a, c, g, or t
  misc_feature (898)..(898): n is a, c, g, or t
  misc_feature (921)..(921): n is a, c, g, or t
  misc_feature (945)..(945): n is a, c, g, or t
  misc_feature (951)..(976): n is a, c, g, or t
gcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatggtggattanagttataattggnnnnnnnnnnnnnnnnnnnnnnntggtcgacttnttaaatttacatgatctgagttnaaccgggggaagcccaggtggttnctatcnnnnnnnnnnnnnnnnnnnnnnnnnngaaggga

SEQ ID NO: 12000 - DNA, 941 bp, Diabrotica virgifera
  misc_feature (11)..(63): n is a, c, g, or t
  misc_feature (77)..(104): n is a, c, g, or t
  misc_feature (106)..(133): n is a, c, g, or t
  misc_feature (141)..(167): n is a, c, g, or t
  misc_feature (169)..(226): n is a, c, g, or t
  misc_feature (233)..(332): n is a, c, g, or t
  misc_feature (334)..(357): n is a, c, g, or t
  misc_feature (359)..(376): n is a, c, g, or t
  misc_feature (378)..(394): n is a, c, g, or t
  misc_feature (396)..(412): n is a, c, g, or t
  misc_feature (424)..(449): n is a, c, g, or t
  misc_feature (451)..(830): n is a, c, g, or t
  misc_feature (837)..(860): n is a, c, g, or t
  misc_feature (895)..(908): n is a, c, g, or t
  misc_feature (911)..(933): n is a, c, g, or t
ctagaagaatnnnnnnnnnnnnnnnnnnnnnnnnnnnnnnnnnnnnnnnnnnnnnnnnnnnnngtattcgtttttgnnnnnnnnnnnnnnnnnnnnnnnnnnnngnnnnnnnnnnnnnnnnnnnnnnnnnnnngttaaagnnnnnnnnnnnnnnnnnnnnnnnnnnngnnnnnnnnnnnnnnnnnnnnnnnnnnnnnnnnnnnnnnnnnnnnnnnnnnnnnnnnnnggattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnncnnnnnnnnnnnnnnnnnngnnnnnnnnnnnnnnnnngnnnnnnnnnnnnnnnnngaacatttttgnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcgataaataagattgcgaccctcgatgttggatnnnnnnnnnnnnnnggnnnnnnnnnnnnnnnnnnnnnnntgttcgac

SEQ ID NO: 12001 - DNA, 634 bp, Diabrotica virgifera
  misc_feature (120)..(137): n is a, c, g, or t
  misc_feature (139)..(151): n is a, c, g, or t
  misc_feature (153)..(165): n is a, c, g, or t
  misc_feature (297)..(313): n is a, c, g, or t
  misc_feature (315)..(397): n is a, c, g, or t
  misc_feature (450)..(467): n is a, c, g, or t
  misc_feature (489)..(514): n is a, c, g, or t
tttcgcgcgtgcgattttaaaatgataaaatattttttcttagaagaacagaaaactgtctttagatgagagggaattagtgttgtgggagaatattttgatctttctaccggaaacacnnnnnnnnnnnnnnnnnncnnnnnnnnnnnnngnnnnnnnnnnnnntatttcttattttccaagttaaaacagctaaacaaatctacaaattttattgtcaaacacagattatcaataatttttttggaaggaaaggttattcgtttttcgatatatctaactttttaagagataacnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnttgatttttaactaagacttaggcttagaaaattccgtattttaaaagatggnnnnnnnnnnnnnnnnnngattagtattgttatattttannnnnnnnnnnnnnnnnnnnnnnnnngcattgttttaatttgaggatgaaggcaccattagtatcagaagactggatattttgcacaaatatatgcggataataatgggactccgcaacattgtctgcccctgtgttatacaaaca

SEQ ID NO: 12002 - DNA, 947 bp, Diabrotica virgifera
  misc_feature (332)..(353): n is a, c, g, or t
  misc_feature (835)..(836): n is a, c, g, or t
  misc_feature (881)..(881): n is a, c, g, or t
caaaaaaaaactatatatcaatggaatactgaccttgcctttttctataaaatttctatgcaacattcgaataaaacgtctctttctataaatattgatgcacaggaactatacaataatctaatgtcagcaattaaagaaactgcttcgcaattacaactttgtaaagaaaaatctttcccgtcgtgtatcaggcaaagtcctccatggtttgatcatgaatgtacctcagctaaaaacaacatgaaacaaagcctcaaaacagctaaatcaaataacttccgcgacccctataaaacaaattttttgacatcaaaaaaagcctatagacnnnnnnnnnnnnnnnnnnnnnntatatattttcataacctgtattctcaacttgcaaacagcagggactccaaaacattctggtcagtgattaggaaatttcggaaaaatcacaatacttcttttatcgatgtagacgtatgggagcaattttattcgaatatatatcccccaaaactatatcataatgcccgtttttttgatgcaagacatcccatttttgacgctattataaccagtgacgaaatatatagagtcctaaataactgtcccaatcgtaaagcacctggaactgaccatatttcttatgaattctttaaaaatcttccaaataattggatactgtatttaacgggcatgtttaatagaatactggaaacaaccattacgccgcatatttaaaaagggcaacagagatgatccagcaaactatagaggtattgccttacttaattgtgttgaaaaaatatttactaatattttgttaaacagactcagagattgnngtgaaagtaataatagtcttcccgaatgtcagtcgggtttcaggngatcaagggggtgcattgataatgtattcacccctcacttctgctgtacaactgcaactacgactg

SEQ ID NO: 12003 - DNA, 996 bp, Diabrotica virgifera
  misc_feature (676)..(697): n is a, c, g, or t
  misc_feature (859)..(859): n is a, c, g, or t
gaatatttggagattggcaaggacattttgaagagtcccaactgtgtcaatagacaaacatcccttaaccgcaactttgtccccattcaccgccaattattctcataattcctattttttcaacttcctcttttatcctattctttctctttcaacttactctctcttctttttcaaaatttcctctttccttcactgcttccaaactcctttacccgaataacattattaactattgaaccctattaaccatcacctcattaattcaccctactatctttttacttctttttcatttcattacttcgttcagtttaattccacacctcatcttttctttatccctctctttcccttaaaattcttgtctttataccttacaccacagccctctgctttttgtctttgaccttttccaagaaaacttttacctctccaactaacatccattcacttgatttcagttctcacattcagatccattatcattacaattaaattatatctatattctttttcttactttggttttattttattcagtacactttcaatattattttcattttaatttcatttttgtatcaactggacttaacagctataatcatacattactttatctctaatttcccataccaacactttgtcacaagaattctctcaaaacttttgnnnnnnnnnnnnnnnnnnnnnncatctcataataattacaattctttttcattcacatattacacacttttaattatttgactgtatcctaactcaaatccattatttacaaaaacttgcatttttaaataacaatattttccttttacatatacaaccaccaaatacatatagactagattanattgcctaccaaatttatcattttgtacaataactttccaactaatattgatttttctcttttctcaccttcatctatttttatcttttttatcttattgacagcagcttactttctttctatcaatttgatcaatc

SEQ ID NO: 12004 - DNA, 877 bp, Diabrotica virgifera
  misc_feature (102)..(119): n is a, c, g, or t
  misc_feature (815)..(815): n is a, c, g, or t
  misc_feature (842)..(842): n is a, c, g, or t
caaataaataaataaatacaaatttaacatttaacttcgattgtcatttgtgttgtgctgtgcaggttcttatattttgtatagaagcaatattaacatttnnnnnnnnnnnnnnnnnncataaagatgactacagtgcctggtgaaaactgtaattttgtatttaaaaaacggtctattaaaaacagaggcacaaggaaaagacaagcttcgagttctgaagaagatccagaagaaaatgaacagaaggaacaaatagttaaacatagcaagcgtaaaattaagtcaaatccaaacattcagagtactagtaatatacaaaatcgtgaacgaaacagagaaaaagagtcttccagtagcagtgatgaagactttcgtgttaactataaatctaagaagtcagctatggctgcagggccttctgatcagggtgcaacagcaacagttgaaattgatacagaaacagatagagatgcccaagccatttttgagaagaggttggagattaataaagatctagaaggaaaagaggatgataaaatatataggggtttaaataactatgctcaatattacaaacctaaagatacagctgctggaaatgctagttctggtcttgtaagaaaaggccctataagagcacctgctaatctgagagcaacagtacgatgggactaccaacctgacatatgtaaggattacaaagaaacaggattttgtggttttggagatagttgtaagtttcttcatgacagaagtgattacaaacatggctggcaactggaaagggaatggaatgaaggaagctattctanagacagtgatgatgataccagatatgnaattcattctggatgagaagacttgcctttttaat

SEQ ID NO: 12005 - DNA, 839 bp, Diabrotica virgifera
acatcccgtatcccgatcatgatataggtacctgggttataaaagacataaaacctaactctgaaggaaagccgcagaaagtgaaagtcaaggtccgtgtaaacctccatggaatcatgtcgatatcgagtgctagtttgtacgaagcaaaagagtcagttgaaccagaaagtccggaagaacaacagaaggaggcacaggtgaacagtaacgaccaacagaatggcggtgtgcagactaacgagagcggcgaatcgatggaaacgacaaacgaaggaacaggagccaacagtggagaaggtgctgttcctgaggaaggaagcgataaaaagaaaaagcaatcggtaaaatccatagaattaccaatcgaatctcttacgaccggtttctctcaggtggaaataaatcatttcaccgagcaagaattcaaaatgatcgcttctgatcgacaagagaaagaacgcgctgacgctcgaaatgcatttgaagaatacgtttatgaattgcgtaacaaagtcagttctgatggagatttcgcacctttcatgcctgagaacgatagaaatactttggtgtcgcaattagatgatatggaaaattggctttatgaggatggcgaagactgtaataaacaagtatatatcgacaaattacagcagttaaaaagtattggagaacctgttcaaactagaaaaattgaatatgaactaagacctgtggttattgaggattttgctaaatcattacaattatgtatgaaagctttggaattgataagatcaaaagatcaaaaatatgctcacctaactgaagaagactataataaagtagaagatgca

SEQ ID NO: 12006 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12007 - DNA, 196 bp, Diabrotica virgifera
  misc_feature (28)..(28): n is a, c, g, or t
  misc_feature (79)..(101): n is a, c, g, or t
  misc_feature (109)..(130): n is a, c, g, or t
  misc_feature (136)..(136): n is a, c, g, or t
  misc_feature (160)..(191): n is a, c, g, or t
taacagcgtaattttattggagagttcnaatcgataataaagattgcgacctcgatgttggattaagtttataattggnnnnnnnnnnnnnnnnnnnnnnntggtcgannnnnnnnnnnnnnnnnnnnnnagtttnaaccgtggaagcccaagttggttnnnnnnnnnnnnnnnnnnnnnnnnnnnnnnnngaaag

SEQ ID NO: 12008 - DNA, 559 bp, Diabrotica virgifera
  misc_feature (8)..(29): n is a, c, g, or t
  misc_feature (31)..(72): n is a, c, g, or t
  misc_feature (86)..(118): n is a, c, g, or t
attttatnnnnnnnnnnnnnnnnnnnnnntnnnnnnnnnnnnnnnnnnnnnnnnnnnnnnnnnnnnnnnnnngtgcgagaatatgnnnnnnnnnnnnnnnnnnnnnnnnnnnnnnnnncctcgagtatcagcggattattaattaatgaattatttatggatctattttcgattgtataagagctaagaaattataggtattattgcaacctcaagcttctaagaaattttgtagaaatggcgacctaatacgcttataatatatccaagtctcgacgcggaagagaagatgtgcatgatgttggtgtcatgaaagaatgtatattttgagggtatgattattaagagatgtataaatgggtagaggcgattaatgtaaaaagcaagatacattagccaagtggaagtcaagatgatacatgttggaaggctaagggtggatgatatgtggtctgcatagtaaaagagggcgtgggatgtgacacgatgatcataggtaatgtccaagtatgggtcgaaaaacattttaaagttgtacttccagtacatcgtgatgtct

SEQ ID NO: 12009 - DNA, 925 bp, Diabrotica virgifera
  misc_feature (903)..(903): n is a, c, g, or t
  misc_feature (916)..(916): n is a, c, g, or t
cggacgcgtgggagtttttacctgcgattagttgttaatttgattcattggtatattgaatctatcgatattggcccaaacctaaattctctgttggtattgtgattcgcaagatttaaaagcagcgaaaagatgaggattaggaggttagtacagatccaggacgaaatgtcggtgctggaaagatttataatgtttctttccgaatttggaggcacggcatgcttggtattcatcggttgtttaggctgcctcagtgctaatgggaccatcatatcttttggatttggttttgccattatgatgggagtacagatttttggacatatttctggagcacatattaatccggcagtgacagtagctgcagccaccttaggaatctttccactaattaatattccaatttatatatttggtcaacttttgggcgctataactggttttggactagtaaagcttttaatcaacaactcagtccttagtatctctgggttgtgttcgccaggacctactggtgtcctatctgcatttcagttattcctatcagaatttatattaacattgatcttgattttggtatgctgtgcaatttgggatagcagaaatgcgacgaagcacgattcactacctcttagacttggtcttgcagtaactggactagcaatggctggaggtggacttagcggtgccaatatgaatcctgctagaagttttggtccagctcttctaaataatacctgggatcgccattgggtatactggatagctcctcttttagcaggatttgttggagccttagtttatagaataattttttcaaaggatgccaagaaaaatgaaacatacccagaaggaacataaactgtacacgtcttttgtattatgtaatacttatacaantaaatccaaattngaagagcta

SEQ ID NO: 12010 - DNA, 141 bp, Diabrotica virgifera
  misc_feature (47)..(67): n is a, c, g, or t
tgacgtccgtgaaactgtgttacgtgatatagtgatagttcttatcnnnnnnnnnnnnnnnnnnnnngtaagatggttccatttatgcattcgttatgttcattttggaaattataacagaaataaagacaacttttaatt

SEQ ID NO: 12011 - DNA, 102 bp, Diabrotica virgifera
  misc_feature (15)..(101): n is a, c, g, or t
gattaatttgaagannnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12012 - DNA, 420 bp, Diabrotica virgifera
  misc_feature (15)..(50): n is a, c, g, or t
  misc_feature (76)..(113): n is a, c, g, or t
  misc_feature (137)..(183): n is a, c, g, or t
  misc_feature (185)..(200): n is a, c, g, or t
  misc_feature (211)..(247): n is a, c, g, or t
  misc_feature (328)..(348): n is a, c, g, or t
cccttttcacgcccnnnnnnnnnnnnnnnnnnnnnnnnnnnnnnnnnnnncaatattctttagtaaaagtaacgannnnnnnnnnnnnnnnnnnnnnnnnnnnnnnnnnnnnncaatattttatctttataaacgannnnnnnnnnnnnnnnnnnnnnnnnnnnnnnnnnnnnnnnnnnnnnncnnnnnnnnnnnnnnnnccgaatttacnnnnnnnnnnnnnnnnnnnnnnnnnnnnnnnnnnnnncattttacatactctttttgtaatgcaatgtccttcggttttaaatatctctaatttcttaggaactaaattaaattctcnnnnnnnnnnnnnnnnnnnnncttacatattgctataccattaatattaactattttgaccgacgagctgaacaacaaacctctattaaaatt

SEQ ID NO: 12013 - DNA, 83 bp, Diabrotica virgifera
  misc_feature (2)..(64): n is a, c, g, or t
cnnnnnnnnnnnnnnnnnnnnnnnnnnnnnnnnnnnnnnnnnnnnnnnnnnnnnnnnnnnnnnnccagttttttttgattata

SEQ ID NO: 12014 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12015 - DNA, 474 bp, Diabrotica virgifera
  misc_feature (443)..(462): n is a, c, g, or t
ccccttggggagtccggatttaaaatccctgattgttaaatactatatcttttttattgggcccctctaatcaagttccggggcccgttatttacaagcgtagtggaggaaaatcccctggctttcccctgatattcgcctttgactctatcccctttttccacatgtggtaaaaaataaaataacccccaaccttttgcccttccaaaaatttcaatactcttaatgattaagagcacccccccttgatctttaatatacccaggtgtgtgagggttgattaccccaggagtgtcccatataatttgggctgcaccaatacccccactccgtgattatttctccattatttattatcaatgtaagctgtatttcccttttttattaaaagaggacctccccttagagttacccttttaaaggattgacattaccccgccccnnnnnnnnnnnnnnnnnnnntgtaatctctag

SEQ ID NO: 12016 - DNA, 744 bp, Diabrotica virgifera
  misc_feature (11)..(33): n is a, c, g, or t
  misc_feature (224)..(296): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (589)..(618): n is a, c, g, or t
  misc_feature (638)..(687): n is a, c, g, or t
  misc_feature (692)..(733): n is a, c, g, or t
ccctttcgtannnnnnnnnnnnnnnnnnnnnnngatagaaaccaacctggctcaccccggtttaaactcaaatcatgtaaaattttaaaagtcgaacagacttaataatatagctgctaccccaattataaactttaacccaacatcgagggcgcaatctttattatcgatttgaactctccaataaaattacgctgttatccctaagggaatttattcttatnnnnnnnnnnnnnnnnnnnnnnnnnnnnnnnnnnnnnnnnnnnnnnnnnnnnnnnnnnnnnnnnnnnnnnnnncccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggggagactttatatttaatacaaaaagacatnnnnnnnnnnnnnnnnnnnnnnnnnnnnnnccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnntaaaaaataaa

SEQ ID NO: 12017 - DNA, 87 bp, Diabrotica virgifera
  misc_feature (2)..(36): n is a, c, g, or t
  misc_feature (47)..(84): n is a, c, g, or t
annnnnnnnnnnnnnnnnnnnnnnnnnnnnnnnnnngttttttaagnnnnnnnnnnnnnnnnnnnnnnnnnnnnnnnnnnnnnnggg

SEQ ID NO: 12018 - DNA, 84 bp, Diabrotica virgifera
  misc_feature (7)..(46): n is a, c, g, or t
  misc_feature (55)..(56): n is a, c, g, or t
  misc_feature (69)..(69): n is a, c, g, or t
aaaatannnnnnnnnnnnnnnnnnnnnnnnnnnnnnnnnnnnnnnntttgatccnnattttttgatatnagaataaattacctt

SEQ ID NO: 12019 - DNA, 483 bp, Diabrotica virgifera
  misc_feature (386)..(405): n is a, c, g, or t
gatataattttatcgccactattcgataagcaaatgaaattaagaagtttaagtgaagaaaaaacatatttaggatatagatataacaacagacgcagttttccccaattccttaatgaaaaatatctgtgaagtaaatagagaatgatctatgagagaacgagatacgcacatcttttatacaaaagaataaatggagcggagatgtgttatatttagggtatattgcatgtttttaatgaagagggcaaagtactgcaggtttattcctgatgaggagcgtgcttatctattaaatatatctggtttttactctttgatgatcattactgatgagacctagtcatgtgatgtgataagtgaggattagtatgtatctaagttgnnnnnnnnnnnnnnnnnnnntgttactaacataatgtaattaaagaaaggattgaaacaaagaccctattcgaggagcaatactaatgctatgatata

SEQ ID NO: 12020 - DNA, 840 bp, Diabrotica virgifera
  misc_feature (5)..(822): n is a, c, g, or t
  misc_feature (824)..(837): n is a, c, g, or t
ccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnaat

SEQ ID NO: 12021 - DNA, 898 bp, Diabrotica virgifera
  misc_feature (387)..(407): n is a, c, g, or t
  misc_feature (775)..(775): n is a, c, g, or t
  misc_feature (803)..(803): n is a, c, g, or t
ctaataaataaaaacgtaacttattaacacaaaacactatactagcaaattctaactctcctacactataaccttgttcgtatgatctagtcaaacgagatacaaaactaataggtacttcacattcattttgatattgtaataatactcctgacaacttatgcatagatgcatctgttcgtaaagtaaatggcaagctgtaatctggatggtatatctttaaattttgacaaaattgattttttatgttatcaaatgcaaattgttgttccataccccaataccattttactcctttcttgagcaaatgatttaaaggtactatcttttggctcaaatcaggcacaagtcttttaaaataattgattaaaccaagaaaaccacgcnnnnnnnnnnnnnnnnnnnnngtagggtattcttttattctattcactctctcctcatccattgaaactcctaaattatctattttataccccagaaaggtaacactatcttggaaaaatttacatttctttatattgattttaagacccgctaaatctaattcttttaatagtatctcaatatgttttaggtgtgaatgttcgtcttttgacagtattagaatatcatcaatgtagtgaaggataaaatcatcatacttatttaaaatattatggagagcgcgaactaaagcactacaggaactctgcaaaccataaggcacaacacaaaatctgtaaagaacaccatcaatcataaaagcagtataatccctggattcatgggctanaggaattaaccaaaaactggtgtctcanatctactttgctaaaatattttgcccccgttattctcccgaaaatagtttctgttgtagcaggtgcttcgtattgtggtatggtatgatttattt

SEQ ID NO: 12022 - DNA, 230 bp, Diabrotica virgifera
  misc_feature (7)..(48): n is a, c, g, or t
  misc_feature (50)..(84): n is a, c, g, or t
  misc_feature (86)..(156): n is a, c, g, or t
  misc_feature (158)..(170): n is a, c, g, or t
aagaaannnnnnnnnnnnnnnnnnnnnnnnnnnnnnnnnnnnnnnnnncnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnncnnnnnnnnnnnnngagtaaaaaagaaaaaaatttaccctttacggcataaacgagcggaaaattttttatttg

SEQ ID NO: 12023 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12024 - DNA, 774 bp, Diabrotica virgifera
  misc_feature (2)..(17): n is a, c, g, or t
  misc_feature (19)..(681): n is a, c, g, or t
  misc_feature (689)..(733): n is a, c, g, or t
  misc_feature (744)..(744): n is a, c, g, or t
  misc_feature (756)..(756): n is a, c, g, or t
cnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggggnnnnnnnnnnnnnnnnnnnnnnnnnnnnnnnnnnnnnnnnnnnnntaatttttaangttaaaagcttnaatttttttaaagacgag

SEQ ID NO: 12025 - DNA, 585 bp, Diabrotica virgifera
  misc_feature (28)..(28): n is a, c, g, or t
ccctccaaagcgcccggggaagaatggnggggaaatatgtttctttaaagattgaggaaatgatattttataagtttggataagttattagtgaattgagaattattgtattatgtcaggggatgaattggattgagaatatagagtgatattagaaagaagaaagattaatgaattgagagttttatattatctataagaatggatgaagttgtaggatagtatgttatgatatgtatggaattacatggatctatagacaagcgaaaaggttgtaggatttacaggttcttatttgatattgtgtatattggattgtctgaatgcatcatataaagagatagttgtatgaaaggatttatagagaacctcagatgagtattctccaaagttgatattactacagaatgatagttcaaggaacaaatttttcgaagaactaaagtttatctcagatactacttttagattagcagaatagttaactgctattgataaagaagaatatgtgaaagaaactgtgtaatattatcctccagagcattgtttggaggtaattgaattattctatgaatactatccgaa

SEQ ID NO: 12026 - DNA, 807 bp, Diabrotica virgifera
  misc_feature (214)..(246): n is a, c, g, or t
  misc_feature (266)..(331): n is a, c, g, or t
  misc_feature (366)..(616): n is a, c, g, or t
  misc_feature (622)..(723): n is a, c, g, or t
  misc_feature (725)..(744): n is a, c, g, or t
  misc_feature (751)..(806): n is a, c, g, or t
gtcatttctacacacctcgagtagttccttgagatttctagaaagaacttgtcgaaggtgtgacgtatcgaagaaggtcctaacagattagaattatgtacccccatgccctatttgtggtgcttgcggatatcatacgatacattcatgcaataagtatatttatatgattacccaattgaagagaactaaaaaataaaaagtatgattaggnnnnnnnnnnnnnnnnnnnnnnnnnnnnnnnnngaaggttattcgtgtttacnnnnnnnnnnnnnnnnnnnnnnnnnnnnnnnnnnnnnnnnnnnnnnnnnnnnnnnnnnnnnnnnnngttatattattagtattaaagatttttagggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnncgaaaannnnnnnnnnnnnnnnnnnnnnnnnnnnnnnnnnnnnnnnnnnnnnnnnnnnnnnnc

SEQ ID NO: 12027 - DNA, 203 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(192): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggttnnnnnnnnnnnnnnnnnnnnnnnnnnnnnngaccgaaaggg

SEQ ID NO: 12028 - DNA, 640 bp, Diabrotica virgifera
  misc_feature (22)..(54): n is a, c, g, or t
cttatcattgggcaggcgagannnnnnnnnnnnnnnnnnnnnnnnnnnnnnnnncgcccgtccatcttgtgctccccggattttatcttcatcctgagacatttcctagcttgtatgtaaatggacacgagaagatagccgctatggtgtaccccataaactttaatatggccactctcactttatcgcagatgccgttctctccagtgacgtgacttatgctctttctggatcatggtacaagactcttcgtctgtgggattaggttgctggaaaaactacatgaagatttgtagatgacgctaaggatgatgtgagtgtattcttctctgttgactatagacaaattgtgtctgaataccgtgacaataccatcgaagtgtggaactccttggacgaatgtaaatacacaattcatgatgatggacattccgattgggaatcctgcgtaagattttcccccaaccacgccaacccaatcatcgaatcagctggatgggaccgaatggtgaaggggtggaacttgaccaatcgccgactatagatcaaccactctgttcacactggttacttaaagccagatgcagactctcctgacggcagcttatgtgctcgcgtggggcaagactgcaagccctgg

SEQ ID NO: 12029 - DNA, 749 bp, Diabrotica virgifera
  misc_feature (7)..(81): n is a, c, g, or t
  misc_feature (83)..(720): n is a, c, g, or t
attttcnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaactattcatggaaagctgcagagaag

SEQ ID NO: 12030 - DNA, 102 bp, Diabrotica virgifera
  misc_feature (2)..(17): n is a, c, g, or t
  misc_feature (19)..(32): n is a, c, g, or t
  misc_feature (56)..(76): n is a, c, g, or t
gnnnnnnnnnnnnnnnncnnnnnnnnnnnnnnactttttggactgaatattaaggnnnnnnnnnnnnnnnnnnnnngtgaatgtccggcggtattatgaccg

SEQ ID NO: 12031 - DNA, 866 bp, Diabrotica virgifera
  misc_feature (32)..(73): n is a, c, g, or t
  misc_feature (75)..(99): n is a, c, g, or t
  misc_feature (102)..(146): n is a, c, g, or t
  misc_feature (148)..(170): n is a, c, g, or t
  misc_feature (177)..(213): n is a, c, g, or t
  misc_feature (215)..(235): n is a, c, g, or t
  misc_feature (262)..(354): n is a, c, g, or t
  misc_feature (368)..(446): n is a, c, g, or t
  misc_feature (448)..(485): n is a, c, g, or t
  misc_feature (529)..(547): n is a, c, g, or t
  misc_feature (563)..(584): n is a, c, g, or t
  misc_feature (586)..(602): n is a, c, g, or t
  misc_feature (628)..(657): n is a, c, g, or t
  misc_feature (709)..(728): n is a, c, g, or t
  misc_feature (765)..(795): n is a, c, g, or t
tttatttcaaaatcccaaaatatgcccttgannnnnnnnnnnnnnnnnnnnnnnnnnnnnnnnnnnnnnnnnncnnnnnnnnnnnnnnnnnnnnnnnnnccnnnnnnnnnnnnnnnnnnnnnnnnnnnnnnnnnnnnnnnnnnnnncnnnnnnnnnnnnnnnnnnnnnnncaatttnnnnnnnnnnnnnnnnnnnnnnnnnnnnnnnnnnnnncnnnnnnnnnnnnnnnnnnnnncactgaaatgttattcgcttttacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgagcttaacnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnntattcaaatataaatttagattatttcaatttagtactgatgcnnnnnnnnnnnnnnnnnnnctgtatatttactacnnnnnnnnnnnnnnnnnnnnnncnnnnnnnnnnnnnnnnnccacctgttcattcacaacatgtccnnnnnnnnnnnnnnnnnnnnnnnnnnnnnnactgatgaatttgatggcccgcgcatttttgccgagctaaggtagctataannnnnnnnnnnnnnnnnnnnccgggacccaaaggttctgtcgaaaaacaactgcccnnnnnnnnnnnnnnnnnnnnnnnnnnnnnnncttcacccccctaacttttttacaacatcaaaaacccaaaacggcgttaaaataatcacataacttttttt

SEQ ID NO: 12032 - DNA, 820 bp, Diabrotica virgifera
  misc_feature (8)..(29): n is a, c, g, or t
  misc_feature (37)..(59): n is a, c, g, or t
  misc_feature (66)..(81): n is a, c, g, or t
  misc_feature (83)..(125): n is a, c, g, or t
  misc_feature (133)..(164): n is a, c, g, or t
  misc_feature (170)..(215): n is a, c, g, or t
  misc_feature (217)..(248): n is a, c, g, or t
  misc_feature (257)..(368): n is a, c, g, or t
  misc_feature (370)..(435): n is a, c, g, or t
  misc_feature (437)..(620): n is a, c, g, or t
  misc_feature (647)..(666): n is a, c, g, or t
  misc_feature (680)..(775): n is a, c, g, or t
  misc_feature (777)..(818): n is a, c, g, or t
ttttatcnnnnnnnnnnnnnnnnnnnnnnctttttcnnnnnnnnnnnnnnnnnnnnnnncttaacnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnntcatcnnnnnnnnnnnnnnnnnnnnnnnnnnnnnnnnnnnnnnnnnnnnnncnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttattaaaaacacgtctttttggnnnnnnnnnnnnnnnnnnnncgcccaccgattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnngc

SEQ ID NO: 12033 - DNA, 478 bp, Diabrotica virgifera
  misc_feature (51)..(72): n is a, c, g, or t
ttttatttagtttaggatactacccttatatccttttaaaaggaaggaaannnnnnnnnnnnnnnnnnnnnngtatggattgtgagggaatatcttatttttatagaagaggagttgatgtattggaagttgaggatcccgtcctattagttaacaattagatatacatgattatactaggctctaccggtggacgataagaatgatgagtgaacagtgatgacatgaaatgaggtgttggtggtgaaatgttattcgtataccaagaaagtataggtgttgatattgtaaggagcagagatgtagtagaaaatgttgtagaatctaatagagtgtatatcattattataaaggacgttgtaaagtatgagcgggggagttaagaaagtaatcatatctgatcattctgatgatgttcgagcgtaagaatgaggtgtattataggatgcgtaattagttgatgtttacgtgatatcat

SEQ ID NO: 12034 - DNA, 511 bp, Diabrotica virgifera
ccaataaaagaggtatcaaaccctatgtacctatgtgatacatgaactatttattgacatatatattctcaagtatatggatactccattctataaataattagattcattattgttctttaaacatatcaaattatactatagctctgaaaaaataatcattaatacaaccaattacttacctttgaattcttatagatgcataaactactattagataataatactttaacatttaactaacttgaaaactttaacttacaataaacaacataatatcacagtgtatgatacaaactacttctcaatattataatgttattatgatacatatgacatacaacaagtaattaacttgataaaatcacccttaatatagattaatttatgacaaccatttcttatttgaacctttcctatgctatcacctccgcccgcatcggacaaaatcaaaaaaataacaagatcacaatagaataacagactactctaacaatccatcctatgctat

SEQ ID NO: 12035 - DNA, 727 bp, Diabrotica virgifera
  misc_feature (88)..(105): n is a, c, g, or t
  misc_feature (146)..(165): n is a, c, g, or t
  misc_feature (175)..(193): n is a, c, g, or t
  misc_feature (229)..(249): n is a, c, g, or t
  misc_feature (315)..(333): n is a, c, g, or t
  misc_feature (344)..(368): n is a, c, g, or t
  misc_feature (370)..(461): n is a, c, g, or t
agcaaatatttttttatgaacgtattcatagtcgaagaatttatttaaataagggtttattaaatattatacctaatttaagattatnnnnnnnnnnnnnnnnnncttctaatatagctgctcctccatctttaaatttaatgagnnnnnnnnnnnnnnnnnnnncaatagttgnnnnnnnnnnnnnnnnnnnattattcttatcattaatatcatttttcagagctgnnnnnnnnnnnnnnnnnnnnngatattctcaacatggcatatttttttctggtgcttattctttttataatggattaattcgtgagnnnnnnnnnnnnnnnnnnnattgattaccnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaaggggacccaggtttacgaacgggggctgggaacgccatactttttttatggggcccccaaatttcatttccggggccgcctttttacaccgcggggaggggaaaaccccgggggttccccaatttatccccttggcagcacttccccttttccccagtgggggaaaaaggaaaaaggccccccccattcccctttcccaacagtggcgcacccggaaggggaatgggaacgcccccggaaggggccatttaggcgggggg

SEQ ID NO: 12036 - DNA, 109 bp, Diabrotica virgifera
  misc_feature (27)..(27): n is a, c, g, or t
  misc_feature (79)..(101): n is a, c, g, or t
taacagcgtaattttattggagagttncaatcgataataaagattgcgaccctcgatgtggattaagtttatagttggnnnnnnnnnnnnnnnnnnnnnnntgttcgac

SEQ ID NO: 12037 - DNA, 822 bp, Diabrotica virgifera
atctttatgtatttgaaagtattaccaatatgtttttaagtaaccacgtagaaggaaccatgttattcaccgatatgtacatgaatattgagttagaatatgttatgtttatcaaagatgaatttattcctcgtacctagggaatcgcggataattatttaataattgtagatttatcatttgcaaatgcaaaagacgtatataagaaagatagctatatagtcgttgaatggtatgtatagatcaactttactggaatcgtgatgctaatcgttatgaaaaccatgtccccaatgcaacgctaattaatgctccttcatcaacacaaactttatcattaccaagaaatatgttgtaagtaactatacaatcctaaatatatgctctcccatagatacatgattccccgagaactacctacatatgacttatcaaccaagaatgtcacatttgaacctacgatatcatttgattccattgatcctcattatgcattatcatacaacatgccacatatgcatgtacacctaatgtcattgatgttccaaatgatgcgtgttttgatgtacccacaactgtaccttcaatatatgtacagaggtccctcacaagtgatgctgaactcttatttgctgcagagacttatgatgatcatgctatctatgatgtacaacaatctcgcctgcccactcatgatgaaccatggactgatggataataatatgacgccccaacacttgatattccaaataatgatgcaacctgacatgatgatgaagaacgaaatgatgactgactttatgatgatgcctccacacatga

SEQ ID NO: 12038 - DNA, 726 bp, Diabrotica virgifera
  misc_feature (18)..(38): n is a, c, g, or t
  misc_feature (56)..(115): n is a, c, g, or t
  misc_feature (124)..(256): n is a, c, g, or t
  misc_feature (268)..(457): n is a, c, g, or t
  misc_feature (459)..(473): n is a, c, g, or t
  misc_feature (491)..(563): n is a, c, g, or t
  misc_feature (568)..(588): n is a, c, g, or t
  misc_feature (590)..(602): n is a, c, g, or t
  misc_feature (604)..(651): n is a, c, g, or t
  misc_feature (659)..(690): n is a, c, g, or t
ccccacgcccgcgtccgnnnnnnnnnnnnnnnnnnnnnattcccccaccccagtcnnnnnnnnnnnnnnnnnnnnnnnnnnnnnnnnnnnnnnnnnnnnnnnnnnnnnnnnnnnncccctaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattttattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnntgaaatatttttttcaannnnnnnnnnnnnnnnnnnnnnnnnnnnnnnnnnnnnnnnnnnnnnnnnnnnnnnnnnnnnnnnnnnnnnnnnaggannnnnnnnnnnnnnnnnnnnntnnnnnnnnnnnnnannnnnnnnnnnnnnnnnnnnnnnnnnnnnnnnnnnnnnnnnnnnnnnntatttagnnnnnnnnnnnnnnnnnnnnnnnnnnnnnnnnttaaatgtttttgaaagatgagaatacgctatagag

SEQ ID NO: 12039 - DNA, 541 bp, Diabrotica virgifera
cttgtaaaagggtaaagaaggtatataaaaagagagtgaagttaggattgagagtgattctcttgatgatcaagaatatggagttgatgtaatgcgtctctgtaggattcattccttgtggttaaatactagatatagttgataaactaggagtcttacgatgatcaataagagtgatgagaggaactatgatgagtttataatggatgctcatagagatgtttttgtcgaatacaaattaaagaataactagtagataactctagggagcaatgatgtatgcaaaaaatggtgtagaaactaggaatagtggtcagtcataaatgtgtagcgccctctatgtgtggaggatggcgttaagctagaaataatcgctgctcaatccggagaggattgagtgataagtaatcagaagttagctgaggatgctgtattatgctgctgtttagagtgagcagcgtgcacttcaagacacattttgtgaattgaataactgaaatagtcttaaggtgcatgcaacggtaccgatgaatgtttgaag

SEQ ID NO: 12040 - DNA, 900 bp, Diabrotica virgifera
gaggattagatgtaaatcaacaactaattacaccgttttctgaaaactacataccagttaaccgtcgttcgtcactcggaaggtgtctggaactttgcttaccagaatcgttttaaatttactggagaatgttccaatcctgatgcccaaattcggtcctgccaaactcgcaggctcccaattcttgattaccaatcagaagttcaatattacttataagaagtgtgatggcatgaccggcacatttgatggagtggttgagtatagctgcttgggtgattggtttgttggtaaaaatctctattttgctgttgctaataccaaggaatccagaaaagatgaaaaatacagatgttttttgaagaacagagatgatgatctgtacattggtgtgtcaattacagctgaatgtaatactttaaagactgttgaaaaaagtccagaaagattgcatattacaccagtaaaatctgagatagtggagccaggttgccgccttccgcaaaatttctctggagaatggataaatacagctaatattgatgctgatattttcattaatgagacccacattatagaaacatggtatcctgatgaaggaagatacaggagaactatttatgtttgccgagaacagagagatagtagagtgatgatggctagattaactgttgatggatgccaaaaagatttcatctgttttgactttgtaccgcaacatcacaacgttattaggtacagacgaggtattgctgtcattaaagacgatttcagtacagtatgctcctgggtacaattccagaacaaagttaaatggaagtacgatttgtatttgaagaaaaatcccgtgccagtgaaatgtccagtggcgggaaaatccattttactcaaaaaggggat

SEQ ID NO: 12041 - DNA, 856 bp, Diabrotica virgifera
  misc_feature (746)..(763): n is a, c, g, or t
gattacggtttatcccaattgctccacaatcttgatatgatatgcaattattatataaagtgtggctgacatcctttgaatttaaacatacaatcaaccaagagaggccccctattaaaaaattgaaacaccatgtggacgacgacagtggaagtggagacgaagattcaggcccaaatatcacagatttgggccccattgactatcctccaggagaacacaggctgcaacatccctattgtttatggttttcaaagagaccccaacaaatacaagggttgcagggatatagtcaagcactgaggttggtagggcaggtgggcacagttgaacaatggtgggcgttgtattcgcatatggttagactacaagacatacctgcccacagagacatacatctttttaaaaaaggaataaaacctatgtgggaagatgcagccaataaaaaaggaggcaaatgggttataagacttaggaaagaacaagcaggaagggcttgggagaacttatgtatggctatgttaggagaacagtttatggctggtaatgaaatatgtggagtagttgtatcaacgcgatatcaggaatacctcctaagtatttggaatcggacggcttcagatcaagcaaccacagctagaataagagatgccttaaaacgactgttaaatataccttctggtgccactatggagtacaaaacacacaatgattgtctcaaatatggggctacaaaaacaataccnnnnnnnnnnnnnnnnnnctgaccccgtaaaaagttttagaaaattatgattttactgtttactgaaatctgtattgaaaaaataataattaagataaacttcattaatgc

SEQ ID NO: 12042 - DNA, 905 bp, Diabrotica virgifera
  misc_feature (512)..(524): n is a, c, g, or t
  misc_feature (527)..(547): n is a, c, g, or t
  misc_feature (737)..(737): n is a, c, g, or t
  misc_feature (777)..(778): n is a, c, g, or t
  misc_feature (813)..(813): n is a, c, g, or t
  misc_feature (829)..(829): n is a, c, g, or t
caaagatgaagtggttggttcttctttccgtcgtaacgttaagtacagcttcgccaactctccgcggcagacacctttccatcggtgatgatcggaactcgtaactcttatcggatctaacggtttcgaaattgatatattcaaaagtgttactgaccccagcatcgttgatgtcatcctaagaagcccacgtggacctaccaggtcttttcaaattgatgaggtcaacaatatcagagaagttagtgaccgtaatgtcttcggatattccagatatcatgacttcaaccaggctgatatccttgcccaaatcttccgtcagtaccaaggttctatagcggaaaaccaatactacagtcttctaaacagaatccaattgttggtcgaaggaggagttcttaacgaagctatctatgatgttttgagggaatgggaaccagtacaatttgcaagatgttaggaacctcgatagagaaactctaatccagcctcttcaatccactttggaagannnnnnnnnnnnncgnnnnnnnnnnnnnnnnnnnnnaaaatctggaaagtattttgatctagaggatgaaaaccttgatcttcttttaggagaaaagtataacactgacaaaattttgaaacttatttacaaagaacaaattgggccagttgccaataaatccttcaaatggtacttttgatgaggccaaatgggagaagacaaacctttagatgttaattttcgntgataaattcgtaaaaaatgaggattcaattaatttgaannatcaagagttcatcgataataaagatatcgcttcnacatacctgattttcnaacaaggttcttataaatgaaggtaagaaaggtcattcaacactagcatacatcaaatctaattatcgacaatgaa

SEQ ID NO: 12043 - DNA, 822 bp, Diabrotica virgifera
  misc_feature (272)..(272): n is a, c, g, or t
gatgagtgattattttctattaagatatcatatatcatttagtaggagataacaggtaatattactgctatatgaatccaggatctggtttcgtgcatggtaatctttttatgaatagatgaattttagtccgtttggaacactatgaagaactcagaaggaattatatgatttaggtacactcatcactatataactatattcctcagagagttcactcagacgcataaatagaatttacagatttattaattagattttatagcatcctntgtaaagtagagtctcttgttagaagatcgcataatcgcctcatgtacatattgtctaaagtgattgtcctcaatctttcttagaagacaatcagagttatcatattcattctatatcttcggataatagttcaattgcctacaataattaattgatattcattgctgatcaattcttcttaagaggataccccactctgaaattcttctaaaatgttaattccttattgtaatacatctaggaatgaagacaattcgataatatacgacatgtgatgatttataatactatacctccattcatatacttgatctccgttgaatcagctaatgaattcatctaatgacacaatgaggaatgactgagaatatcttcaatgaacaaaccgctaatattgaagttgtctataacttcctgaaggttgcttctgcatcgtactatactcctgttgatatctcacacgatcttgttgatcatgtataatgtctcgctggccccctgattatcttgatgtgtccgaagtattatgaccgtgctaaagcttactaa

SEQ ID NO: 12044 - DNA, 121 bp, Diabrotica virgifera
  misc_feature (6)..(34): n is a, c, g, or t
  misc_feature (48)..(117): n is a, c, g, or t
taatcnnnnnnnnnnnnnnnnnnnnnnnnnnnnngaggggttggatgnnnnnnnnnnnnnnnnnnnnnnnnnnnnnnnnnnnnnnnnnnnnnnnnnnnnnnnnnnnnnnnnnnnnnncgag

SEQ ID NO: 12045 - DNA, 677 bp, Diabrotica virgifera
  misc_feature (5)..(20): n is a, c, g, or t
  misc_feature (23)..(65): n is a, c, g, or t
  misc_feature (73)..(183): n is a, c, g, or t
  misc_feature (195)..(305): n is a, c, g, or t
  misc_feature (307)..(471): n is a, c, g, or t
  misc_feature (473)..(556): n is a, c, g, or t
  misc_feature (560)..(580): n is a, c, g, or t
  misc_feature (584)..(650): n is a, c, g, or t
caacnnnnnnnnnnnnnnnnccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnncggnnnnnnnnnnnnnnnnnnnnntggnnnnnnnnnnnnnnnnnnnnnnnnnnnnnnnnnnnnnnnnnnnnnnnnnnnnnnnnnnnnnnnnnnngagcatatcatttagtttttttattga

SEQ ID NO: 12046 - DNA, 739 bp, Diabrotica virgifera
actattttacctattaataaataccaatagatttcagcactgtctgaactggtgtaatgtagaattgatgatgattatagaagctattatattcatttaccctagatgctatcagtgcgttatatataaagtgatagagatcagcgtttcgtctataaccgatgccgtgcagagattgaggatgccccactcgatatgattaatgatggataaatgactattgtgacattactgacagactctacagtgttaattgagaacgcatagcagcccaaggtagaacaggaatttttatctcggcgaaacaactgaaatgtattcaagaagtatcttgctgtatgtcccggatatctttactaacagtagacatataactttagcatgaatactagatttaccagttatgaatgatgtaaaatgtgcacggaggaatatgtaagacgacatcatatattgtcacagttagttcctgaaggaacgcctccgatcttaatgccatttatagcttgaactcaaacaatgagacatgtaagacgacctggaacattagcaggacgtttaactgctaatataagctcaggagactcattgataactcatctaagatatactgtgacaatactatgcacgctatagaccagatatattgattagagcccaggttgtgctattgattctagacacagcagtatgtatatttctgtcttatgtatttgctgttttagaacacgatattcta

SEQ ID NO: 12047 - DNA, 1003 bp, Diabrotica virgifera
  misc_feature (6)..(992): n is a, c, g, or t
cgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttttga

SEQ ID NO: 12048 - DNA, 530 bp, Diabrotica virgifera
  misc_feature (21)..(389): n is a, c, g, or t
  misc_feature (402)..(421): n is a, c, g, or t
  misc_feature (443)..(461): n is a, c, g, or t
  misc_feature (463)..(529): n is a, c, g, or t
taatgaaatcgttattcgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggtctttttggnnnnnnnnnnnnnnnnnnnncgcccaccgattaatttgaacnnnnnnnnnnnnnnnnnnngnnnnnnnnnnnnnnnnnnnnnnnnnnnnnnnnnnnnnnnnnnnnnnnnnnnnnnnnnnnnnnnnnnng

SEQ ID NO: 12049 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12050 - DNA, 749 bp, Diabrotica virgifera
  misc_feature (2)..(46): n is a, c, g, or t
  misc_feature (55)..(164): n is a, c, g, or t
  misc_feature (176)..(537): n is a, c, g, or t
  misc_feature (564)..(583): n is a, c, g, or t
  misc_feature (597)..(623): n is a, c, g, or t
  misc_feature (625)..(661): n is a, c, g, or t
  misc_feature (680)..(694): n is a, c, g, or t
  misc_feature (696)..(744): n is a, c, g, or t
cnnnnnnnnnnnnnnnnnnnnnnnnnnnnnnnnnnnnnnnnnnnnntacctcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttattaaaaacacgtctttttggnnnnnnnnnnnnnnnnnnnncgcccaccgattannnnnnnnnnnnnnnnnnnnnnnnnnngnnnnnnnnnnnnnnnnnnnnnnnnnnnnnnnnnnnnngcgggaatggaagggttgnnnnnnnnnnnnnnngnnnnnnnnnnnnnnnnnnnnnnnnnnnnnnnnnnnnnnnnnnnnnnnnnatttc

SEQ ID NO: 12051 - DNA, 98 bp, Diabrotica virgifera
  misc_feature (13)..(73): n is a, c, g, or t
  misc_feature (86)..(86): n is a, c, g, or t
aagacgagaaacnnnnnnnnnnnnnnnnnnnnnnnnnnnnnnnnnnnnnnnnnnnnnnnnnnnnnnnnnnnnntaattattttaanttggggtggata

SEQ ID NO: 12052 - DNA, 816 bp, Diabrotica virgifera
  misc_feature (11)..(28): n is a, c, g, or t
  misc_feature (84)..(101): n is a, c, g, or t
  misc_feature (165)..(202): n is a, c, g, or t
  misc_feature (206)..(237): n is a, c, g, or t
  misc_feature (281)..(301): n is a, c, g, or t
  misc_feature (325)..(369): n is a, c, g, or t
  misc_feature (376)..(393): n is a, c, g, or t
  misc_feature (395)..(440): n is a, c, g, or t
  misc_feature (509)..(544): n is a, c, g, or t
  misc_feature (546)..(632): n is a, c, g, or t
  misc_feature (691)..(725): n is a, c, g, or t
  misc_feature (727)..(739): n is a, c, g, or t
  misc_feature (742)..(755): n is a, c, g, or t
  misc_feature (774)..(790): n is a, c, g, or t
  misc_feature (793)..(813): n is a, c, g, or t
ctctctctccnnnnnnnnnnnnnnnnnnctctcattaacgacgttaattcgtaccgtcgagagaatatctctctatctctctcnnnnnnnnnnnnnnnnnnctctttccgtacctccgtcgtatcagggattatctcaattaataattatcatcatttatcatcnnnnnnnnnnnnnnnnnnnnnnnnnnnnnnnnnnnnnnatcnnnnnnnnnnnnnnnnnnnnnnnnnnnnnnnntaatcgaaacgttattcgtttttcaaatatcatctaattttttnnnnnnnnnnnnnnnnnnnnncttatctaacaatatcatttatcnnnnnnnnnnnnnnnnnnnnnnnnnnnnnnnnnnnnnnnnnnnnncgagctnnnnnnnnnnnnnnnnnncnnnnnnnnnnnnnnnnnnnnnnnnnnnnnnnnnnnnnnnnnnnnnnctttaaaatacgttatctaattacttttaaatcatctatctatcttttattttttatcaaattttttcnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaaaacacgtctttttggatttaaatataaaggtctcgcccgcccaccgatannnnnnnnnnnnnnnnnnnnnnnnnnnnnnnnnnngnnnnnnnnnnnnnagnnnnnnnnnnnnnngctggaatggaaggagtgnnnnnnnnnnnnnnnnntcnnnnnnnnnnnnnnnnnnnnnctc

SEQ ID NO: 12053 - DNA, 903 bp, Diabrotica virgifera
  misc_feature (804)..(804): n is a, c, g, or t
cgtttatttatttgttatcgttaaggctagtacgcagtttgtttattatttaaattaaagcattattaatttagtgtttattgttgatcgtagtataactcgtggtataactttggaatatggctcgcagagcaaattatgcagtgtccactatgtttggaaactacgtcaccgcccataatccagtgcaaagtcggccatagcatgtgtggttcgtgcattaaagagagtggtatcaaaatgtgtccaacctgtcgggagaagctaactactacaagaaattatcaactggaacaattgatagaaggaataaaagatgttcttaaattcgattgtgcttatcagcataaaggttgcaagttcgcagtcaacaagcaagataaagaaaatcacgaaagagagtgtaaatttaggaagtttacctgcgagggaaagagatttgcaaagtggtcatgcaattggtccggtgattattcagaaatttatcaacattttaagagagatcataaagataataccagacttgagtttaaaactgatgcagtgatgaaagttagcctaaaaaccagcttcaataatgtctatctaatatctttattcagtggacaaagttatttatactgcaagcaccgagttgacacatcgaataaaaagatatacttccattttcaattcataggactaaagagtcaagcacaacactattactacgaatttgaagtttacaaaggcactagaaagtttaaaattactgaaatatgcacaagcgacacatcaaacattgatataacgtttgctgaaganaaatgcttcgtaatgtcttttattgctgtaaaaaattatttgaacgaagagggagagctccccttttaatttagggatatgtccactaagaaaacgtct

SEQ ID NO: 12054 - DNA, 832 bp, Diabrotica virgifera
  misc_feature (11)..(30): n is a, c, g, or t
  misc_feature (32)..(75): n is a, c, g, or t
  misc_feature (78)..(91): n is a, c, g, or t
  misc_feature (93)..(120): n is a, c, g, or t
  misc_feature (128)..(238): n is a, c, g, or t
  misc_feature (251)..(439): n is a, c, g, or t
  misc_feature (441)..(627): n is a, c, g, or t
  misc_feature (629)..(660): n is a, c, g, or t
  misc_feature (674)..(742): n is a, c, g, or t
  misc_feature (762)..(810): n is a, c, g, or t
  misc_feature (813)..(829): n is a, c, g, or t
tatttattttnnnnnnnnnnnnnnnnnnnncnnnnnnnnnnnnnnnnnnnnnnnnnnnnnnnnnnnnnnnnnnnnccnnnnnnnnnnnnnncnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnngcccactggattannnnnnnnnnnnnnnnnnnnnnnnnnnnnnnnnnnnnnnnnnnnnnnnnnnnnnnnnnnnnnnnnnnnnaatggaggggggtggatgannnnnnnnnnnnnnnnnnnnnnnnnnnnnnnnnnnnnnnnnnnnnnnnnagnnnnnnnnnnnnnnnnncga

SEQ ID NO: 12055 - DNA, 858 bp, Diabrotica virgifera
  misc_feature (8)..(120): n is a, c, g, or t
  misc_feature (129)..(405): n is a, c, g, or t
  misc_feature (407)..(487): n is a, c, g, or t
  misc_feature (518)..(537): n is a, c, g, or t
  misc_feature (551)..(579): n is a, c, g, or t
  misc_feature (592)..(615): n is a, c, g, or t
  misc_feature (632)..(646): n is a, c, g, or t
  misc_feature (648)..(693): n is a, c, g, or t
  misc_feature (703)..(703): n is a, c, g, or t
  misc_feature (722)..(722): n is a, c, g, or t
  misc_feature (726)..(752): n is a, c, g, or t
  misc_feature (754)..(796): n is a, c, g, or t
  misc_feature (806)..(854): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnncacccgtttattaaaaacacgtctttttggnnnnnnnnnnnnnnnnnnnncgcccaccgattannnnnnnnnnnnnnnnnnnnnnnnnnnnngctaaggtagcannnnnnnnnnnnnnnnnnnnnnnnccggaaggaaggggtgnnnnnnnnnnnnnnngnnnnnnnnnnnnnnnnnnnnnnnnnnnnnnnnnnnnnnnnnnnnnngcttaaattnttttaaaagacgagaaacnctannnnnnnnnnnnnnnnnnnnnnnnnnngnnnnnnnnnnnnnnnnnnnnnnnnnnnnnnnnnnnnnnnnnnngtggggtgannnnnnnnnnnnnnnnnnnnnnnnnnnnnnnnnnnnnnnnnnnnnnnnntttt

SEQ ID NO: 12056 - DNA, 794 bp, Diabrotica virgifera
  misc_feature (9)..(385): n is a, c, g, or t
  misc_feature (387)..(424): n is a, c, g, or t
  misc_feature (426)..(681): n is a, c, g, or t
  misc_feature (686)..(766): n is a, c, g, or t
tgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgnnnnnnnnnnnnnnnnnnnnnnnnnnnnnnnnnnnnnnnnnnnnnnnnnnnnnnnnnnnnnnnnnnnnnnnnnnnnnnnnngaataattaccttagggggatacagcgt

SEQ ID NO: 12057 - DNA, 297 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
  misc_feature (199)..(237): n is a, c, g, or t
  misc_feature (239)..(293): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaaccgtgtgagccagggtgggtttcatctttattttataatatatttttaaacgaaaggacnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnngccc

SEQ ID NO: 12058 - DNA, 754 bp, Diabrotica virgifera
  misc_feature (31)..(54): n is a, c, g, or t
  misc_feature (91)..(118): n is a, c, g, or t
  misc_feature (128)..(236): n is a, c, g, or t
  misc_feature (249)..(296): n is a, c, g, or t
  misc_feature (302)..(325): n is a, c, g, or t
  misc_feature (337)..(361): n is a, c, g, or t
  misc_feature (363)..(384): n is a, c, g, or t
  misc_feature (386)..(442): n is a, c, g, or t
  misc_feature (456)..(637): n is a, c, g, or t
  misc_feature (640)..(659): n is a, c, g, or t
  misc_feature (668)..(745): n is a, c, g, or t
atttcactccaaataataaaatcttttctcnnnnnnnnnnnnnnnnnnnnnnnntaacgatagttaattagtaccgcgagagaatctttcnnnnnnnnnnnnnnnnnnnnnnnnnnnngtacctcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcgaaacgtnnnnnnnnnnnnnnnnnnnnnnnnnnnnnnnnnnnnnnnnnnnnnnnncttacnnnnnnnnnnnnnnnnnnnnnnnncttttatactannnnnnnnnnnnnnnnnnnnnnnnncnnnnnnnnnnnnnnnnnnnnnncnnnnnnnnnnnnnnnnnnnnnnnnnnnnnnnnnnnnnnnnnnnnnnnnnnnnnnnnngttattatttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnntgagggttg

SEQ ID NO: 12059 - DNA, 478 bp, Diabrotica virgifera; identical to SEQ ID NO: 9465
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t

SEQ ID NO: 12060 - DNA, 242 bp, Diabrotica virgifera
aaaggacaagcaaaaaacaaagaagacggcacacagacaagaagggagcacaacgagcaaaacgcacaagacaaggcacaaaggcaaaacaaaaaaacaagacacacagagcaaccagaccacacaggcacacacaaggagaacaaaacaagacacaggaaagcagagacacagacaaaaagaagcggagccaagcggcgaaccgcacaagcaaaacgagcaacaacgccgacaaaagaaaa

SEQ ID NO: 12061 - DNA, 755 bp, Diabrotica virgifera
  misc_feature (546)..(561): n is a, c, g, or t
  misc_feature (724)..(724): n is a, c, g, or t
agacatcacaacaatgtaaactccagacatcgaaactcataaatcttaatgccgccggcacgcgacacccaaatctcagatcaagttccggttcctccgtacactcaccggtaatcttctctcgctagtcatctaagaaactcttctcaccgaataatatcggtcttttagatagacgggctcttcgtcattttcacggaactcgtggaaagacgtcgcagatttcgagtcgtaaagggagacggtcgtatcattttttttcgcggaatatcaatatcagatttctttcactaactcagaggacgggatcggtaaatagacatcaaaagttgaatttctcggggagtaatcatcgatcgaggtcttcggctcggaaaaacatcgcatcgggtttacgaattaagcaaacagtttctaaaatatataaagatggaagggttaaaattccgtgatctttcgaagtaacttctgcaatgtgttgttcttctgaggccaaacagataccttattggtattttttggtaatttaaaaataacatctaattnnnnnnnnnnnnnnnnaaaaccccaaaaaggaagaacatatcgaagaagagaactcgaataaggaaaaatatggtagtttagaagaaggtaaattgagttctttcgaaacagatcttatagcatagcaagctgaggcgagtttcttacttaaccaatcgatatgaagggaccatttganggttgtggtctaaaaaatacaagaaatttta

SEQ ID NO: 12062 - DNA, 651 bp, Diabrotica virgifera
  misc_feature (335)..(353): n is a, c, g, or t
  misc_feature (375)..(400): n is a, c, g, or t
  misc_feature (634)..(650): n is a, c, g, or t
cctacctaggacgtccgaattttttacatgttttgagccaatttctttaaaaaggaccgggagggagaagggaaagggaaaaaaaaacggagaagagagggaagaaagaagggaattccttagtatgagtctcgagattttaataaaaaggtagaaagtttgagagaggtgttgatatataatagattgatgaagataacatctaagtgagatgaaaaggatgaagaagacgatgaatagggagttgaaaagtgaataggagcgggttagaagggtagaaagggccgatggattcttaattgtaatatgagaagtagagtaaaatgataaagttnnnnnnnnnnnnnnnnnnngagatagagaattattggtagnnnnnnnnnnnnnnnnnnnnnnnnnnttggagaactttaagagattgggaatgaagtatttgattaggtatcgaacataatgtgtgaatttggtgataaaagtgttgttatattaggtttattgatttgtccattactaacagtgaaggatattgtaatatggatacactattttgctgatgaaatttctatcggattaggatggtaaagattttaaagagtaattggagataaagttagtgataatagtttataatgannnnnnnnnnnnnnnnng

SEQ ID NO: 12063 - DNA, 493 bp, Diabrotica virgifera
cctcttgctgtcctgtgggttgcgcggtgtttcgtggttttccctctttttgttgggtggccttgtggttttggtcttggtcggggtgttctgcctccccgtgttttttctcgctttgttttctggcctgtcttcctccgtcttcgttgtcgcgtggctgttcttccggtgggtttggtcgttcctcctccggttttccgcttctctcctccctttggctctcttgctgcctccctgttcttttgggtcttggttgggtcctggcccgtgtcggcccttccgctgtgtggttggttcgcgggtccggctgtggctttggttgcccggttggcgggggctcctgctctttttccgctcgcgttgtgggctggtgccttttccgttccttcgctgttcgggctcgtttccgcccccttgggtgttgttgctctcgctgttgtcccggttgtgttggttctgttccttccggccctctgccggttcgtgggtgtcc

SEQ ID NO: 12064 - DNA, 845 bp, Diabrotica virgifera
  misc_feature (807)..(807): n is a, c, g, or t
gggcaaaatcacagggttcgagaacattcaaaatggccattgaaattaaagatcaatttaccaaagaatgtggccacaggtctattttaaaacagcaagtatcgcatctttagcaacaccttttggttgtttctttgctggtccttttgcggatcgatatggaagaagaatggcactttttttcgttaatatcgtatgcctgttaggatggataacaattgcagtattttgttacgccaaaccatctcatttctggatcctgttattgggaagagtgttaactgggctttcaacaggactatgtagttccccagcaaccgtttacatggctgagatatcctcgcctgacttgagggggatcttcactacatgggcctctgtatcattttcattgggagtgttggtagtatacttcttgggatttctttttcagagcaatcttggagcaatttgtttgataactgcagtatttccgtgcgtgggaatcttattctcaatcttcttgataccagaatcaccaacgtggctggtaggaagatatcgaacggaggaagcaagatctagtttgtgcagaattttcaatactggactaactcctgatgtacaagcagagctggaccatttaataaaatggcaaaggagtggtcgaacatgaaatcagaaaagccaaggtataggaaaattttaagcaagttggaatatctaatggcaacctcattggttaagagcgatggattttgggttctaacctacttcttcttcaacaattcagtggggaatatttgttatcatcttttacgctatagnatatcgttaataatggtgggcataacattcgatcctac

SEQ ID NO: 12065 - DNA, 784 bp, Diabrotica virgifera
  misc_feature (16)..(116): n is a, c, g, or t
  misc_feature (118)..(384): n is a, c, g, or t
  misc_feature (386)..(502): n is a, c, g, or t
  misc_feature (504)..(535): n is a, c, g, or t
  misc_feature (548)..(608): n is a, c, g, or t
cccctcccgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnncaatggccgcgtnnnnnnnnnnnnnnnnnnnnnnnnnnnnnnnnnnnnnnnnnnnnnnnnnnnnnnnnnnnnncgttgcatgaaaaaaaaacagtctctatttaatctataaagaatttcatttttaagctaaaaagcttatattttttcaaaagactataacaccctatatagttctataaaattattaataactttgtttagtatatactttgtttatataatagatttatttcattgatgtgatta

SEQ ID NO: 12066 - DNA, 659 bp, Diabrotica virgifera
  misc_feature (403)..(429): n is a, c, g, or t
  misc_feature (442)..(476): n is a, c, g, or t
cttccgcgtccggttcttattcttggctttatcttattaaaattttcacagatattgttgtattcggtgggaatataaaactaaagtatggaattaacacaagaagttagtgtgaagacttataaaatagaaatagataataatcaggtgtgtgatgatcctttaagtaccttcaaaattgaaataaaagaggaacccaagcgagaacatacatacgatgcatttgactattcagaattccatcaacttgctgaaaacactgaattagaacaagatgaatataaatttaacctatttgaagaaaatcaaacaaaaaatgatgaaggttgtcccaaggaggagaacaaaatggaaactttacctgcgcattcatctcgggaagaaaactacagaggtcaacacnnnnnnnnnnnnnnnnnnnnnnnnnnngtggaagttgtgnnnnnnnnnnnnnnnnnnnnnnnnnnnnnnnnnnnaaagcagtttactataagcgattctttaaaacaacatttgagagtgcacactgtagaaaaacctcacaagtgtgaaatttgtgtaaagcaatttatgcaagcaggtgatttgaaaagacatttgagagtccacactggagagaaatctcgcaagggagatgtttatttgaaccaaattttctc

SEQ ID NO: 12067 - DNA, 905 bp, Diabrotica virgifera
  misc_feature (210)..(253): n is a, c, g, or t
  misc_feature (304)..(321): n is a, c, g, or t
  misc_feature (794)..(794): n is a, c, g, or t
  misc_feature (878)..(878): n is a, c, g, or t
gttagacgagaaactacataagtttattattgtttctcgtgtttatattatatctacagtgtatcgagtgttctttatcgttatcagattgatgaaggatgtcattaagtgaacaagtgaacaactagggatgttaaattatgtgtggtgtttttaacgattaaaataaataataaggtcaagatgagacgtgctcaaatacttggattnnnnnnnnnnnnnnnnnnnnnnnnnnnnnnnnnnnnnnnnnnnnaaacaattctgcaaaatatacaccaagttataaagtacttgaacgggacgnnnnnnnnnnnnnnnnnnctctaacacaaaatggatatattcagttcttaaaatatattaacgatgttcctccaataaccgactacacattttgcatttggttgagaagtcacaatcttacgcataatcatcctattttatcttactccaaaaatgaagaagaaagtcttatacgtgtatggatagctcaatatggtaaaagcattaatttagaaataagtggtggtacctattttcgaatttccgtcaaattttattgaaaatagatggtatcatggatggccaatcgtggtcatcatttcaagcggcatgggtcattatacataaatggaaagcttaaatctactgggatcagtaccaaagttaaggaagggtcgttcatttaaagggaggaggcgacatagttatcggacaaaatatactgattttgacaaggactcgatgatggaatagagggatataatttcgggttttacctttgtattatcttncactatcaataaccaaaaacataataaaccagttttctagcaaaccgcagtatcagaaatctcaacacaaaacacacccacaangttaagatagagccgcatcagatctca

SEQ ID NO: 12068 - DNA, 923 bp, Diabrotica virgifera
  misc_feature (275)..(289): n is a, c, g, or t
tcacgaggcccaggtccgcagttcttacctaaacaactagaagctcaaccgaaccaaaaattgaaggagcaaaccatcagaagtcgtctaacggagttgaacacgacagttcaagagtgtctatctatgatacaagcagcggctaggggaaacccctttcatttatccctacactttaaagatcttctcccgactttgctccaagacttgcagtcgcctctagccgcacctctcatctgcaagctcttcaccagtctccgaaaaactgtgttttnnnnnnnnnnnnnnnccttgggagaactggtggctaacttgaccttgagattagccaatcctcagtgtgatttggactccaactgggaatcagagaacattaacaaagccatggtgagagctgtggctttgatccacgataagactgtacccaaaaagactgaagatcattcagaaatgtgttttacagttccagctttttgctacattttccctttcttaaaatacagtttagtctcaaattacgctaggaaccacgatgagttagtacacgacggactccaaatcatagcagagcacgccaaattacgaggaaccgaagaaaacggcgtcaaagatatctatcatcacgatacttgcctaccaaacagatccttagcctccttgtaggaatcataaactcaacacacggtagagtacaatcccaatgcgaagcttgtcttttagaagtggcttcttgtataagcggtcaactaggctgtgccaaagctagcactgacgaaatagatgtgctgctaggtgccttgcagagccccttttcagtactgagagacgccgcactcagaggactaaccatagacatattggcacttcctacttttgagaaagactacgcctatgtcattaaagttttcaaaagagtttggatc

SEQ ID NO: 12069 - DNA, 728 bp, Diabrotica virgifera
cccacgcgtccggtgctggagtaataaccgaaatcatataaaagagataatttctattgtgaaccgatttttcaaaagtttctacattaagtacatattcattactaaataatggacgaaaacgaaaatccagaggatttggccaccgcaattctccgtaagaaagatcgtccgaatagacttttggtagaagaagcagataacgatgataactccgtggttgctttgtcgcaagcaaaaatggatgaactacgacttttcagaggagagacaggcctactgaagggcaagcgagggagagaaactcgtttgtatagtattatgtgatgatacatgtagcgatgaaaaaattcgtatgaatagaaatgttagaaataatttaagagataggctttcaaatgtagtttgtatccaaggttggcctggagtaaaatatggtgagagaatacatcggacttcccatggatgatacagtggaaggactcacaggaaatctcttcgaagtataacctgaagccctactcacctggagagctatcgaccagtacacaaagatggacgtattcggagtacgtggtggaaggagagctggtgaattcaaaggcgtcgagaccgatcccgcaccggactcgaaagtggctccagatagcggcattcatcgggacggagatccaaacaagcgcgaagaggaggaagaagtccgtaacgcagaggtatacggcgacatc

SEQ ID NO: 12070 - DNA, 950 bp, Diabrotica virgifera
  misc_feature (665)..(711): n is a, c, g, or t
  misc_feature (871)..(871): n is a, c, g, or t
  misc_feature (896)..(896): n is a, c, g, or t
  misc_feature (931)..(949): n is a, c, g, or t
ctttaatgagcaaacatatagtgcgtacaattcattacgatcaaaatgtgaatcacggcaaattgtttttggtgcggcagaatacttctttgcgtttatggataatatccttgtgatttctggcaaggaatagtaaacatttttttcgttatttccgtcctagaactattttttccacagtgttagttattttcttggttgtagtgagaacaagaataattagagatggcaccaacagcaactataatttcaccttccagcactttgtcttctccatttgctcttagcagaacccaacaagattatggctgtaatggatcattaaattcattactcagttcgtttccagctaccaattggtgtcattatcaaaacaacgaccaatatcaaacgaaacttctaagtccgacatggagtgcttattcaacaaaccaacagtattcctttaacctttacagtccaacatactcgaacctaagcgcatgtgatcatttaggagatatcactgaacagctcgctgacttatcactggacagaagacagatcaaacgaccgcctccatcgtatttgtgccatttgtgtttccaaaaggggcactatatcaaggattgtccacaggctcggcccaaaggtgaaggaaaaactccataccaaggtagaaagcnnnnnnnnnnnnnnnnnnnnnnnnnnnnnnnnnnnnnnnnnnnnnnntcaggtaactcctggtcaaatatgggacaggaatgtattaaatgccacatcaatgtttttccacataaacaaagaccgttggaaaacccgatgggattggatgtatccgaccaatcgaaagtccatcctcagcatctatgccaaaaatgtaaagagctgngatattactgtaggcgagtacatanaacagaaatacctccacctgtttttgtttcattcnnnnnnnnnnnnnnnnnnnc

SEQ ID NO: 12071 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (157)..(157): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtggagcccagggntggttnnnnnnnnnnnnnnnnnnnnnnnnnnnnnnnngaaagg

SEQ ID NO: 12072 - DNA, 851 bp, Diabrotica virgifera
  misc_feature (2)..(23): n is a, c, g, or t
  misc_feature (25)..(37): n is a, c, g, or t
  misc_feature (47)..(98): n is a, c, g, or t
  misc_feature (100)..(119): n is a, c, g, or t
  misc_feature (123)..(135): n is a, c, g, or t
  misc_feature (138)..(163): n is a, c, g, or t
  misc_feature (179)..(254): n is a, c, g, or t
  misc_feature (256)..(307): n is a, c, g, or t
  misc_feature (309)..(335): n is a, c, g, or t
  misc_feature (343)..(379): n is a, c, g, or t
  misc_feature (381)..(426): n is a, c, g, or t
  misc_feature (428)..(441): n is a, c, g, or t
  misc_feature (450)..(477): n is a, c, g, or t
  misc_feature (521)..(545): n is a, c, g, or t
  misc_feature (552)..(578): n is a, c, g, or t
  misc_feature (580)..(645): n is a, c, g, or t
  misc_feature (655)..(692): n is a, c, g, or t
  misc_feature (694)..(742): n is a, c, g, or t
gnnnnnnnnnnnnnnnnnnnnnngnnnnnnnnnnnnnagctcatccnnnnnnnnnnnnnnnnnnnnnnnnnnnnnnnnnnnnnnnnnnnnnnnnnnnngnnnnnnnnnnnnnnnnnnnngagnnnnnnnnnnnnnagnnnnnnnnnnnnnnnnnnnnnnnnnngatatgtgattattgnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnngnnnnnnnnnnnnnnnnnnnnnnnnnnngcacctgnnnnnnnnnnnnnnnnnnnnnnnnnnnnnnnnnnnnnannnnnnnnnnnnnnnnnnnnnnnnnnnnnnnnnnnnnnnnnnnnnncnnnnnnnnnnnnnngtcattagnnnnnnnnnnnnnnnnnnnnnnnnnnnnctggatgaaagaaaaactggcttgatttaagttataaagaatgnnnnnnnnnnnnnnnnnnnnnnnnngtgttgnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnncgattaaagnnnnnnnnnnnnnnnnnnnnnnnnnnnnnnnnnnnnnngnnnnnnnnnnnnnnnnnnnnnnnnnnnnnnnnnnnnnnnnnnnnnnnnntaacagcgtattttatttgtagagttcaaatcgataatagagatggcgacctcgatgttggattaagctcataatcggtgtagcagctatatcactacgtctgttcgac

SEQ ID NO: 12073 - DNA, 894 bp, Diabrotica virgifera
  misc_feature (57)..(76): n is a, c, g, or t
  misc_feature (400)..(426): n is a, c, g, or t
  misc_feature (785)..(785): n is a, c, g, or t
  misc_feature (792)..(809): n is a, c, g, or t
aatattagcagatattgggtgtccgccatatctcgaacgatatattaattgcgtgannnnnnnnnnnnnnnnnnnnagttgattgtttggtttgtttaatgtgaaatagtaaatacataaagatcacaaaatggagtttgtcaaagaaaatttaggtttagtgttatttctcacaatattccttctaatatacatatactacaaaaatgcctacaaatactggaaaaatatgggagtgccccaactggatccagagtttccctttggagatatgtacgataccatatttaggaaacaaaatatgggcgataaaataaaggaaatatatgacaaaatgaaaggtcggaggtttgttggtctatatttctttagccggaaagcatttttgccactagatccnnnnnnnnnnnnnnnnnnnnnnnnnnnggatttccaatacttttacgataggggaatttactataacgaaaagaaagatcctctaagtgctcatttattttccattgctggtaccaaatggaaaaacttgagatccaaactaacaccagcgtactcacccggcaaactgaaatacatgtttggaactatagataagtgcggccataccatgacgaaaaagctacaagaaattgccaacgagaaaggtgaagttgaaatcaaagaaattctagctagatatacgaccgatgtaataggctcgtgtgcctttggactagaatgtcattgtatgactgatcccgaagcggagtttagattgatgggaaaaagagcgtttacccaaactngttgggnnnnnnnnnnnnnnnnnngtaattcggagttttccacccatagccggtttattaggtctttggtgtatttttccggaaacgtcacagactttttttaaccgag

SEQ ID NO: 12074 - DNA, 813 bp, Diabrotica virgifera
gtgaatagcagatctttttaaaagagcaattcttttaaattttttactaggacatttatgtattcatatatacttgattaaaaccatttaacataaggtcagcatggactcatttaattgagaatattttatcatatatatccgataacggagatgttattacttaataattaacttccgcatttaacgaaaaccatcataaagttattggagccttataaagtattctagcccatggagatttagttgtaccatagccagtctgtaataataaacttgaacttactgaagaaggaaaatcaatagctgaaaaaggcagctatgaagctatgatatataatattcttgatgaaaatggattacctcaagctgaagtaatgatactacacaaatgccataaatatgagttttagaagagcaatgacatcaggatgggaagaaatagataaatctgttacacctccaatggagaaaaaaaaagtgcctcaaattaatgacgtaattcatgaacacctcaaacaaattttgactgaagatatatcctcaataatatcagatgaagaaaaacaggagtattataagaggaaacttattcaacaagtggctgtgataacctctgattaatagaaaggaccgtaattgaatcttactcttacccagctacagacacatcttacttgtgaaaggataaactctggtgcctggaataacttgaaattcacagaatacaacttcaatgcactgtgtgcacctttgagctccgaatatcttcatgcgttgctctaagttctatctaaattcatgcatatcttc

SEQ ID NO: 12075 - DNA, 789 bp, Diabrotica virgifera
  misc_feature (2)..(600): n is a, c, g, or t
  misc_feature (609)..(682): n is a, c, g, or t
  misc_feature (691)..(773): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactgnnnnnnnnnnnnnnnnnnnnnnnnnnnnnnnnnnnnnnnnnnnnnnnnnnnnnnnnnnnnnnnnnnnnnnnnnngaatgaagnnnnnnnnnnnnnnnnnnnnnnnnnnnnnnnnnnnnnnnnnnnnnnnnnnnnnnnnnnnnnnnnnnnnnnnnnnnnnnnnnnnaagacgagagacccta

SEQ ID NO: 12076 - DNA, 693 bp, Diabrotica virgifera
  misc_feature (389)..(435): n is a, c, g, or t
agttattgtaaaatagatttcatcttcttctaaagaagatgatagaatatgatttatggatataaattgactgtgagatataatattatattcttatacaagagaaattaaatttttcgcccgcttcagtcttaagaagtattactttttatgtatatcttgatcattttcaaattgaagatattcaagaatttaccctcttgattgaggatctctcataatcaataatttatgtgatatgaaatgtaatccatgctaaaggatatctacctttttattatgccctcttcccctatttgtactatatatctttatgcctacatagactcatatgatcttatgttagattactcttacccacgtacttacgaggaacctattagtccaannnnnnnnnnnnnnnnnnnnnnnnnnnnnnnnnnnnnnnnnnnnnnnataatggaattacctgtttctatatctgatacttctcatgttccctctatgttgcagtatatcatccatcataatctgttcagtgaagtgacgatgaatctactgatataaacaacctgtatatgtatgctttgaatgtccgtgctttcgaggaattcccggacattattttcatgctgtgctctcaagacgtcgttgttcgtgtattagatgtaccgactactactgcacactgaatcttttatatgatacgaacta

SEQ ID NO: 12077 - DNA, 967 bp, Diabrotica virgifera
  misc_feature (858)..(858): n is a, c, g, or t
  misc_feature (887)..(887): n is a, c, g, or t
tttaattataaaattggcgaaagtcaggttgtgattgaagcctaaattaatcaaaatgataagaagtattattgagccttatgcttattattttaatgtttttaataggtatatttatcaattttaaaagtttcagaatcagtatcagtctattgtattcagtatcagaatacaatagaccttatataactaactcatctctgatatgttctattaataaacatccgctatctttcgtcttcttccatttaaatcccaaatattttacaatcctgtagagagaactcacacttccaatccactccagaactgtttgtcgtagtcccttaagtctgtcacaggcaggctttctttaataggtaggtattgtagctgaaaattcttgtgaattatttgatatcagatagcctttccatacgaaagctgtattaggtcttcttcatcaatatctatcattttattagtatgatgtttagtttctgtttctttttgttactcctacaactaaaaaagtaatagatatgagtccaagtttattgtgacaaaaattttgaagtcagttactaaataccatgtcatctgtttaaccaatttttgaaactgtgtgatgaatatttgaataaagcttttgaattttacttcccctttaaaacaatatataatttcacactataaaaaaccctgtttttaaaccaggaggagtaattcaaatttaccgccccgtaatggcttgtctgtaataattattggaccaacctcaaacaagtttactccactggcacctggctacactggcattttataggttaattaagttatatcggcaattttttgtgttttctgcgttattccttttantttatatttttaggccgcttttatataanaaacagttgtttttagaaatctttagaaaatatatatatttatgggattaccatatcgaaggccgacatgatcaccaaaa

SEQ ID NO: 12078 - DNA, 464 bp, Diabrotica virgifera
  misc_feature (47)..(130): n is a, c, g, or t
gaactagaaaatacaacgcgttgctattgtcgatgtttacatcttannnnnnnnnnnnnnnnnnnnnnnnnnnnnnnnnnnnnnnnnnnnnnnnnnnnnnnnnnnnnnnnnnnnnnnnnnnnnnnnnnnnggtggcggaagagaagaggcaggacgtgtatgagggggaactcaccgactccgctgaggaggactatccgcaccgaacgtcatcactccgtgaagagaaatataccgtagaaaagctctacatcgcccttgccccgcaaggacaaaacacgatggaactcccgcggcgatacgggcgctcgcgcgaggccggaaaggagcaacttaaacgtcagtgatgatccagtgaaatccgcgcgcacgaacaaagaagaagaaccgaattatgctgaaaatcttatgcacatgcgctatgtatgtatgtgactccaagcaggcactcctccgttgtacga

SEQ ID NO: 12079 - DNA, 844 bp, Diabrotica virgifera
cccacggcggtccggcgagtacgacggggttcgagcccaagattcacatgcaaaatttcagaagattacagaactctcggtccatcccttcagtcgtatctttcgcctccttccatgcttttaaattccccgattctcacgaacgttcacttccagcgggtcattcaggtacgtagatataactcgtccagaaccaaaacgtggacacggcttaggtcttactagcgaatacggagctcctccactatccaacgctctcggaagtggcgacttcggaggacatcgccggtttgagcagtgaatatggaccacctccttctggagaatatggtttacctagcagccttcccagatccaagacatccatccggacctaccggtgcttactctgaacaaaatggagaagttgttccagcacctcaagctcaaacgtcctcatcatctacttctaatcctcctaatctctcatctccagccccacaagtatcagctcaaacgggaactggagatccacttgcctcccccaccacctccaggtcaccatgggcatatataacactggtcaaaaggaaaagtaatattggagaagaatttgaaggcaatttggcaactctaggaggccgaccgagacttatagaaaacctcccaagtgaattgcaaggagtaagaagaaggagaagtccggaagtaatggcggtagttgtaagtcacgtggtacaaacgagaagctcaagaaatggactggaggtaatactaaccgtactaattcaagtagtagtttcttggagatggtcactttgccctcaattctggtcaaaacaacgaaactggtagtcatccaatc

SEQ ID NO: 12080 - DNA, 820 bp, Diabrotica virgifera
  misc_feature (744)..(764): n is a, c, g, or t
  misc_feature (803)..(803): n is a, c, g, or t
gaaacatcgtcgatgtttgtcgtcgtcattaccgtcctgttaatatcttacacattccactgcacttgggtcacttctgaagcttatagttcacctagcatagttcttagcgctagatctcacgatggaggcagaatcatctttgatgacttcagggaggcttattattggttaaaaatgaacactccagaggatgctcgaatcatgtcatggtgggattacggataccagataacagccatggcgaatcggacaattcttgtggataataacacttggaacaatactcacatcagcagagttggtcaggctatggctagtaccgaggaaaaagcctacgaaattatgaaagaactcgacgtcgattatgttttggttatatttggaggcctgactggttattcttcagacgatattaataaattcttgtggatggtgcgaataggtggaagtacggatagaggagcacacatcaaagaatgggattactattctcctagcggcgaattcagagtggacaaagagggatcacaaacgctattaaattgtcttatgtacaaaatgggctactatcgatttggccaagtgtacaccgaagggggcaaacctccaggttatgaccgtgttcgcggtggctgaaattggtaacaaagattttgaactcgacgttttggaagaagcctacacaactgagcattggctagttagaatttacaaagtcaaggatcttccaaacaggggtgnnnnnnnnnnnnnnnnnnnnngttttgggatattttttttttctaatgtattatacacanataaatttttttattac

SEQ ID NO: 12081 - DNA, 854 bp, Diabrotica virgifera
  misc_feature (810)..(810): n is a, c, g, or t
  misc_feature (850)..(850): n is a, c, g, or t
ttttgtttgtgatacatacagagaggttaaggtcaatatcggaaaatggattttattctttgcagtcttcttgcgattgcgacattatatttaatatcagcaatactcaaacacaaatcatatgtgggtgtctccgcaaaaacgcagttactttacactgtagctcttgttgtacagggtgaaatttccatattgtacatattgcttatagcatttccctcaattgtggcttttactttggcttttaagatgagagatacttatgaaaaagaagtcgacagtttttgggcagagattcttcttatagcagctttcattttatccgtttacgtccaacctcatttctcctcatttggggtactatctacttttagcgattacctagaaactgtagcgtttattccccagctatatatgatctggaacagcaaaggaactaccaaacacatgaaagtatatatccagcttttattcttgtataagttagtaaacttattatggctaatatacttaattctgattcataatttagactggttaactcgtcagtataatataaaatattccacagttgtgattctaaatttcttagtcctgtccgttgctgtattaactgtacgctctaaaaggatcctacactgcgaagaagaaaatatggatacaaaagctcaaaatattttcgtcgtcacttctggactagcaccacccattactcttaccaaacctaatgctattactgatgtcacaaatgaagctaataagcctttggtatagtattctcaaatacaaaaataacttgaacatatgaanttatttttttatacacttttgtacatattataccgaatanaagt

SEQ ID NO: 12082 - DNA, 942 bp, Diabrotica virgifera
  misc_feature (743)..(743): n is a, c, g, or t
gggaaaaagtgagcacgagtggatctcctaggacctcatggactctaccggagaacgtggtattggccggtgtaagtggtcttcccggccccgacggagcaccgagggcctaatgtgtcaagctcggtgcatggggtggaaccggtccggcagggccaaatggacccgaaggagaagctcggtaggcagggttctccaggtttacaaggaataagtggtgggcctggaagaaactcggcgtacccggaaaaccaggtccatcaggggaaagtggcatacctcgggacagagatcgggaaatgccagagagaatgctcagggcctcaagtgatattcaagtgtctggcctgggtccttttagggtatcgcctgggtgaaagagagactcggactgggtgaaccagggaagagatggagaagccggcccactcggaccagcaggtcccagtggtgatgcaggtaaagatggaaatccagggccacaagggtcttccgggtcctccaggtgtagaacggcgaaagaaagctcctggtggtgaggagcaagaggttttcaggcttctggagctggtggtaatccaggttcacccggtaagggatgggggaacaaggagtgcaaggccccattggttgggtttccggaccacaaggacaaagaggggaacgaggtttcccaggagaaagaggacttcctgggtatatcaggtctacccggattctaagggtgctactggggctcaggnagctgatggaccactagggccagatggaccacctggaccaaaaggacaccctggtttaccaggcgcaataggattaccgggattaagaggagcaccgggttcacaaggagaaaaaggagaacatggatctgtaggacctattgggcctgatggagcacaggaagaaaaggtgaacgtggacccatggggtcactagggt

SEQ ID NO: 12083 - DNA, 791 bp, Diabrotica virgifera
  misc_feature (3)..(45): n is a, c, g, or t
  misc_feature (53)..(165): n is a, c, g, or t
  misc_feature (175)..(363): n is a, c, g, or t
  misc_feature (365)..(582): n is a, c, g, or t
  misc_feature (592)..(631): n is a, c, g, or t
  misc_feature (644)..(668): n is a, c, g, or t
  misc_feature (678)..(678): n is a, c, g, or t
  misc_feature (681)..(701): n is a, c, g, or t
  misc_feature (703)..(703): n is a, c, g, or t
  misc_feature (708)..(736): n is a, c, g, or t
  misc_feature (738)..(755): n is a, c, g, or t
  misc_feature (760)..(788): n is a, c, g, or t
ccnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccactgnnnnnnnnnnnnnnnnnnnnnnnnnnnnnnnnnnnnnnnngagctaatcattnnnnnnnnnnnnnnnnnnnnnnnnnttggaagggntgnnnnnnnnnnnnnnnnnnnnntnattannnnnnnnnnnnnnnnnnnnnnnnnnnnngnnnnnnnnnnnnnnnnnncgagnnnnnnnnnnnnnnnnnnnnnnnnnnnnnagg

SEQ ID NO: 12084 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (135)..(135): n is a, c, g, or t
  misc_feature (139)..(139): n is a, c, g, or t
  misc_feature (156)..(156): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagnttanaccggtgtgagccaggntggttnnnnnnnnnnnnnnnnnnnnnnnnnnnnnnnngaaagg

SEQ ID NO: 12085 - DNA, 825 bp, Diabrotica virgifera
  misc_feature (6)..(739): n is a, c, g, or t
  misc_feature (741)..(822): n is a, c, g, or t
aatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnntac

SEQ ID NO: 12086 - DNA, 916 bp, Diabrotica virgifera
  misc_feature (2)..(839): n is a, c, g, or t
  misc_feature (843)..(915): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgnnnnnnnnnnnnnnnnnnnnnnnnnnnnnnnnnnnnnnnnnnnnnnnnnnnnnnnnnnnnnnnnnnnnnnnnnt

SEQ ID NO: 12087 - DNA, 1358 bp, Diabrotica virgifera
  misc_feature (204)..(252): n is a, c, g, or t
  misc_feature (272)..(298): n is a, c, g, or t
  misc_feature (321)..(342): n is a, c, g, or t
  misc_feature (476)..(552): n is a, c, g, or t
  misc_feature (555)..(583): n is a, c, g, or t
  misc_feature (585)..(602): n is a, c, g, or t
  misc_feature (665)..(719): n is a, c, g, or t
  misc_feature (738)..(759): n is a, c, g, or t
  misc_feature (762)..(798): n is a, c, g, or t
  misc_feature (825)..(1057): n is a, c, g, or t
  misc_feature (1066)..(1248): n is a, c, g, or t
  misc_feature (1291)..(1314): n is a, c, g, or t
acggggccggaatacccggggcgacccccccgcccgcggtaacaggaaaaaaaggacgacgaagagaccaccaagcgaccgacaaagaagccaacaacaacgaaaggaaagggggcaaccaggagggaacgggacgggaaaaaccccgaaccccccccaccgaccccacggaacagggaagcggagcctgggaaatacatcacnnnnnnnnnnnnnnnnnnnnnnnnnnnnnnnnnnnnnnnnnnnnnnnnngggccccccaaaaaagggannnnnnnnnnnnnnnnnnnnnnnnnnntcccccaggaaaggggggccgcnnnnnnnnnnnnnnnnnnnnnnaaaagaggattgtgggaaaagagggacacccccccccataaagaaggggggggtgttgtgggggtgataatatataaacacccacagagggagggagggggccgcacaagggggggggaggagggaaaaaaatnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnntnnnnnnnnnnnnnnnnnntgcgcccacagagaacaaaatatatttaggggggggggaccggcgcccccgcgcgcccgcggnnnnnnnnnnnnnnnnnnnnnnnnnnnnnnnnnnnnnnnnnnnnnnnnnnnnnnnggacgcccgcctcccctcnnnnnnnnnnnnnnnnnnnnnncgnnnnnnnnnnnnnnnnnnnnnnnnnnnnnnnnnnnnngagaagaggccttctctccccttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccacttcccttccctctcccctctcccctctcccccctcctnnnnnnnnnnnnnnnnnnnnnnnngcccgcggcgggaggggaggaaagaggaaaggagaggaaagaaa

SEQ ID NO: 12088 - DNA, 110 bp, Diabrotica virgifera
  misc_feature (7)..(27): n is a, c, g, or t
  misc_feature (85)..(103): n is a, c, g, or t
gatatcnnnnnnnnnnnnnnnnnnnnnattactttccagactaaaagagtgtccgtccgcacgtatattattcgtttacgtatannnnnnnnnnnnnnnnnnngtattgt

SEQ ID NO: 12089 - DNA, 963 bp, Diabrotica virgifera
  misc_feature (92)..(115): n is a, c, g, or t
  misc_feature (159)..(180): n is a, c, g, or t
  misc_feature (188)..(300): n is a, c, g, or t
  misc_feature (309)..(805): n is a, c, g, or t
  misc_feature (810)..(866): n is a, c, g, or t
  misc_feature (904)..(930): n is a, c, g, or t
  misc_feature (932)..(962): n is a, c, g, or t
gtacgccttgctgggtaccgggtccgagaattcccggcgcccccccccgcgtccgattcttctcccttttaaaataataaacacctcttccnnnnnnnnnnnnnnnnnnnnnnnntaacgatagttaattagtatccgtgagagaatcttttcttttcnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnnnnnnnnnnnnnnnnnnnnnngttaaaaagctttagatttttttagaagacgagagacnnnnnnnnnnnnnnnnnnnnnnnnnnngnnnnnnnnnnnnnnnnnnnnnnnnnnnnnnng

SEQ ID NO: 12090 - DNA, 1070 bp, Diabrotica virgifera
  misc_feature (11)..(11): n is a, c, g, or t
  misc_feature (61)..(86): n is a, c, g, or t
  misc_feature (94)..(117): n is a, c, g, or t
  misc_feature (239)..(257): n is a, c, g, or t
  misc_feature (271)..(644): n is a, c, g, or t
  misc_feature (646)..(702): n is a, c, g, or t
  misc_feature (725)..(764): n is a, c, g, or t
  misc_feature (771)..(788): n is a, c, g, or t
  misc_feature (790)..(832): n is a, c, g, or t
  misc_feature (834)..(855): n is a, c, g, or t
  misc_feature (858)..(873): n is a, c, g, or t
  misc_feature (876)..(943): n is a, c, g, or t
  misc_feature (949)..(1003): n is a, c, g, or t
  misc_feature (1005)..(1039): n is a, c, g, or t
ccctaccaagncgtccgcccaagtagtgttccttttattctaacctttatttcgaacagtnnnnnnnnnnnnnnnnnnnnnnnnnnaaaatggnnnnnnnnnnnnnnnnnnnnnnnncccttgtcattggacacgtatattctgggaaatctactactactggacatttaatttactaatgtgttgtcatatacaaaagaaccataaaaatagactaattataggacaataaatagttnnnnnnnnnnnnnnnnnnngaaagggtattcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnngatttttgaccgtggtaaggtannnnnnnnnnnnnnnnnnnnnnnnnnnnnnnnnnnnnnnnggggtgnnnnnnnnnnnnnnnnnncnnnnnnnnnnnnnnnnnnnnnnnnnnnnnnnnnnnnnnnnnnncnnnnnnnnnnnnnnnnnnnnnncgnnnnnnnnnnnnnnnnggnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnctttagggaaaaacaagaacaactttttttg

SEQ ID NO: 12091 - DNA, 839 bp, Diabrotica virgifera
  misc_feature (11)..(47): n is a, c, g, or t
  misc_feature (55)..(167): n is a, c, g, or t
  misc_feature (176)..(728): n is a, c, g, or t
  misc_feature (730)..(838): n is a, c, g, or t
cgtgagagaannnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12092 - DNA, 929 bp, Diabrotica virgifera
  misc_feature (146)..(197): n is a, c, g, or t
  misc_feature (216)..(235): n is a, c, g, or t
ccgtagttcaagatcaagtgagcgacgtcgaacacgattcccaatcaacgtctattggtgctgttacttacgaatctttgcagactcgaattatttcaggtggatccccagttcgaccacagggacaaaaatggaaaagacttcgnnnnnnnnnnnnnnnnnnnnnnnnnnnnnnnnnnnnnnnnnnnnnnnnnnnngaaaagcctcgaaaggctnnnnnnnnnnnnnnnnnnnnacgattcccacaagctgaaatcggatagagaatcaacggataaaataaaatatttggaagataacctacaagaactgaacaaagattattccaagcttaaactagagtgcgatcaaaaagaaaaccaattgtcagaacttagaaataagtttgatttcgaggtggttttcaagaaattagaaattgaatatagcaaaaaagttgaagaggcagaaaaacttcaagaggcactcgaaaatgctcaaaccaactcaaaaaatatcaggaattccaaacttgaagagctcgaaaaaactctagcaaagtgtaaaatggaactattgcaaaccaaagacaaactcaaacagagcgaattagcaaaagaagaagctgccgatgagagtattaaagtaaaattgcaagagtcaagaaatacaatagaggcaattaagtcggatttggagaacaaagtcaaacaaatcaatcagctaaaagatattatcaaaagtgaaggagagactaaaactaaactcttgcatgataatacagagctcgcacacagtctagagctcgtacgacagattataagaagttttgtgtcagagatgggtaataaagaaaaagagttgcatgcagaatgtgggaacatgcttagaaatacaccgaagaaatggtcaaaaatactgaattatctagtcagctagcaatacaaaaa

SEQ ID NO: 12093 - DNA, 471 bp, Diabrotica virgifera
  misc_feature (3)..(94): n is a, c, g, or t
  misc_feature (96)..(123): n is a, c, g, or t
  misc_feature (157)..(209): n is a, c, g, or t
  misc_feature (241)..(285): n is a, c, g, or t
  misc_feature (289)..(326): n is a, c, g, or t
  misc_feature (342)..(360): n is a, c, g, or t
  misc_feature (362)..(391): n is a, c, g, or t
tgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnngagagataaaaaaaataaggaattatttttagannnnnnnnnnnnnnnnnnnnnnnnnnnnnnnnnnnnnnnnnnnnnnnnnnnnnaattaagattaatagtataattatattatggnnnnnnnnnnnnnnnnnnnnnnnnnnnnnnnnnnnnnnnnnnnnntaannnnnnnnnnnnnnnnnnnnnnnnnnnnnnnnnnnnnntgatgatagtattagnnnnnnnnnnnnnnnnnnngnnnnnnnnnnnnnnnnnnnnnnnnnnnnnnatggtaatatttttattatgtgtttaatagaaaaatgaaattatgatattaaatgtaataaatagtaagcctactgatta

SEQ ID NO: 12094 - DNA, 1060 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(753): n is a, c, g, or t
  misc_feature (755)..(795): n is a, c, g, or t
  misc_feature (798)..(843): n is a, c, g, or t
  misc_feature (852)..(906): n is a, c, g, or t
  misc_feature (908)..(962): n is a, c, g, or t
  misc_feature (976)..(1049): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatcccnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnccgaataacatttnnnnnnnnnnnnnnnnnnnnnnnnnnnnnnnnnnnnnnnnnnnnnnnnnnnnnnnnnnnnnnnnnnnnnnnnnngcctcttttat

SEQ ID NO: 12095 - DNA, 898 bp, Diabrotica virgifera
  misc_feature (8)..(52): n is a, c, g, or t
  misc_feature (54)..(96): n is a, c, g, or t
  misc_feature (104)..(217): n is a, c, g, or t
  misc_feature (227)..(415): n is a, c, g, or t
  misc_feature (417)..(603): n is a, c, g, or t
  misc_feature (605)..(634): n is a, c, g, or t
  misc_feature (648)..(674): n is a, c, g, or t
  misc_feature (676)..(720): n is a, c, g, or t
  misc_feature (726)..(744): n is a, c, g, or t
  misc_feature (747)..(815): n is a, c, g, or t
  misc_feature (817)..(885): n is a, c, g, or t
tcttttcnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncgcccaccgattannnnnnnnnnnnnnnnnnnnnnnnnnngnnnnnnnnnnnnnnnnnnnnnnnnnnnnnnnnnnnnnnnnnnnnngaagannnnnnnnnnnnnnnnnnngtnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnctagttggggggg

SEQ ID NO: 12096 - DNA, 817 bp, Diabrotica virgifera
  misc_feature (101)..(118): n is a, c, g, or t
  misc_feature (133)..(243): n is a, c, g, or t
  misc_feature (255)..(616): n is a, c, g, or t
  misc_feature (633)..(662): n is a, c, g, or t
  misc_feature (684)..(740): n is a, c, g, or t
  misc_feature (783)..(809): n is a, c, g, or t
gtccgatctcacttcaaatacaaaaatcactttttcgtaaaagtaaaggaaaatttacttcaacatcgtgaattagtaccgtgagagagaccttcactttnnnnnnnnnnnnnnnnnncttttcgtacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggttattaaaaacacnnnnnnnnnnnnnnnnnnnnnnnnnnnnnncgcccacggattaatgtgaagnnnnnnnnnnnnnnnnnnnnnnnnnnnnnnnnnnnnnnnnnnnnnnnnnnnnnnnnnctggaatggaagaggtggatgaaaaaaaaaccggcttcattcnnnnnnnnnnnnnnnnnnnnnnnnnnnaaaaagct

SEQ ID NO: 12097 - DNA, 686 bp, Diabrotica virgifera
  misc_feature (165)..(184): n is a, c, g, or t
ccccctccacggcgtccgccattcacctgcgagacatttactacccctttcgtcattactaaatttagttcatttacattaatatgttaataagaaatggattaaaatataagtttgaactctttaagttcagaaatgatgaaaagagtagtattaaaacacagnnnnnnnnnnnnnnnnnnnnagagttgcaatcaaaggaaatgtcccgcagtcaaatatttgtcactctgtctgtataatcacgctctgccatattatgtgattcacagtacttgagcgctacacgctgtctccctcggttctgtttggcatgcaacgtcggtcattttgacccgtggtagaggatgattatcactagtttttatcttgaaagcggtaaggtaagctgataagcaaacaaaaatagcgttgatatagtttataaggcatcccattgctaagatagaaatggttgatggctattgctaatgtgtcggaatgcacccacatatatgtatgtctagtattgtcagtgagcgatgctactgtgtccttcttcgatagcacctcttaatgtgatgggagtgattagaacataatagtagctgctcttatgagatgcacatagatcttaatgtttggtctacattttgtcgattataagcatctagaatccaagggataacggcctcatttgaccggag

SEQ ID NO: 12098 - DNA, 853 bp, Diabrotica virgifera
  misc_feature (6)..(24): n is a, c, g, or t
  misc_feature (32)..(75): n is a, c, g, or t
  misc_feature (86)..(121): n is a, c, g, or t
  misc_feature (129)..(241): n is a, c, g, or t
  misc_feature (251)..(629): n is a, c, g, or t
  misc_feature (631)..(660): n is a, c, g, or t
  misc_feature (683)..(818): n is a, c, g, or t
tttatnnnnnnnnnnnnnnnnnnncttttccnnnnnnnnnnnnnnnnnnnnnnnnnnnnnnnnnnnnnnnnnnnncgtgagagaannnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnncgcccaccgattaatttgaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatttttttagaagacgagaaacccctatagag

SEQ ID NO: 12099 - DNA, 906 bp, Diabrotica virgifera
  misc_feature (450)..(462): n is a, c, g, or t
  misc_feature (465)..(491): n is a, c, g, or t
  misc_feature (674)..(696): n is a, c, g, or t
  misc_feature (698)..(728): n is a, c, g, or t
  misc_feature (863)..(863): n is a, c, g, or t
  misc_feature (883)..(904): n is a, c, g, or t
cagcaattttctgagtacctgttcatcagaagagtactcccgggctgacaacctctaggaaggaactctgacaatcaggatgagaagcacaacaaaattttttattttcgttaaaaaatagatcggattgtatattttgacagagaaatctttgcgttgtggtgtttgtacagggtgttctgttaatgtatattaataatttaccagaagaatgcttggtagctacattgggatcagtttaatagtttgcataatacttttgcaatccaaggtccgaaaaaatattgcaaatttggaaaatgatgctgggacaaaaaaagtcagtctggcaatttaaatagttataaatcggtcaactaggagaccctagggaattttttaaagataggcagtgggggtgtcccctcggcaggccgagcaaaaactgaatcggctatcctcttatccgannnnnnnnnnnnntannnnnnnnnnnnnnnnnnnnnnnnnnntgttaattgaaaattgaaaaagtctactttttacttaaaacttgtacagttgtttaaaaaatttcctaagctcttctattcaacattatttcaatgattcaaattgtatttgaaaccttaaatgtctttttatatgtgaatatattttcaagtatttgaaactttttttgttggctctgcatnnnnnnnnnnnnnnnnnnnnnnngnnnnnnnnnnnnnnnnnnnnnnnnnnnnnnnttagtattgcaaaaactactttttctcaaataaagcaattttttctaatagttccaattaaattttatttttgaccaagcattttcctgaaaaatcattcactaaatgttaatcaatcaccctgtatggttttantattgctttaaatattaacnnnnnnnnnnnnnnnnnnnnnncc

SEQ ID NO: 12100 - DNA, 487 bp, Diabrotica virgifera
  misc_feature (2)..(208): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattatttaaatcctagtagtgatgataataatagtattaaaaaatagtatatttagcaaaaatatataggcttaagaatggacttccgtaacatttttttcaccgggttattaaacaaaggtctttttgtataaaatataaggatctcacctgcacgcttcttcatttcgatgttcttcctagttagccacattctacaggaataattataatattacttaatagtgatttaatttcaatacatctatcaatcaaatcactatatttcttcaaagttt

SEQ ID NO: 12101 - DNA, 592 bp, Diabrotica virgifera
  misc_feature (10)..(87): n is a, c, g, or t
  misc_feature (113)..(167): n is a, c, g, or t
  misc_feature (210)..(245): n is a, c, g, or t
  misc_feature (247)..(284): n is a, c, g, or t
  misc_feature (289)..(334): n is a, c, g, or t
  misc_feature (353)..(374): n is a, c, g, or t
  misc_feature (400)..(419): n is a, c, g, or t
  misc_feature (440)..(510): n is a, c, g, or t
  misc_feature (523)..(561): n is a, c, g, or t
agattaaaannnnnnnnnnnnnnnnnnnnnnnnnnnnnnnnnnnnnnnnnnnnnnnnnnnnnnnnnnnnnnnnnnnnnnnnnnnnnntaactataaattattataattctatnnnnnnnnnnnnnnnnnnnnnnnnnnnnnnnnnnnnnnnnnnnnnnnnnnnnnnnatacgaacggaattcggcaacatctttttcgtcctgtgtatgnnnnnnnnnnnnnnnnnnnnnnnnnnnnnnnnnnnngnnnnnnnnnnnnnnnnnnnnnnnnnnnnnnnnnnnnnntcgtnnnnnnnnnnnnnnnnnnnnnnnnnnnnnnnnnnnnnnnnnnnnnngaagggctgcatgaaaatnnnnnnnnnnnnnnnnnnnnnncaagatttcatttctaaagcagaaannnnnnnnnnnnnnnnnnnncgagaagacccctatagaggnnnnnnnnnnnnnnnnnnnnnnnnnnnnnnnnnnnnnnnnnnnnnnnnnnnnnnnnnnnnnnnnnnnnnnngggggggggctcnnnnnnnnnnnnnnnnnnnnnnnnnnnnnnnnnnnnnnncaaaaccaattttttgtccccaatttttttt

SEQ ID NO: 12102 - DNA, 134 bp, Diabrotica virgifera
  misc_feature (2)..(2): n is a, c, g, or t
  misc_feature (9)..(86): n is a, c, g, or t
gnggtgatnnnnnnnnnnnnnnnnnnnnnnnnnnnnnnnnnnnnnnnnnnnnnnnnnnnnnnnnnnnnnnnnnnnnnnnnnnnnnnataatttacctagggatacagcgtatttttattggagagttcaatcga

SEQ ID NO: 12103 - DNA, 643 bp, Diabrotica virgifera
  misc_feature (208)..(237): n is a, c, g, or t
  misc_feature (439)..(457): n is a, c, g, or t
cggtgtccgattgtattttggagtttattagtaatcctttcagtttgtatattaaatgttagtaaatgcgcattgagtgagaatattttgtttttttaattggagatttccttttttgtatctggcctattatgtatttgtgaatgaaagttatagatttatgattattaaatgttacatgatctatggaatgaatgtgtttattagnnnnnnnnnnnnnnnnnnnnnnnnnnnnnngtgaagtgttgttttattgttcatatatctagttatttgtcatagacatacaattaatttattaagaatgtgtttataatatattatttgctttttgttaatattatatatttattgaggatgaaattatcattaatgttctatgacaatgagatttttatataaaaatgaggattgatgaatttcatattttaagagatgnnnnnnnnnnnnnnnnnnnatcattatatgtattttgtataactttatttatgaaaaatagatgtaaattgtttatcttgagttatgacgatgagattaatattttaaaattgtagatttgatgatgggttctactactactaaaggaattcgttgacgtttttttaacctgtttatgcagaactagtgatgtttggattaaata

SEQ ID NO: 12104 - DNA, 107 bp, Diabrotica virgifera
  misc_feature (12)..(79): n is a, c, g, or t
  misc_feature (81)..(106): n is a, c, g, or t
ctatttatttcnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnng

SEQ ID NO: 12105 - DNA, 831 bp, Diabrotica virgifera
  misc_feature (4)..(53): n is a, c, g, or t
  misc_feature (55)..(97): n is a, c, g, or t
  misc_feature (105)..(687): n is a, c, g, or t
  misc_feature (694)..(721): n is a, c, g, or t
  misc_feature (730)..(779): n is a, c, g, or t
  misc_feature (785)..(786): n is a, c, g, or t
  misc_feature (790)..(812): n is a, c, g, or t
atcnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcannnnnnnnnnnnnnnnnnnnnnnnnnnngaggggtgnnnnnnnnnnnnnnnnnnnnnnnnnnnnnnnnnnnnnnnnnnnnnnnnnnaagtannaagnnnnnnnnnnnnnnnnnnnnnnngacccttatagagttttat

SEQ ID NO: 12106 - DNA, 553 bp, Diabrotica virgifera
tcatcctttgctttgtatatatagatacagttacttacggtagtcgttgatatgggtcgcgagcgtcttcctactattcaatcaagaagttatgtatgtgcgctacgactttatgaccgtaaattatgggagagactaaaaaataaagttctccatttatggaagacaagatagagctggaatttgaccagaaaatcgttggcacgaggtgatatatcgataagtaacgtgggtatgctaacgggcgagccaagtacgattacaatgaacacgatgatagtgaactgcagctctacatataagccactcgttctacatcagtgacatactcacaatcaccgcgataaggcagcagtctttgaagaataaaagcacataaactacccatccgtacacacaagagaaacatctttaatgactgtgcttttgctgcaaggagccatggagtttctgttattttcaacatatcatataggaaggcaccaacctccttcctaatccgaaccattaaagagggctaaatatcatgttattaagccagaagacgacccag

SEQ ID NO: 12107 - DNA, 116 bp, Diabrotica virgifera
  misc_feature (5)..(73): n is a, c, g, or t
  misc_feature (75)..(91): n is a, c, g, or t
ggggnnnnnnnnnnnnnnnnnnnnnnnnnnnnnnnnnnnnnnnnnnnnnnnnnnnnnnnnnnnnnnnnnnnnngnnnnnnnnnnnnnnnnncccttagggaaaacagcgggaaatt

SEQ ID NO: 12108 - DNA, 97 bp, Diabrotica virgifera
ggaagatgggagatattccttcttaaagcatttgaccgcattgaaactattttctttgtactcaaatgctttaagaaggaatatctcccatcttcct

SEQ ID NO: 12109 - DNA, 989 bp, Diabrotica virgifera
attaaaacgagtttgaaaatctctttaactgcgataaaattatcgtagtttagtgaataattaagacaacgttcgacgacgtaaaaagaaagtttgaaactcgaaggtttcgcggtcattgaaaatttattcacaccagaagaagtggaagaaatgaaaaatgaagcacaaaaccttataaaatctatgccaggcgaatcaaagagaacagtattcagtacaacacattctgagtcacaacaaaacaaagacaagtatttcttagacagcggtgataaaatagcttatttctacgagcaaggagctctaggaccaaatggagaactactggtagagccggaaaattcactgaacaaaataggccacgctcttcacgaacttaatcctgttttcaagaagcacacgttttccgaaaaaataaaagaggctgcttttcaattaggtttcgaagaaccagttatcccacagagcatgtacatcttcaaaaatccaaaggattggaagtgaagtaactgctcaccaagatgcttcatatctacacaccgaccctctgaaagtagctggcttctggatagctctggatgatgccactgtagaaaacggttgcttgtggttctctaggaggtctcataacggtggaatccataggcgattcatcagaaatcctgatccaaatgcggatgagctgctgatatataactcagctgctccttattatcaaaaaagcagtttttctccagttccagttaccaaagttgtatcttaatacacggccaagtagtacactacagcgaagcaaataagtcagataagtcaagacacgcctataccttccacattgtagaaagcaagaacactacatactccaaagacaattggttgcagcccacaaacaggcagttttttaatctgtacagaaactattttgccattatctagcgttaattaatttaggtgtacaaaattgttaaaataaagggatatttttc

SEQ ID NO: 12110 - DNA, 76 bp, Diabrotica virgifera
  misc_feature (10)..(75): n is a, c, g, or t
ctataaaggnnnnnnnnnnnnnnnnnnnnnnnnnnnnnnnnnnnnnnnnnnnnnnnnnnnnnnnnnnnnnnnnnng

SEQ ID NO: 12111 - DNA, 554 bp, Diabrotica virgifera
  misc_feature (22)..(42): n is a, c, g, or t
gggtcggacccacggcgtccgnnnnnnnnnnnnnnnnnnnnncaatctttccccaactttcatctcacatccatagaggaaatcatcttagacactccaccttcgtgagtagcgaatactgggatccatctatttcatcaccagatcggccggctaacgctatattgggtgataaattaatctttcattccggttgtgtccaagtgtacgcggtctctcttcggcaatgagtttacttcggtattcgggtgtacctcggaatcaatacagtttctaagctattttcacaggtttcctccccttggttatcatcaagaaaactcttcaaattcgattttcatcatcattattagttgtcaaataggaatcatcattcttgatatagtcatcgatcgtgatcaaagcctaggatttttgtagaatagaacatctgcatcacagttgtagttttcctcgttttgatctttcttcctcgctatcgacatttctcaaaaataatttgattattacttaattgttcttcaatttcaatacattctatcaatcaactcact

SEQ ID NO: 12112 - DNA, 581 bp, Diabrotica virgifera
  misc_feature (400)..(415): n is a, c, g, or t
gcttgatactgataggatccacatacgcctggatatctaattacgtaaagaaagttttccgatgatttttattccaatctctgatttttattctctcaagagctttttataagacatatcgccattatgaagtttagatacagtaagtacttgatatcatattcaccattttcctaaaagatgcggtacagagaagatttagacggttgataaaacattaaccgacatagtaaagttttgtgattttgccttcaggatccacgatcagaatctcaatgttaatgtgaataattcactgagcgcctgggggaccaaacaaggcgacagtaaaatataactcacgtggcgttcaatggtgtcaatctattataccttatagaacaataattattatcttcannnnnnnnnnnnnnnnaataggattcagacttctggttcaaaaaacaaacagtctactgttcttttaaaacagaatttatcaatatgaaaaccctttatagttagaactaacaactaaacagtgttatctatcatgtccttctaggattatactgatatcaattctactaccgactaaatct

SEQ ID NO: 12113 - DNA, 907 bp, Diabrotica virgifera
  misc_feature (60)..(74): n is a, c, g, or t
  misc_feature (780)..(780): n is a, c, g, or t
  misc_feature (819)..(819): n is a, c, g, or t
  misc_feature (847)..(847): n is a, c, g, or t
gaccgtgaaaaccgaatgaaaactcgctccattaagaaccacggcttcctcgccataaannnnnnnnnnnnnnngatcacgtaagtgaaacaccagtacgctataaagcatttctttccacgcacgacatttctagccagaggctacaatatttgcaaaatagcttaaaaacggatggtactattcctagagacaacggggatgtcattctaaaagtaataaactttcatcagaaaccgtttccttaatgaagcaccaaattgagactatacagaagacatctgggtgtaaaagacattacaatttacatgagagccagaggatatatctctctgatgaactgaatgtaagaaaactctgggatcactacattgaaaaaaatccagacaataaagtatcatatgaagcatataggaaatactttaatgaaaatttcaacatttcttttggctctccgaggatggacacttgctcctcttgtgatcaatttttggcagaaattaaatgtataaattctcaactaagaacatgtacaggtgaaactgtgaaagaagaatttaatcaagagagtaaaaaattggaagtagaaaataaactacatatattaaaggcagagaaattttatgcaataaaaaagagtgctagattgtgtgctcgcaaagataatactgtaactagtataactatggattttcaaaaaaatttgtatattgcaaacatcacaacgaatgatgtttattataaacgacaacttgtctatgatgaaacaacgggtaaaanaggtgccgatgctgtggtttcacatttacttgactttgnggtctgtatattctgtgactcatgtggngggtcagaataaaaatatacagtttttagattcttcactatgtgggccatggctgccatc

SEQ ID NO: 12114 - DNA, 209 bp, Diabrotica virgifera
  misc_feature (18)..(54): n is a, c, g, or t
  misc_feature (90)..(112): n is a, c, g, or t
  misc_feature (120)..(142): n is a, c, g, or t
  misc_feature (172)..(203): n is a, c, g, or t
accttgttatccctaagnnnnnnnnnnnnnnnnnnnnnnnnnnnnnnnnnnnnntgcgacctcgatgttggattacagtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12115 - DNA, 782 bp, Diabrotica virgifera
cgagcgagtaattatatccattatatttatactcgacatgtgaagtacagtatataattgactaggatacatagatgaccttacatctctaattacatggattgtgtgtagcggattgttttggatcggtggtttattggggctcgccgattaagtcataagaatttatataattaattcatatgtacatattcacaggacgctagaggacggagatcttgtgatagtcaacacttacctgccaatgatatatatttgaagggtagatggcatatgcatcgttgctcagagctaattctttcctaaagaatgtataattattgataaactgtatattaatgagtagagattgatatattgttgagattacatatttttagggacgagcttaggaggagaattctattatcaactcgttctcacatatttatcacgattaagagtgttcatatatgaaaatatgatattattcattgttatatattattatatgaattacttatgaattgtttattatgatataaatactgatgatgtacattcattaatgatagatacatgattactcatatatatcattgcactgattgagtaagaatatataagctcagtagaggacttcggacatatttttgtcgctagcgtgttacttacatgactatttctgtgttagataaaaagtctcacctcgtccactgattaatatggatgtgcgcgctattctgtgcgtgatagggtagcatagtcatgactctatttattgtcagctggaatgaccgctt

SEQ ID NO: 12116 - DNA, 415 bp, Diabrotica virgifera
cccccttaacgcccccgagagcacaagagaacaagaaaccccttctcacggagcaacggacagaaaacagcaaaaaaaaagaagcaaaaaagaaccgcgagagagcgaaacacccctgagaacgaagaagaaaccggggaaccactgacagccagaagcaagaacgacaaaacacaaccacagcagcgccgacaccacaaggaacaagacaaaccccgaaagcgaagcggacagcccccgaaaagaaggaagcaacgacagcaaaagagcggggaagagggacacacgcgaaagcaccgaacggacgaaaaaaccgaaaagacccggacgaaacaaacgcaaacagacggagcaccgcgaaccagacaacgaaggccagcaacaggccgcgccacgaacccgggggaagagcaac

SEQ ID NO: 12117 - DNA, 296 bp, Diabrotica virgifera
  misc_feature (6)..(28): n is a, c, g, or t
  misc_feature (219)..(292): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnncccc

SEQ ID NO: 12118 - DNA, 594 bp, Diabrotica virgifera
  misc_feature (425)..(450): n is a, c, g, or t
cttcacgcgtccgatcaaacaagaattttcacaagattttcatttttcacgaaacttttttgaaaatttgttgttgctaaactatgctatggattttcaatatatcagtgttgtttaccagaagaaatgtcaaaatttacgaaaataatagtcactagatggctctgtaccaccggagtaagtaatcgttggcaatacatcaagacaaaactgtaaccaagtgagatcccaatgagtttttcgaatgttagttatttttattgtttataactttttgaagttatacttctttaggtacgagggtgaatctttacattccctggcgcatgcgcacaccgacagtatggcattcgtcgctacatattataagccatgtattgcaaataaggttgtgcgagaatagaatatattattatagtttttannnnnnnnnnnnnnnnnnnnnnnnnngactgtgaatttaacatacctacttataagtataatttgtaaatgcttattttcacttaatgtataagtaaaccgcgatcactaaaatatccaggagcacgatcggatgaatataaaagcatatgatattttattgtgttgcct

SEQ ID NO: 12119 - DNA, 203 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccaggttggttnnnnnnnnnnnnnnnnnnnnnnnnnnnnnnnngaaaggacc

SEQ ID NO: 12120 - DNA, 61 bp, Diabrotica virgifera
  misc_feature (4)..(60): n is a, c, g, or t
gggnnnnnnnnnnnnnnnnnnnnnnnnnnnnnnnnnnnnnnnnnnnnnnnnnnnnnnnnng

SEQ ID NO: 12121 - DNA, 938 bp, Diabrotica virgifera
agggattgagttcaccgacaatacctgttgttcttctaggggacatatttgaaactctaacattggatatttgtgagaatatgtttggttttgtagaacaaaatgttaatgtttggaaagaggaactatttttctcgtactgcaagaacaatcttctgcgtctctgtaatgatcttttaagacgtctttcaagaaccacagctactgtattctgtggaaaaattctgttatttcttgccaagttctttccgttttctgaaagatcgggattaaatatagtcagcgaattcaatttggaaaatgtgacagaatatggaactgatcctcctgatgatgaaattgctgaaattaaaattggagaacagaagaatctaatagattttactttttattgcaagttttggcaactacaagatttctttagaaaccctattcagtgttacaataaggtgcaatggaaactgtttagttcccatgccaccaatgtattaaatacattccaaggaataaaattagactacgtaaattctggcacctctactcaaaatagctcaaatttgggatattttgccaaataccttaccagtcaaaaactacttgaactacagttacatgacgtaaacttcagaagatctgtattgttgcagttcttaattttatttcagtattttacttccactgtccggttcaaaactgatgctcatgagcttaagaacgatcaaaaagaatggatcagcaccaatactgaaaaagtatacagtcttttaaaagaaacccgccagatgggggaagaatttgctgaaatcgtgaagaacgttttgagcagggaagagttattggatgcatgaaaaaatgaaagttgtccagaaataaagaaacactaccacagcccacggaaatttcggaaaggaaaagggattcagataaacccttaatcg

SEQ ID NO: 12122 - DNA, 802 bp, Diabrotica virgifera
gaatatatgcaacacaacggtaccaaaatatgcgcatatatatgcatcattttactacccatatgcaggtattttttctaaattactctactaatgcatccgcctatcaaaaatactccacaacaacacaatatattaggtcataagatcttcacaaaagatgccttcaaaaatactcacaactttcctcaagcaatcaaaaccctcatttttttctctgacattttctaatttatttctactctgctagatccctgtatttccgacaatattttgacaatgatcacagaaagagtcctcccgaataaccgaaacactaacctgcaaattcctttggtctaatgacttcattagatcatggtaaaagactaacaattaacttttatgaacataagttctttatcaattcgtacgttacttaaaaaacaacgaacgttacttaacctgaaaaagaatagacgaattgtctacgattcgatgaattttcgcattctgatgcttctctctcatgcccgtctttatagaagtagaaagcgaatttgtccaataaaaacactctttccataaaaacttcttatgtgaccacatgatcctagttggttgtcagttcgtcatttatatctgaaatgtgaaagtgatagtaacttacgatattgtaacacgccttgcgatatactctagcctccactctatctttacactacagacacactttatccaagcactctgttgaatgtaagacatatgtaaatttagaatataccactcacttcatgaacactacatacgatacaaaggttac

SEQ ID NO: 12123 - DNA, 616 bp, Diabrotica virgifera
  misc_feature (106)..(125): n is a, c, g, or t
gaagatgctgataatacagagataaaagaaccttttgaaaaagttgtcttgcagcattataatattgaagatatttggaaagaagcaaattcaaatgtcgccaaannnnnnnnnnnnnnnnnnnnccttttaaaaaacataaataacacaccttatggtaagaataaaagtagttctcacaatatttcgagaggtataaatatttctcctcaaaacaatgcctctctatcaaatatgaggcataatattcagcagtccagctgtagcaattttttgttgccaaatattaatcacatatctacacataaccaaaataggaataatatgccagaaaatttcagtttggagaaaggcatagctcaacacgaatctaagaaaaagtttgattttaaaaaagttggcactgatgtaagcccaacgaaaccgactaatgctgaaaatgtagtgataagttgtagtgagatgtctgttacagccgataaaaaggatagtgaaatatggaagtctgtattggaagatgttgattctgagtcgctgtttggtgatttttaactttttgtttaattattatgtaaatatttgtacggaggcaaatttatatacattgtttagtttt

SEQ ID NO: 12124 - DNA, 262 bp, Diabrotica virgifera
  misc_feature (2)..(44): n is a, c, g, or t
  misc_feature (50)..(72): n is a, c, g, or t
gnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 12125 - DNA, 67 bp, Diabrotica virgifera
  misc_feature (6)..(6): n is a, c, g, or t
  misc_feature (15)..(65): n is a, c, g, or t
aaatanatttaactnnnnnnnnnnnnnnnnnnnnnnnnnnnnnnnnnnnnnnnnnnnnnnnnnnnta

SEQ ID NO: 12126 - DNA, 53 bp, Diabrotica virgifera
  misc_feature (9)..(9): n is a, c, g, or t
  misc_feature (13)..(13): n is a, c, g, or t
  misc_feature (19)..(49): n is a, c, g, or t
aaagcttanattnttttannnnnnnnnnnnnnnnnnnnnnnnnnnnnnnaata

SEQ ID NO: 12127 - DNA, 94 bp, Diabrotica virgifera
  misc_feature (19)..(19): n is a, c, g, or t
taacagcgtaattttattnggagagtcaatcgataataaagattgcgacctcgatgtgggattaagtttataatgggtgtagcagctatattat

SEQ ID NO: 12128 - DNA, 249 bp, Diabrotica virgifera
  misc_feature (2)..(31): n is a, c, g, or t
  misc_feature (45)..(117): n is a, c, g, or t
  misc_feature (121)..(243): n is a, c, g, or t
gnnnnnnnnnnnnnnnnnnnnnnnnnnnnnncgcccaccgattannnnnnnnnnnnnnnnnnnnnnnnnnnnnnnnnnnnnnnnnnnnnnnnnnnnnnnnnnnnnnnnnnnnnnnnngaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttttc

SEQ ID NO: 12129 - DNA, 576 bp, Diabrotica virgifera
gccgggccgtacccgcggctcctcccccccccccggagctacgggtgtgacagttctattcatgttgaccccacatacacacatgttgaccaacgagatttggaagtaccgagttatccaaggtactattttatcgatgtatgaggcgttaatagagaggctataggagaacctctgtagctgggaaagataaatcttactccatgttgctcgtacagttatcggtatcgatctcgtagcagataccacttgcacgtggattcgctgcgatgattttgttatatttagatgaatgatttcccttttctgtattattaagaatctatatatttgggtgattgcttcaccaataggtgtactattatgcttactgatccccatgacgcagaattaggcgtctatcatagtttgaaagataggcgtatctaatatgatccactcgtgtaatagtaagtctagtaaattacagagtaacattcgaagcccaactcggtgctctctactcatgagcaagtcagaatctttactaagcgtgccagctactacacatgtacatgcctagataagaaattggga

SEQ ID NO: 12130 - DNA, 297 bp, Diabrotica virgifera
  misc_feature (20)..(109): n is a, c, g, or t
gggaagaacagggtacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaccaaaaccatattcactactgagtaatttcacttggagcccttccaataaggaaacacttaggtacatgaactttaagttggacttagagatgagcgaacatccgagacagtactctcaagttaaagaaataaaagaaaagtatatggaacctccatacgttgtattcacatagaattttattg

SEQ ID NO: 12131 - DNA, 293 bp, Diabrotica virgifera
  misc_feature (2)..(33): n is a, c, g, or t
  misc_feature (46)..(118): n is a, c, g, or t
  misc_feature (122)..(285): n is a, c, g, or t
gnnnnnnnnnnnnnnnnnnnnnnnnnnnnnnnngcccacggattannnnnnnnnnnnnnnnnnnnnnnnnnnnnnnnnnnnnnnnnnnnnnnnnnnnnnnnnnnnnnnnnnnnnnnnngaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggggg

SEQ ID NO: 12132 - DNA, 772 bp, Diabrotica virgifera
  misc_feature (10)..(573): n is a, c, g, or t
  misc_feature (580)..(617): n is a, c, g, or t
  misc_feature (637)..(650): n is a, c, g, or t
  misc_feature (653)..(675): n is a, c, g, or t
  misc_feature (683)..(705): n is a, c, g, or t
  misc_feature (735)..(766): n is a, c, g, or t
catcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12133 - DNA, 70 bp, Diabrotica virgifera
  misc_feature (14)..(59): n is a, c, g, or t
aagacgagaaaccnnnnnnnnnnnnnnnnnnnnnnnnnnnnnnnnnnnnnnnnnnnnnnattatttatat

SEQ ID NO: 12134 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12135 - DNA, 1022 bp, Diabrotica virgifera
  misc_feature (174)..(192): n is a, c, g, or t
  misc_feature (777)..(799): n is a, c, g, or t
gtgaatcaaaggcgaaagtgttatcagttttgcatacaaggactttaaagttagaagacagtgtattgtgtgttaagatttcaccaaatggaaagtttattgctgttgggttattagattctactgtcaaaatattttttgtcgatacgctaaagggccatgctggagaagctnnnnnnnnnnnnnnnnnnncggatggtcaatttgttgtgtcatgcggtgccgatagggtgttgaggatgtatgaaaaatctgaccagatattagtgttagaagacgaacaggaggaagaaagagagcaacaagaagagttagcaacaggggaacaaacagtaattcctggccaaccgggtttaaatttaccatccagaaaaaccataggaagtgaaaaagcgacggaaaatattttggaatgtttggcaatatgtgagaagtataaggaacatttagttgaacatgcagctcttcaagcagcttcaagtcagacgttgcctttaccagttcccccatctttgatgttagcactgaatgtttcaacgccaggtgatttttttctggaaacaattaaaagaatcagacctagcgatctggaagagtctatgatgattctgccgttttctgctgtatgtgaaatattacaaatattacctacattattgtctaggggcgttcaaactgaattaatttgtaaaatatctatgttcttgttaaagttacattatgcacctataattgccaatcagtatttgcttggagctctagagaaattattgagannnnnnnnnnnnnnnnnnnnnnnaattaagagatctaattggttacaactattatggcataaagtttattcaaaaaaaattgaagcagcagatagtgttcattggttagagatgcctctagagcaaaaaccaaagctaataagaaaacaaaaacaaccgtgaaaaactttaaaaaagccatttatggcattttaattaatggaaaggtcttggttttgaaaatgttttacaataaaatttttaatt

SEQ ID NO: 12136 - DNA, 262 bp, Diabrotica virgifera
  misc_feature (19)..(63): n is a, c, g, or t
  misc_feature (70)..(107): n is a, c, g, or t
  misc_feature (127)..(140): n is a, c, g, or t
  misc_feature (143)..(165): n is a, c, g, or t
  misc_feature (173)..(195): n is a, c, g, or t
  misc_feature (225)..(256): n is a, c, g, or t
taacagcgtaatttattcnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12137 - DNA, 623 bp, Diabrotica virgifera
  misc_feature (2)..(27): n is a, c, g, or t
  misc_feature (33)..(324): n is a, c, g, or t
  misc_feature (326)..(344): n is a, c, g, or t
  misc_feature (346)..(363): n is a, c, g, or t
  misc_feature (375)..(412): n is a, c, g, or t
gnnnnnnnnnnnnnnnnnnnnnnnnnntcttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnntnnnnnnnnnnnnnnnnnngaatataaagannnnnnnnnnnnnnnnnnnnnnnnnnnnnnnnnnnnnnatgaaccgagcttacgttacataatcatcagattattaattgataacagaaatgaatatttggatgaaaaatagatttgttattagtaaatatgaatagaattatcttactaagcgaaaagacgagaagattactataaaagaaatgtatttttgtgctcaactatataagttaaagctggtgcatcgtacacatttttttcagcttgttt

SEQ ID NO: 12138 - DNA, 776 bp, Diabrotica virgifera
gctgggtgacggtcgtagtcgagatattaagtttcttaaaaccgatcaacgtgaagagtagttatagctacagcacctacagtacagtatgtttcaaagaaagtgcaagcaaactaaaataatcgcaactgtgcgttaaatttgtcttgtagatattgtgatagtgatttttaaaaattgtgaatgtttttttattcatcagtgacaatgagagatttaattcgaaaatacaaacttataattcagggaaagcatctacctgacgctgactctgaactccttataagttctacttcttctccaggtaacacttacaacatggaggtaggaaatcccagattatttcagcaaggctacagcagtacagagagtgaagatgatagtcctaaaaagtcttcatatttgaattctcaacagtatatgccaaagaaggaacaagttttatcaagaagttataataatagtttaattatggataagcatgataatgctctgtacgatgttttgcagcattcttctttaaatgaaattatttcagaaacaactaagctgcttccatcaaaaagtaagatgtccgattccgttcagcagtctaaaaatgtttcaaatgatataaagaagcattacaatcattctctagtcacaattcttttagatttgcaatatggaatactacagttggcacatcacttttggctatggcttggggaatggaaaaaactggtttatttcctggtattcttatcaatttgtttgtggaggcggtatgcctgtat

SEQ ID NO: 12139 - DNA, 622 bp, Diabrotica virgifera
  misc_feature (297)..(316): n is a, c, g, or t
  misc_feature (598)..(618): n is a, c, g, or t
aaaatatcttggtttttggttttatttcttacacaattagaaatattcactcatcaatattcttcgtttttaagttataaattttagcctttaccgtttaaaactcacagttaaattaatacaaaaaatccatttttgcctctcctgaaaaaaattgttttttaagttgtgacacttttccttgatgagcgatgtattgttatataggaaacaaaacgtacgttatgtgtaaatttaaaaatttatcgtacaatttactgtctataactaaaaatatatttgaaaaagaggtgacgnnnnnnnnnnnnnnnnnnnngaacttttttaagaatcactattattaggaaagatgctgttttattgtaagattaaaagtgggcaatactttttaataagggtgtatatcaaaccagaaataaagtataaggttttcagaattacacgattaaatcagagattgttaaaaaaacaacatggtgtaagatttggccactctaaatatttcgttttattttcttctttaatatatccttgctgtcagattttgcttgtgaatatttgctttttatattttagattgtagatttatatttacttnnnnnnnnnnnnnnnnnnnnngcga

SEQ ID NO: 12140 - DNA, 246 bp, Diabrotica virgifera
  misc_feature (2)..(77): n is a, c, g, or t
  misc_feature (91)..(125): n is a, c, g, or t
  misc_feature (127)..(166): n is a, c, g, or t
  misc_feature (171)..(240): n is a, c, g, or t
gnnnnnnnnnnnnnnnnnnnnnnnnnnnnnnnnnnnnnnnnnnnnnnnnnnnnnnnnnnnnnnnnnnnnnnnnnnnnggatggaagggggnnnnnnnnnnnnnnnnnnnnnnnnnnnnnnnnnnngnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnttgggg

SEQ ID NO: 12141 - DNA, 185 bp, Diabrotica virgifera
ggatgacagcacacttaaactctgggtgaagaagtatggctggaaggacatgactggcaatttgattttcattgcgaaccaggatgaaaacattaagactaagaacatcaacgagaagatagattttgaaaatgttggtgctattatggcatcatgccgttaagtaaataaaccacatttttatt

SEQ ID NO: 12142 - DNA, 73 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgt

SEQ ID NO: 12143 - DNA, 636 bp, Diabrotica virgifera
  misc_feature (3)..(549): n is a, c, g, or t
  misc_feature (551)..(620): n is a, c, g, or t
tcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnngattaaatagaaagag

SEQ ID NO: 12144 - DNA, 893 bp, Diabrotica virgifera
  misc_feature (2)..(884): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccattttt

SEQ ID NO: 12145 - DNA, 702 bp, Diabrotica virgifera
  misc_feature (15)..(57): n is a, c, g, or t
  misc_feature (67)..(171): n is a, c, g, or t
  misc_feature (177)..(367): n is a, c, g, or t
  misc_feature (369)..(480): n is a, c, g, or t
  misc_feature (482)..(498): n is a, c, g, or t
  misc_feature (516)..(539): n is a, c, g, or t
  misc_feature (556)..(580): n is a, c, g, or t
  misc_feature (585)..(605): n is a, c, g, or t
  misc_feature (607)..(619): n is a, c, g, or t
  misc_feature (621)..(638): n is a, c, g, or t
  misc_feature (640)..(654): n is a, c, g, or t
  misc_feature (656)..(681): n is a, c, g, or t
ataattaggattgannnnnnnnnnnnnnnnnnnnnnnnnnnnnnnnnnnnnnnnnnnaccttgtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnntaaatatataggattagnnnnnnnnnnnnnnnnnnnnnnnngcacctgattattatgnnnnnnnnnnnnnnnnnnnnnnnnncagcnnnnnnnnnnnnnnnnnnnnngnnnnnnnnnnnnngnnnnnnnnnnnnnnnnnnannnnnnnnnnnnnnnannnnnnnnnnnnnnnnnnnnnnnnnngtggatgaaactgaaactgtc

SEQ ID NO: 12146 - DNA, 793 bp, Diabrotica virgifera
  misc_feature (33)..(52): n is a, c, g, or t
  misc_feature (716)..(716): n is a, c, g, or t
  misc_feature (722)..(722): n is a, c, g, or t
  misc_feature (760)..(761): n is a, c, g, or t
cgcctaaccttactcgcacggtgtgtgtaacgnnnnnnnnnnnnnnnnnnnngaaaacaagatccgctaattttcgtttccgtgtattaaatttgatcttaaacttttaagggagtgtttaatagtttggaccgtaacggacaaattcaacctgtttaagaaagtaaattgtcaagagggcggtggatttttacgaagagcaaatgaaggtagtttacacgaaatattcaacagatacgccaccgtggacaaaaatggcgagaagtttatgaccgctgaagatttcgttataaaatatttaaaactcttggacgaccaaaactacaacaaggatacagtaaagttgttggcagcaatcgttgataccagcaaagatggactcatttcttacccagaatttcaagcattcgagggactcctatgtttcccggatgctctgtataaaacagcttttcaattattcgatactaatggaaatgggcatgggttagtttcagtgaattcgttgaggtaatggaagaaaactgaactggcacaggaagattcctttcaacagggattcaccgttcatccagctggtatttcggtaaagacaagagccgcgtagtatcctacaacgaattttcgcagtttcttcacgacttccatgaagagtacgcaatcgaaggttttagaagggcagatacaaagagcagcgggtttatttccctctcggncttccnagaaatttatgacagtataaaaagtcacctattaaccnnaacaagtcagtcgcatctaatcgaggcagcga

SEQ ID NO: 12147 - DNA, 523 bp, Diabrotica virgifera
  misc_feature (3)..(45): n is a, c, g, or t
  misc_feature (51)..(73): n is a, c, g, or t
  misc_feature (264)..(337): n is a, c, g, or t
  misc_feature (342)..(407): n is a, c, g, or t
  misc_feature (425)..(443): n is a, c, g, or t
  misc_feature (452)..(466): n is a, c, g, or t
  misc_feature (468)..(484): n is a, c, g, or t
  misc_feature (487)..(505): n is a, c, g, or t
tgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 12148 - DNA, 592 bp, Diabrotica virgifera
  misc_feature (86)..(122): n is a, c, g, or t
  misc_feature (263)..(277): n is a, c, g, or t
taaacgcgcccgcaaaaaaacaaaagagcctggagcactcttatagaaaaagtaaatgaaaggacagaaaaatagcatcgagagannnnnnnnnnnnnnnnnnnnnnnnnnnnnnnnnnnnngtacctggtgaatactgcgtaatgaattggtaaaaatatatttgttatactacggaatatagacagcaggaagatgcgaattatagaagagcaaaagatagttgacaaaatgtaatagtcgtgagatgctattctgagaannnnnnnnnnnnnnnttttatgagagttgaagatttctttatataatatttaaaggtgttggacgacctagactacatccaggtttccgtaaggttgttggcagcaatcgaagataccaattaaaatggaatctaatcttacccttaatatggaggattggagggagtcctatgttacctggacgctttgaataaaacagctttacaattatgttatactaaagtagatgtcatgcttagtagcaccgaatgcaatgatgtaacgaaaagaattgaactgctcaggagcattcctttaaccatggatacaccgatcatccagctgtattt

SEQ ID NO: 12149 - DNA, 217 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagattaaaccggtgtgagccaggtgggcgtctatctttatgttataaatatatattagtacggagagactgaatatgtaaaataa

SEQ ID NO: 12150 - DNA, 850 bp, Diabrotica virgifera
  misc_feature (530)..(575): n is a, c, g, or t
  misc_feature (577)..(591): n is a, c, g, or t
  misc_feature (613)..(637): n is a, c, g, or t
  misc_feature (639)..(662): n is a, c, g, or t
  misc_feature (664)..(689): n is a, c, g, or t
  misc_feature (715)..(739): n is a, c, g, or t
  misc_feature (741)..(796): n is a, c, g, or t
ccctcttggtccgacctcatactagtttaaagagtcaatagaaattatccttttattgaaagaaggatagaaaaattttctataaatgctaaattgttatccttaagagaaaaaacttctgtatttatacaactaaaaatcttactttctcattgcaccactggagacatacttgcaatagatatacattaatgaagttagtactactgtatgtatatttgcgtcatatcccctattactttagctcattgtaagaaatctttccactttgtgagaacatgaccaatgattgttcatcatgaaatcttattctttggtaactgcaacatcgctgatatctgattcttgtcatgatattagtctacatctatttgtagacacagactaaatataagatattatgttattcaactgatatcatgtaatgaactaaaggattgtttatattatgagtcatcaatattttaatccatgagctgaacactaaaattctattatgacctaattcttacataacaattaggactacnnnnnnnnnnnnnnnnnnnnnnnnnnnnnnnnnnnnnnnnnnnnnngnnnnnnnnnnnnnnntaaattctttattatcatatcnnnnnnnnnnnnnnnnnnnnnnnnncnnnnnnnnnnnnnnnnnnnnnnnncnnnnnnnnnnnnnnnnnnnnnnnnnngtaatacaggcattccgcaacattgnnnnnnnnnnnnnnnnnnnnnnnnnannnnnnnnnnnnnnnnnnnnnnnnnnnnnnnnnnnnnnnnnnnnnnnnnnnnnnnnatattttaaccgagctcatgaagcataaacattgattctttttattgaaaaagg

SEQ ID NO: 12151 - DNA, 674 bp, Diabrotica virgifera
  misc_feature (154)..(171): n is a, c, g, or t
  misc_feature (660)..(672): n is a, c, g, or t
ctctcccacggcgtccggttcgatagtgttatttggtaaaatccctcttaagaccgtaaggaaaaagtagataaggatggacttgaacgtcttgtggactattgtgtattgataatgtttctcccctacaggaggaaaatatttatttttggannnnnnnnnnnnnnnnnngtatgttcaaaatagataaatatagtatattatgtattaaagggagagaaaacatccaaattcttactaatgtaggtatgatttataacatgaattcttataccactatgaagagatatgctactgtgaaatcatctaatccttcatagatacatattaaattgtaaatgttgatccatatttttataaatgaacaattttgtatgataggtctatttgatactaaggtctgagctgtacattgaaacatgatttacatctattttagaagtcaactgtatagttgagaattttagaatataacaaaatagaagtataaaatatttaactgaataatcccttgtataaacagagtgttcaattatgtacctttgattgaccttatgtacagtgacgaataacttatatgtgatgtagatgaaagtgtttatatatccacctatgctgagattgctcacgagatcacccccaacttcctttcgcctgatnnnnnnnnnnnnnat

SEQ ID NO: 12152 - DNA, 967 bp, Diabrotica virgifera
  misc_feature (830)..(830): n is a, c, g, or t
  misc_feature (853)..(854): n is a, c, g, or t
  misc_feature (865)..(867): n is a, c, g, or t
ggtggcagcactggagcaccaggtctaacgcctgggcaaacagtaggggccggtcaagatggtggatggcctggtcacgtaggagctccaggacaaactggtggtggagccggtcaagttggcggatggcctggtcacctaggagcaccaggacaaactggcggttggcctggtcaggtaggaacaccaggtcaaacaggaggctggcctagtcaaagtggtcctggttcttttgtaacagtacctggtcagacggggggaggaactggaaatgtacctggactaatcggtggacccggccaagcagttggtggtcaaatttccgccgtagaatcagatgattcagattcacaagtgcaaacttccgttcaacacacagaaaacggaacaacggctgaagctcaagcacaaggagtctttggcggaggtactgcacagtctcaagtttctggaacctattctggatctggttcgtttagcgcttctgcggggtcggatgatggtaaaagaggtgcccaaactcaggtatctggtgcaaaagagggagctcaaagctctgcccagggaagaggcggtgtaggtcaatcacagtcacaagttgttttctcgcatgaaactggccaaaccagttcaagtgcacaaagtggtggtattacccacggtacacaatcgcaagtacaagcatcagaaaaaggaggcctagctgacgcacaatcgaatggccctggaagtacgtcgtctcaagctcaaattggatttttaccgtatgacgaaaatgacgctgataacggcacagaatcatttattgggaggaggtactgctggagcancaagtggcactcattccggaatnngtccatctcannngtcaggaagatttaagtatggagtaaatatacaggagctgcacaagctgcttcgggaggaactggatttggtaaaattttactaaaacttggcccgttta

SEQ ID NO: 12153 - DNA, 75 bp, Diabrotica virgifera
ctaaggatgatattattagtgtaacgaaattgtatatttagtatagacatatgaaggttagtacgggatttcccg

SEQ ID NO: 12154 - DNA, 603 bp, Diabrotica virgifera
  misc_feature (14)..(35): n is a, c, g, or t
  misc_feature (123)..(152): n is a, c, g, or t
  misc_feature (169)..(202): n is a, c, g, or t
  misc_feature (217)..(237): n is a, c, g, or t
  misc_feature (257)..(277): n is a, c, g, or t
  misc_feature (296)..(369): n is a, c, g, or t
  misc_feature (371)..(387): n is a, c, g, or t
  misc_feature (411)..(430): n is a, c, g, or t
  misc_feature (470)..(489): n is a, c, g, or t
tcccccggcccggnnnnnnnnnnnnnnnnnnnnnnggaaaatcccaacgttgcgccacagtatttgtaaagaagatttttattgattgagatgataattaattattgtagagataattttccnnnnnnnnnnnnnnnnnnnnnnnnnnnnnnaacttggggatttgggnnnnnnnnnnnnnnnnnnnnnnnnnnnnnnnnnnggatgtgaaagagcnnnnnnnnnnnnnnnnnnnnngtatgataaataatatgaannnnnnnnnnnnnnnnnnnnnaaagtatgttgtaaataannnnnnnnnnnnnnnnnnnnnnnnnnnnnnnnnnnnnnnnnnnnnnnnnnnnnnnnnnnnnnnnnnnnnnnnnngnnnnnnnnnnnnnnnnntttgagatttgaaatgaaatttgnnnnnnnnnnnnnnnnnnnntgaaaagtagagatgagaattttaatattttagaatatgnnnnnnnnnnnnnnnnnnnngtattatttttagttggatatagattaattattaagatataggtataactaatgtgaaagtagaaaaaaggataatattaagataaagaaagtgttaatgtagtaatgattgat

SEQ ID NO: 12155 - DNA, 834 bp, Diabrotica virgifera
gatattatttattaagatccagaaaagtgttaggttctcaaaaagaaaaaaaggtaaatatgtacatagatacgaagtattgaatagaaaggaaatcttataatactattccccaattgcagtaacaggtcgtaaatagagtatatgacataatcaaagctcacaggtatataaataacttcttgcatctgatgaatcaacgagtaaaccatcgtaatcaccaataggaacttacaattcccctcgtacttttggaagagatgcgaacaaagttaaacgcaacctccctaatagcccacacaagaaaactgctgacctaaataaacttgaaagtgatgtaattgatattgagtctttggtatcaagcacacaagaagtaaaacatgcacatgtatctgcataaaactgagctcttgtcgtgaaatttttctgtcgagatgacataagacaccagactcctgatatctaagatgtataaacaatattaaaaataggtgaactataaacagatagttgctaaaacggatcatggtgatgactgggtgagaggagtacgatgaatttaataaaaggtttccacatgtgaatatcggcaaatctaattttttctcttgatggtcataacatgtatgcttagtgtctgacatgcctcatgatgtatgcgtctgtcaaatgcacttcgatttcattaactgattgcaatcatttcgaccaggaatcccagttattcccatatgtcacaatgaattactatgatatgtgagctgtgatcctcaaaacgatagttgtatgtatgtaatgtgttccaaatgtgatcacaacattgatgtattg

SEQ ID NO: 12156 - DNA, 55 bp, Diabrotica virgifera
  misc_feature (9)..(34): n is a, c, g, or t
tttgatccnnnnnnnnnnnnnnnnnnnnnnnnnnaccttaggggatacagcgtaa

SEQ ID NO: 12157 - DNA, 434 bp, Diabrotica virgifera
  misc_feature (316)..(329): n is a, c, g, or t
  misc_feature (332)..(355): n is a, c, g, or t
  misc_feature (379)..(404): n is a, c, g, or t
caattaagcagttgctgctacttaggtatattagagatactaaatggtgtctattttctgttacctaaagtagaccgctatatgtaacgtgtttgctttagagggtgagatatttacaattggttaagaatgctgcctttctctttctgagtcttatttctaattccccactatctgataaagcccaatatgaaatattttacataccctttggtgtatgttatgactgtgatgggtgcgttaagaatcggtaaaatgacgtattatgttttccggcatttccgtaatttttcctgttattagcgcacttattacnnnnnnnnnnnnnncgnnnnnnnnnnnnnnnnnnnnnnnnggttggtcataaagtcaaacttannnnnnnnnnnnnnnnnnnnnnnnnngttgtattttatttgattaaacatcataat

SEQ ID NO: 12158 - DNA, 700 bp, Diabrotica virgifera
  misc_feature (2)..(699): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12159 - DNA, 476 bp, Diabrotica virgifera
gcttattctttttctggggtacggaacctagcatttcctttggggaccctaaaactcaatgggggggcccgttctacaaaatcctggggtttcttgggcgaaaccccgggggcaatttcggcccaatatttacggtttggcatagggggaacttcaggttcttttacatgggggcccaaaatttttcggaaaccgggggggagcataggcctagccttaaaatgggaaccataaccaatattgggcatcaaatatggcccctggaaacgccttcggactcggggggcaaaacccttgggtttacgccggtttcccttaagtttaccatatctatcggacgggggccgggggaacttctttgccccctttttgaggattggggggcggaaaacgggtcggattgccatccggaggggattatggggaaaattaaaagaggattattcgggggctacctttacacccgatttttcgtt

SEQ ID NO: 12160 - DNA, 130 bp, Diabrotica virgifera
  misc_feature (10)..(32): n is a, c, g, or t
  misc_feature (41)..(63): n is a, c, g, or t
  misc_feature (93)..(124): n is a, c, g, or t
tataattggnnnnnnnnnnnnnnnnnnnnnnnctgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12161 - DNA, 955 bp, Diabrotica virgifera
  misc_feature (2)..(890): n is a, c, g, or t
  misc_feature (894)..(954): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnnnnnnt

SEQ ID NO: 12162 - DNA, 887 bp, Diabrotica virgifera
  misc_feature (2)..(710): n is a, c, g, or t
  misc_feature (712)..(726): n is a, c, g, or t
  misc_feature (728)..(756): n is a, c, g, or t
  misc_feature (758)..(773): n is a, c, g, or t
  misc_feature (776)..(788): n is a, c, g, or t
  misc_feature (852)..(852): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnntnnnnnnnnnnnnnnnnnnnnnnnnnnnnncnnnnnnnnnnnnnnnngcnnnnnnnnnnnnngagacgagagaccctatagagtttataaattatgattaagtttttttagtagtaaattattatnataataattatttaaatgggggtgataaaaatgac

SEQ ID NO: 12163 - DNA, 170 bp, Diabrotica virgifera
  misc_feature (4)..(4): n is a, c, g, or t
  misc_feature (9)..(9): n is a, c, g, or t
  misc_feature (23)..(54): n is a, c, g, or t
  misc_feature (56)..(90): n is a, c, g, or t
  misc_feature (98)..(159): n is a, c, g, or t
attnttttnaaagacgagagacnnnnnnnnnnnnnnnnnnnnnnnnnnnnnnnngnnnnnnnnnnnnnnnnnnnnnnnnnnnnnnnnnnnatttaatnnnnnnnnnnnnnnnnnnnnnnnnnnnnnnnnnnnnnnnnnnnnnnnnnnnnnnnnnnnnnntcccatttttt

SEQ ID NO: 12164 - DNA, 503 bp, Diabrotica virgifera
  misc_feature (9)..(32): n is a, c, g, or t
  misc_feature (43)..(86): n is a, c, g, or t
  misc_feature (90)..(114): n is a, c, g, or t
  misc_feature (120)..(143): n is a, c, g, or t
  misc_feature (209)..(228): n is a, c, g, or t
  misc_feature (234)..(268): n is a, c, g, or t
  misc_feature (273)..(301): n is a, c, g, or t
  misc_feature (306)..(324): n is a, c, g, or t
  misc_feature (328)..(347): n is a, c, g, or t
  misc_feature (382)..(403): n is a, c, g, or t
ggggggggnnnnnnnnnnnnnnnnnnnnnnnngggaaaggggnnnnnnnnnnnnnnnnnnnnnnnnnnnnnnnnnnnnnnnnnnnngagnnnnnnnnnnnnnnnnnnnnnnnnntggggnnnnnnnnnnnnnnnnnnnnnnnnccctttagggatggggaaaaaggggggaagggggaaggaaatttttaattattgggggggaaaatnnnnnnnnnnnnnnnnnnnnccattnnnnnnnnnnnnnnnnnnnnnnnnnnnnnnnnnnnaactnnnnnnnnnnnnnnnnnnnnnnnnnnnnnccaannnnnnnnnnnnnnnnnnncctnnnnnnnnnnnnnnnnnnnnaccttggaatttgggcccctaaaaaaataaggggnnnnnnnnnnnnnnnnnnnnnngaaatttaaaaagaacccccttttttttggggaaagggaaaaaatcgggggaaggattggccacccgggctgggaaaaggggggaaggaatataagggac

SEQ ID NO: 12165 - DNA, 566 bp, Diabrotica virgifera
  misc_feature (522)..(536): n is a, c, g, or t
gtggcctcaaatctagtcggttcctaacgaatttcttcatttttaatttcttcatagataacatttttagaaacgcggggtttctcttttaattactctaacaacggagtgaataaactaagacacgaatctcaagtgtttgacagatgtttttggagttttagtgcctcatgaaaggaatatttgtacatagtgaacacattgcagccgctcaactgctcttgtaacgggagtctttccaaaatccatccaaaaatcggataacaagggatcgacataacgtctatgaagatgtatcagttttctttcgcattttggctgctgctaatacaaataacaagtcgaattagagaatttaatggtgaatatattggagcaagacagcgaatattccatcctagtagaggatacgaaccaaaaaaattacatccatgcgaacaaagttcttgttacccagctactggcaatctgttgattggcagggaaagtcagttatacgcttcatcaacgtgtggagtacannnnnnnnnnnnnnnttgtattgtatctcatttggatgctgagag

SEQ ID NO: 12166 - DNA, 141 bp, Diabrotica virgifera
  misc_feature (14)..(43): n is a, c, g, or t
  misc_feature (46)..(90): n is a, c, g, or t
  misc_feature (92)..(140): n is a, c, g, or t
cccccccccggccnnnnnnnnnnnnnnnnnnnnnnnnnnnnnnacnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnng

SEQ ID NO: 12167 - DNA, 481 bp, Diabrotica virgifera
gtccagtcgttatacactggactctgctgaacacaaaccataggactgtcttcttgttcgttagtcttgtttgtgttcagcagagtccagtcgttatacactgagattcaacgtctcttcggcctttatacacaagcaagaacttagccaaaagactttaaactaactagaaaagtaatttacagtgattacttattgtgatttgtgatgttgaaataactgataaatgacattttccaattaggcaatatacgtgttaagtgttgttcatgtcgatttaatatgaaaatgagacgagaattttcgatataaatgaactgttaaagcgaagacgtcagcttggaagtgcttgctcccttggcattcagcaaagctaaaacttgtacatgttttattatacaaaagattttattacatcatttaagtcagtcaaatgaagagtaatttatgaggattattcaaatatattgataattataag

SEQ ID NO: 12168 - DNA, 956 bp, Diabrotica virgifera
  misc_feature (2)..(26): n is a, c, g, or t
  misc_feature (829)..(829): n is a, c, g, or t
  misc_feature (855)..(855): n is a, c, g, or t
gnnnnnnnnnnnnnnnnnnnnnnnnntaggtgttaatttcagaaatcttgtacaattatagtatcaccgtcttgaacagaataataatgcagttctttaaattcatcacatagttcaatcttaatgtctggctgtaaagcactactgtatattaacactggacgttctctcaatttaaacatttttttgacaagcaatatgagcttctgaactaaaatgttttgaggcaaactttttatcttttctgttccattgtatcgaaatattaaattcaccaaggagctttgaatgatgtttggtttcactatcagttcagcctcttctggcaaaccatacatttcaattaattgaagaaacctattatgttctaataaaaaattttctctatctactgcattttcaattttcatccattctaaagcatactttttaatatagtcgtattcagcaccccttctttcatcatctctgatgtgtcttccattcagactttgtaaatgttttattttagctattataatttgttctctagtagcaagattttccgtctctaatactgggttttttaaaagtctaagatggcgaaatttctccaatttgttaagctctcctatacttcgccactctgataataagttgtcattcaagttgagtgtttccagattattaaaacaattcactggtattgaattttcctcaaatcggatactttctaatttaatattttctatagtcatatgctctaaagtttttattacagataacttattaatctctgaccaacgtcttatctcgtttccctccaagtccaaatattttaacctcctanaattatgatcggatcgaatttgttanattggttatatgattataaggcactcttagttcctcgacatttgggaaaatgctgatatcgttgtacatctttcaaaggtcagtttcatgaaccacaaacc

SEQ ID NO: 12169 - DNA, 795 bp, Diabrotica virgifera
actcacaaaacctcccccaacgctacatcgtgaaaaaaatgttgctagtgaattaatataaaccctgctgctttggccttcctcattaggacctctaaggaaaatgaatcacaaggtatcggagactaaaattgaaactgacaatatgcattggattcagaaattgcctacgactttgatatttcgcagaggacctggcatacggacaatagccatccacatatatcataatcgtattctgagtaactatctttgcaatgtgctattgatgatactgatatacatctgcatgtgatatatcctcttccctgcataatactattaatcaaaaaatccccagcatgtcctctctcctgaaatgaaatcctcctcctctctgcttctcaaatacatgagatcatcattacctacgaacgaaacctacgtaagcgtgattactgacttacctaccgcggtatcactgcaaaggaatgcattcttcattgcacgcatagaacataaataccacttacaaaccgatcaaataaagaggatagatcctgatctcactagaaaatccacatatctatcatcaaatacatcaaaaacacacacactacttccagctcctatatactctacccggtaaccacacacgacccaaaatgaagagtaccgcatcacatgatcccatagccaactttctagctgattatcgatgcatttaccgtacaatatacctcagaaaccggatacatactgttggtagagacgaacattccagagatatgcctaccttaaaaatcaccaataaac

SEQ ID NO: 12170 - DNA, 290 bp, Diabrotica virgifera
  misc_feature (2)..(235): n is a, c, g, or t
  misc_feature (238)..(238): n is a, c, g, or t
  misc_feature (245)..(246): n is a, c, g, or t
  misc_feature (252)..(289): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaantaagttnnttttannnnnnnnnnnnnnnnnnnnnnnnnnnnnnnnnnnnnng

SEQ ID NO: 12171 - DNA, 1007 bp, Diabrotica virgifera
  misc_feature (662)..(662): n is a, c, g, or t
  misc_feature (713)..(713): n is a, c, g, or t
  misc_feature (812)..(812): n is a, c, g, or t
  misc_feature (913)..(913): n is a, c, g, or t
cttcattgaaccacgtttagtctgtcaatgattgagctcttacggaaagatatgagaaaaatcagaaatacattttttcataaaatacgcaaaataaaaaaacaaaccctgaaagaaaaaacaaaacgaaaaaatgacgatttttgtggaaggggctgggggaggagtggtaggataaaattgtcttatttgtgagcgaattttgactatcttaatggggatactaacactaaagtgttatatgtggtctttattactatatggctgtgagacctggacattcaaacagtatgacgtcaacaaactaaattcattagaaatgtggatgtaccaccgaatactaagaataagctggaccagcagaacgacgaatgaagaagtactggaaataatgaacacacgtcctcatctggtcaatacaattaaaattagaaagacgtcatatctaggacacataatatgccataaggaatttgagcagctccaggtaatattagaaggcaaaattgaaggtaaaagagatataggacgaaaaaaaaaaatcctgactccaaaacatcagagattgaacccacacaacaggaaatgacttaattcatcaagcccagagcagagaggaatttgccatattgatcgccaacctcaatagagaaggcacttanggaggaggtggaatagggaaaccatttggcatttaagatcttgttaagatnttctttttttttaacaagtaatatcgtagaataaaagaaaataaaacttcgaaatttcgaaatatttcgaaattcaagagtcataaggaatacctacanaaaacttatttttttcacactagtccctttttcttttttcctcttctttttattggcatttcttttctcagcagttatttcattgttttagggatgaaacntttgggtattaatgtaataaggttatgtggatgatacattttttcgtttatgttttaatataaaatttgttaaaatatgttttacgggaactga

SEQ ID NO: 12172 - DNA, 571 bp, Diabrotica virgifera
  misc_feature (2)..(18): n is a, c, g, or t
  misc_feature (20)..(64): n is a, c, g, or t
  misc_feature (71)..(570): n is a, c, g, or t
cnnnnnnnnnnnnnnnnncnnnnnnnnnnnnnnnnnnnnnnnnnnnnnnnnnnnnnnnnnnnnntacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 12173 - DNA, 139 bp, Diabrotica virgifera
  misc_feature (39)..(39): n is a, c, g, or t
  misc_feature (108)..(129): n is a, c, g, or t
taacagcgtaattttattggagaagtcaatcgataatanagattgcgacctcgatgttggattaagtttataattggtgtagcagtatatttattaagtctggtcgannnnnnnnnnnnnnnnnnnnnnagtttaaacc

SEQ ID NO: 12174 - DNA, 215 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (116)..(116): n is a, c, g, or t
  misc_feature (139)..(139): n is a, c, g, or t
  misc_feature (156)..(157): n is a, c, g, or t
  misc_feature (169)..(169): n is a, c, g, or t
  misc_feature (172)..(172): n is a, c, g, or t
  misc_feature (175)..(175): n is a, c, g, or t
  misc_feature (185)..(185): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgacttttanaattttacatgatctgagtttanaccggtgtgagccaggnntggttctatctntanttnattaatatantttagtacgaaaggaccaatatataaaata

SEQ ID NO: 12175 - DNA, 896 bp, Diabrotica virgifera
  misc_feature (28)..(47): n is a, c, g, or t
  misc_feature (76)..(90): n is a, c, g, or t
  misc_feature (92)..(105): n is a, c, g, or t
  misc_feature (129)..(151): n is a, c, g, or t
  misc_feature (774)..(774): n is a, c, g, or t
  misc_feature (822)..(824): n is a, c, g, or t
  misc_feature (834)..(834): n is a, c, g, or t
  misc_feature (851)..(852): n is a, c, g, or t
  misc_feature (863)..(864): n is a, c, g, or t
attgacgtatatttcatatctattgtcnnnnnnnnnnnnnnnnnnnngttgctccacaatattgatatgatatgcnnnnnnnnnnnnnnngnnnnnnnnnnnnnntgtattttgattgtagtagtgcannnnnnnnnnnnnnnnnnnnnnnacatacaattgtttaccttttaataacataaccttaatattactttttcttataatttttttgggctatggccatgacaattgtccagtaaccaggaccaatatgattggccaatataattaaaagtgcgaaaaaagttgccgagctatgaaaccaggtgtcgcttttccgaacttgcacggtcccaatagattttcaacagtgttggcgataagctgcattcctgtcccttattcacaatgaagctattggataactgttgttgattgattgggtgttgttatagaatttttgcactgcttttattaaagttatattaattagagtatttccaggacttgtcataatttacacagtgatactgtggtctgtgtcataatttacaaagacgatcttgtgtatggtttatatgtgacttacaaaaacaagtgattatttgaagttttcctattaattttgtgctaatgtatcaatacattatttagtttgctatagacaccctatatggtagaaaatgttttgatataatacataaatataggttaaatatgaaagacacagaaatattttaaggtgaacttgtatgattgaggtatttgacattcgacgtaggctgacataantatgtcagtgttgccatatcgtcaattatttcatactctcacatctannnattcaaatcngggcaatttattatatnntatattactgnntaatatgtacgtaagaccgtcctccaatttgt

SEQ ID NO: 12176 - DNA, 935 bp, Diabrotica virgifera
  misc_feature (29)..(47): n is a, c, g, or t
  misc_feature (844)..(845): n is a, c, g, or t
  misc_feature (869)..(869): n is a, c, g, or t
  misc_feature (892)..(892): n is a, c, g, or t
gttgacattaccgtctcgttttgttctcnnnnnnnnnnnnnnnnnnnggtgtacaactccaacaaaatgcgccaaaatcataggagtatttcctgtgttcggcagaagtcatcacatcttggccattgctttgatgaggggattggcagatgctgggcatgatgtaactatagtttgctcctatgaagataactactccccaaaacgtggatcttatagaactgttattttggagggatttgccgaggaatttgcaaatgaagctatcaatttattcgacttgcaggactttaacaatgtattccaagaggctgtatttgaagactatatgtatggtattaccgagaaagtatttaaagatccaggtgtaaacaaacttatacaagataaagagacatttgatgcgataattattgaacaattttctaacgatgccctgaaagcactagcatacatatttaaatctcatctaatagcatacaattcatttggttctttcaattttgtaaacagattggtagggaatccaacaataatatcctatactcctcagttaatatcaacctttagaagaccaatggtgcctgcaagacaggatttataataccattctatatactgttgaagaaattatgaaccatttcttggtttttacccacacaggacaaactaattcacaaatattttcccgattctcccagtgtatatgacttgaccaaaaacgtttcattggtactagtaaactctcatgaaacaatggggcaagctgtacctttagtgcccaacgttatatccattggaggtttccacgttaagcctccaaaaaaactaccagaagatcttnncagcgtcttggatagtgccaaggnaaggtgtcatattcttcagtatnggggtcaatttaaaaagcaaagatttaccaaggataagatgat

SEQ ID NO: 12177 - DNA, 574 bp, Diabrotica virgifera
  misc_feature (196)..(237): n is a, c, g, or t
  misc_feature (336)..(364): n is a, c, g, or t
  misc_feature (534)..(556): n is a, c, g, or t
tgtatatacctggatatacattgatgagcgggccaataacgggcaaaataaacgcaacacatggaaaacataataggttgtgtaataaaaaaagagatgaaactaatacattaccactatcgagattttacacctccaatgtagggcttttcaacgactgaaatatttttatagatttgatcaattgttgataaannnnnnnnnnnnnnnnnnnnnnnnnnnnnnnnnnnnnnnnnntggtttttaaagtgagacttgtgtccatgtatctaaaattttaacaaatatacgtaggttatttatacttgaggaaactatccttatttatgtagatannnnnnnnnnnnnnnnnnnnnnnnnnnnngctaatacaaagaatattcataaaaatttaatttctaaagagaaaatcggatcaaagatttatcggatatttgacataagagatgatttgtttgtttctaacaacatctggtatcttgtcgatgctttagtaccttatccatttgcattataatgaattgtcgaatgatnnnnnnnnnnnnnnnnnnnnnnngttttattgatttagaat

SEQ ID NO: 12178 - DNA, 856 bp, Diabrotica virgifera
  misc_feature (779)..(779): n is a, c, g, or t
  misc_feature (799)..(799): n is a, c, g, or t
aacaagttttaaagtgcgacaaaatgacacaggtactatcaaaagaccttagtgatttactagaaagtgctttaaatgaaaaaatcgaaagttttgacctccagatagaaggcaatgacaatggagagggccatttaggagaagttctttttatcacattaaccaacaaaagcaccaacaaaattgatcatgtagtggtcaaacaggtacttgaaagttctgtggagaataccatagatttcatgtcatcaacttttttaaacgaaattcatttctatgggaagtttcttccagctttacaagaattccagagaagctatcctggagctgaaatttttaaccatgttcccaagtgtctgggtacatgtttagaaagaggaaaagaaaagttaatattggaaaacctaaagtttaggaattttactttgcatcctaaaaaggaatacgtagggtacaaaatgtacgaagctatatttaaaacatacggaaagtaccatggtgcttgcttagcctttaaacataaccaaccagaaaaatttctagaattatcaaatggttttcagaacaactttaagaaaatggtgaagactggtttgttagagaggggtatacttggaatgagtgcaatgggtacaatccacattaaaagagacccaaccagaattatatgaaaagtttacaccatttgctgagaaatctgtagaaaagttcttgaattgtttagattatagaagcccatattccgtaattactcatgggtgatttggttggagtaacanatatgatggtttaaaataanacgaatcaggaaacccatagaagatattcaactaattgattttccagatgtcgtggc

SEQ ID NO: 12179 - DNA, 64 bp, Diabrotica virgifera
  misc_feature (16)..(36): n is a, c, g, or t
  misc_feature (39)..(61): n is a, c, g, or t
atgaggggtggatgannnnnnnnnnnnnnnnnnnnnttnnnnnnnnnnnnnnnnnnnnnnngta

SEQ ID NO: 12180 - DNA, 887 bp, Diabrotica virgifera
  misc_feature (29)..(53): n is a, c, g, or t
  misc_feature (758)..(778): n is a, c, g, or t
  misc_feature (854)..(886): n is a, c, g, or t
aattctaagataaataaaaacgcgccacnnnnnnnnnnnnnnnnnnnnnnnnnccagttgtatttgatcttttttaacttatactcatgtttaagcttgtacaaaaacaattagtaagatattcaaagaggttccattctgccatggtcaatattactccaccaatgttagatttagaagtaaatagaatagtatgggttgatatggaaatgacaggtttaaatgtagatcaggacaaaataatggaaattgcctgtcttgtaacagacgcagatttaaatataattgccgaaggaccagatattataatacaccaacctgatagtgtacttaaaaaaatgaatgcttggtgcaagaaacaacataagaagacaggtttgactgcagcttgtttgaattcaatgatccatttggagcaagccgagaatgaaattcttgattttgtgaagcaacatgtcactggaaaaatgtcacccctggcaggaaatagtgtttatatggaccgaatgtttctcattaaaaacatgccaagtttacataattatttacattatagattaatagacgtttctacggttaaggaactctgtagaagatggaatttagaagtatacaaaaaagctcctagcaaacagtttacacacagggctttgagtgatataaaagaaagtatagaagaacttaagttttacaaagaaaatttttttaagcaaaagtaaattttgtgtaatagatttactgcatcatgaagaatagcnnnnnnnnnnnnnnnnnnnnnccactgaaatcaacaaatcgacctcatatttactaaaatgattttaaaatgattcagatttgtaataaattcgtcnnnnnnnnnnnnnnnnnnnnnnnnnnnnnnnnnt

SEQ ID NO: 12181 - DNA, 619 bp, Diabrotica virgifera
  misc_feature (11)..(238): n is a, c, g, or t
  misc_feature (274)..(295): n is a, c, g, or t
  misc_feature (322)..(346): n is a, c, g, or t
cgagcggcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttaaaaagacaaaaatatacgggatattttgtcnnnnnnnnnnnnnnnnnnnnnnctatatccttcatatggaggaaaacannnnnnnnnnnnnnnnnnnnnnnnnatactgaggccgagaccaatcgttgtattaaaggattagtttttaacttcgctagggaggatgtgtttctgtaatggacctagtgcaatttgcgtgatgatatcgtaatagttctatcgccacacagagaatacacattacccaaaaacgaactatggaacctcgatagacaagttctattcgagccacttccctccgcttagaacggaattagagaagaacggcaactgcatccggaatcattaatttcaggagactattttgatctagagg

SEQ ID NO: 12182 - DNA, 959 bp, Diabrotica virgifera
aaacttgtctccccgacaaaaagaatattaatctcgaatatctctccttatattccccaccaacttgcagaaaatgcaatcaagagtcttggtcttcaaatagcctccccagtgtctttccttagagcaggaattccaggtgatgaatattcccacatcctcagtttccgccgccaagtgtatgtcttttcaccctctgataatttcgagcttcacacctccttattaatttcatttgaaggcaatgataatagaatttttctttcaacggacaagatggaatgtttcgtatgcaaacaggctggacacgttgcgtcaaattgccccaatacttcatctgacaatgtgttatcacaaaattctactctttctcatgacccaactcccactaccgaatcaacgccacagcaacagcatacacaacttgtgacagacaatgtgttatctcaaaactctactatctcatatgacctaaccaccaccaccgaatctacgccacagcaacagaacacacaacttttctcccatactgaatcacatcaagctgaagacggtgatccaaacaacataaatattcaaaaaccttcttcaatttcttctactcctcaaaccctactgccaacttctgaagcgagcaaaataattcccaccgaagagaacattcccactaaaaatccatgtgaaaaaacctctgaagtaatggatcaacaagcttcactcggaatcataggagaatcatccagtacatctgtgaaaagaagtattgacgaaacgttatcccctcccatcgaaaatctgaatactaataatccaacgtttgctctccctcaaacaccacgtcaaaccaaacatccaaagcccaaaaaacctaaacgcacagcacctactcctgacgcacttaaatttttcatgaaataagattcccacacactcccattaaactatgatcagctaataat

SEQ ID NO: 12183 - DNA, 258 bp, Diabrotica virgifera
  misc_feature (217)..(253): n is a, c, g, or t
cccacgcgtccgctcagaaaatggatttgtccaagtagattcattttctgagaaccttccccttatttcagtgtccaaccaaacgaataatgggaaggttctcagaaaatggatttgtccaagtagattcatctaagaccatctatttttacagcgaggaagagactaacctttccgatttccaacaatcactgactattaccaatcttcttgacgnnnnnnnnnnnnnnnnnnnnnnnnnnnnnnnnnnnnngtttt

SEQ ID NO: 12184 - DNA, 550 bp, Diabrotica virgifera
  misc_feature (20)..(42): n is a, c, g, or t
  misc_feature (88)..(105): n is a, c, g, or t
  misc_feature (214)..(246): n is a, c, g, or t
  misc_feature (281)..(301): n is a, c, g, or t
  misc_feature (316)..(333): n is a, c, g, or t
ccttctaggccccattacgnnnnnnnnnnnnnnnnnnnnnnncttattactatccttttaaaatgtaatatttaatggtattcaatgnnnnnnnnnnnnnnnnnnctcacaaattattccattataaaaagaataagcaccataaaaaaatatgccatagttgagaatatctatataaaaataaagaatatactgttctgaaaaatgatataannnnnnnnnnnnnnnnnnnnnnnnnnnnnnnnncaactattgaattaattaaaataatttacgctcannnnnnnnnnnnnnnnnnnnnttgctatataagaannnnnnnnnnnnnnnnnncataatcttatattaggaataatatttaaaaaaccattatttaaattaattcttcgactagtagaatacgattcataaaaaatatttagctaaatctaaataatccactaagaacataaaccatgcgctaatattataaatagatgaggattttatggtgctttatttataatattagttcatggattatgtacctcggttctaaatcgcgataggt

SEQ ID NO: 12185 - DNA, 358 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(187): n is a, c, g, or t
  misc_feature (200)..(227): n is a, c, g, or t
  misc_feature (245)..(266): n is a, c, g, or t
  misc_feature (273)..(311): n is a, c, g, or t
  misc_feature (317)..(339): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagcccggttggttnnnnnnnnnnnnnnnnnnnnnnnnnnnccacaaaaggccnnnnnnnnnnnnnnnnnnnnnnnnnnnncataattattagaagagnnnnnnnnnnnnnnnnnnnnnnctccccnnnnnnnnnnnnnnnnnnnnnnnnnnnnnnnnnnnnnnngggcgnnnnnnnnnnnnnnnnnnnnnnnatttttcatacccccgggg

SEQ ID NO: 12186 - DNA, 201 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (164)..(195): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcccagggttggttnnnnnnnnnnnnnnnnnnnnnnnnnnnnnnnngaaagg

SEQ ID NO: 12187 - DNA, 791 bp, Diabrotica virgifera
  misc_feature (10)..(55): n is a, c, g, or t
  misc_feature (66)..(101): n is a, c, g, or t
  misc_feature (109)..(153): n is a, c, g, or t
  misc_feature (168)..(191): n is a, c, g, or t
  misc_feature (200)..(227): n is a, c, g, or t
  misc_feature (231)..(260): n is a, c, g, or t
  misc_feature (276)..(338): n is a, c, g, or t
  misc_feature (345)..(386): n is a, c, g, or t
  misc_feature (395)..(558): n is a, c, g, or t
  misc_feature (567)..(579): n is a, c, g, or t
  misc_feature (581)..(655): n is a, c, g, or t
  misc_feature (707)..(727): n is a, c, g, or t
tcctctctcnnnnnnnnnnnnnnnnnnnnnnnnnnnnnnnnnnnnnnnnnnnnnncgtgagagaannnnnnnnnnnnnnnnnnnnnnnnnnnnnnnnnnnngtacctcnnnnnnnnnnnnnnnnnnnnnnnnnnnnnnnnnnnnnnnnnnnnncaatgtaacacagcnnnnnnnnnnnnnnnnnnnnnnnntaataaacnnnnnnnnnnnnnnnnnnnnnnnnnnnncgtnnnnnnnnnnnnnnnnnnnnnnnnnnnnnntgaagtaaattaaagnnnnnnnnnnnnnnnnnnnnnnnnnnnnnnnnnnnnnnnnnnnnnnnnnnnnnnnnnnnnnnngtatgtnnnnnnnnnnnnnnnnnnnnnnnnnnnnnnnnnnnnnnnnnngaaattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattatatnnnnnnnnnnnnntnnnnnnnnnnnnnnnnnnnnnnnnnnnnnnnnnnnnnnnnnnnnnnnnnnnnnnnnnnnnnnnnnnnnnnnnnnngtgaatgtccgcgatatattgaccgtgctctgccacctaatcattagattgnnnnnnnnnnnnnnnnnnnnncgattggatgaaatcatactgtctttattgatttatagagaattttattgttatgttaaaaagc

SEQ ID NO: 12188 - DNA, 445 bp, Diabrotica virgifera
ctccctccacgccgccgttattacatgtgttaacaggcatagctacaattgcagcagcttaattttaaatccaaaggattattagacttgtggtccataagttctcatgctctatctgtggaataacttttccatatgtctacagagcggattatgcaatgtcaactacactaggctacctatatcacctcccataaaccaaaggcaaaccgaccatatcgtgcgtggtaagagcaataactcgtagttttatcagccggggctccacctgactcagatatgctatctactagaagaaattatcaactggaacaattaatactaacgtatacaatcatgtactttcattcatcagtacatatcgagattcaggctatcagtgatggcaggcaacctgtgggataaggaatatctccatagagattgtaagtaagattaagtaacc

SEQ ID NO: 12189 - DNA, 953 bp, Diabrotica virgifera
  misc_feature (852)..(852): n is a, c, g, or t
  misc_feature (910)..(910): n is a, c, g, or t
gtttagaatatgtgtatttcttccaaaatatttatctagtcgttcttgtgaaactattttaattaaacaaactatatatgaaatttagtagcagtaatgggcaaggctataagtaaaaatttagagttgtcaacaaacgaatattgtgttaggtttgtaggaacagaacccatatcaaaaaatgatcctttttggaacagatttttggcctataacttaattcctccaacgtcattaaatgaccagttgtctttagaaacaagaattgaacctcttctacaagctctagtcaagaacaatccaacctctggaaattttagtacccttattcaaatatttctggaaaggtctactgaattgttatcatctacatcaacacaagcaaatctttttaactggcaactgtacaacattttgttcctgataagatgcgtattgaaatttttcacagaaattctaagggaagacgatctaatgaagcatatagaattcaagggcagtggaaatacaatggaagcattcataggtgctttagttggtataatagttgatgtacctatagaggattccacatatctaatacacctagaatctgcaacttgtcttttaatttgtctttctattcagtatcattccggtggtagatcagaccaaagtatcatgtatagacttatgatgaaaggaaaacatggtaatacatggctcccatactagtcaaacgtctgatgaccaatttcatagatcagcaaaaaatgcctccaggattttcaggaggcgatggaaacagtatggtattaaatttggcttccaatatttggtcagtattgacttttaacaaaaagtccaacgagngaatttcagattcagacgagtattcgtaccaagaagctccgctagcgacccaaagttnacttttacttttagtttttagtcatcattgggacacactgtct

SEQ ID NO: 12190 - DNA, 672 bp, Diabrotica virgifera
  misc_feature (105)..(132): n is a, c, g, or t
  misc_feature (162)..(184): n is a, c, g, or t
  misc_feature (219)..(236): n is a, c, g, or t
  misc_feature (263)..(275): n is a, c, g, or t
  misc_feature (277)..(386): n is a, c, g, or t
  misc_feature (391)..(417): n is a, c, g, or t
  misc_feature (471)..(492): n is a, c, g, or t
  misc_feature (553)..(579): n is a, c, g, or t
ctagagtcttgcaattcgggcactactgccttcttcagctgatgaccccacactactcattaaaggacagaagattagaaatcgccaaataatactatattttcnnnnnnnnnnnnnnnnnnnnnnnnnnnnggaagtatccgggataattacttaataagnnnnnnnnnnnnnnnnnnnnnnncaatagagctaaaagattaacatttttattgcccnnnnnnnnnnnnnnnnnntctttttgaaaagaaatgctactcgcnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgnnnnnnnnnnnnnnnnnnnnnnnnnnngagtaaaaatattcatattttaacacaagtgagcactaattttatatatcctgnnnnnnnnnnnnnnnnnnnnnnccattaaacgataaacttaaatgatttatctctagtactgatgataatatgagcattaacnnnnnnnnnnnnnnnnnnnnnnnnnnncggcttaataagggaattcggcaacatttctttaccctggttattaaaaacctgtttttttgttataaatatagaacttcgcctgcccactgt

SEQ ID NO: 12191 - DNA, 216 bp, Diabrotica virgifera
  misc_feature (5)..(6): n is a, c, g, or t
  misc_feature (8)..(74): n is a, c, g, or t
  misc_feature (78)..(78): n is a, c, g, or t
  misc_feature (84)..(85): n is a, c, g, or t
  misc_feature (97)..(215): n is a, c, g, or t
gaggnngnnnnnnnnnnnnnnnnnnnnnnnnnnnnnnnnnnnnnnnnnnnnnnnnnnnnnnnnnnnnnnnnnnnattnttttannagacgagagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12192 - DNA, 874 bp, Diabrotica virgifera
  misc_feature (84)..(101): n is a, c, g, or t
  misc_feature (113)..(133): n is a, c, g, or t
  misc_feature (140)..(645): n is a, c, g, or t
  misc_feature (647)..(666): n is a, c, g, or t
  misc_feature (668)..(683): n is a, c, g, or t
  misc_feature (691)..(750): n is a, c, g, or t
  misc_feature (763)..(814): n is a, c, g, or t
aaaagaggctcaaaaaaatccaaaaatttctcatcggtaaaatcaaatactttcaatcaatctctttcgtaacgaaacgttacnnnnnnnnnnnnnnnnnnctaattttttcnnnnnnnnnnnnnnnnnnnnncttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnannnnnnnnnnnnnnnngtttatannnnnnnnnnnnnnnnnnnnnnnnnnnnnnnnnnnnnnnnnnnnnnnnnnnnnnnnnnnngggtgattacagnnnnnnnnnnnnnnnnnnnnnnnnnnnnnnnnnnnnnnnnnnnnnnnnnnnngaccacttttttttgataaaaggagaaatttaccttaagggaaaaggggaaattttttgg

SEQ ID NO: 12193 - DNA, 604 bp, Diabrotica virgifera
  misc_feature (16)..(37): n is a, c, g, or t
  misc_feature (61)..(87): n is a, c, g, or t
  misc_feature (112)..(153): n is a, c, g, or t
  misc_feature (163)..(245): n is a, c, g, or t
  misc_feature (247)..(274): n is a, c, g, or t
  misc_feature (286)..(322): n is a, c, g, or t
  misc_feature (326)..(382): n is a, c, g, or t
  misc_feature (400)..(424): n is a, c, g, or t
  misc_feature (458)..(478): n is a, c, g, or t
  misc_feature (480)..(512): n is a, c, g, or t
ggtaaagaggcaaagnnnnnnnnnnnnnnnnnnnnnngtaaaattaaaacagtaagttaannnnnnnnnnnnnnnnnnnnnnnnnnngagatgttattaatattgtatatgnnnnnnnnnnnnnnnnnnnnnnnnnnnnnnnnnnnnnnnnnnatggagagtnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnngttatgaaatgnnnnnnnnnnnnnnnnnnnnnnnnnnnnnnnnnnnnnaaannnnnnnnnnnnnnnnnnnnnnnnnnnnnnnnnnnnnnnnnnnnnnnnnnnnnnnnngataatatttaggtttgnnnnnnnnnnnnnnnnnnnnnnnnnatgtatttaataaatagattagtagagatttagnnnnnnnnnnnnnnnnnnnnngnnnnnnnnnnnnnnnnnnnnnnnnnnnnnnnnngtgaataatgattatatagtaagatatagtgtataattgatgtaatattataaaagaagaattaattatagaataagacagttatttattaa

SEQ ID NO: 12194 - DNA, 333 bp, Diabrotica virgifera
  misc_feature (6)..(28): n is a, c, g, or t
  misc_feature (219)..(292): n is a, c, g, or t
  misc_feature (297)..(331): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnct

SEQ ID NO: 12195 - DNA, 727 bp, Diabrotica virgifera
  misc_feature (3)..(16): n is a, c, g, or t
  misc_feature (21)..(528): n is a, c, g, or t
  misc_feature (535)..(572): n is a, c, g, or t
  misc_feature (592)..(605): n is a, c, g, or t
  misc_feature (608)..(630): n is a, c, g, or t
  misc_feature (638)..(660): n is a, c, g, or t
  misc_feature (690)..(721): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12196 - DNA, 828 bp, Diabrotica virgifera
  misc_feature (792)..(792): n is a, c, g, or t
  misc_feature (805)..(805): n is a, c, g, or t
  misc_feature (825)..(825): n is a, c, g, or t
  misc_feature (827)..(827): n is a, c, g, or t
ttatgatttagtcgtcagtgtttgtcaagatggcgtgatatgttcatgttcatatagatggatgttggatttattggtgtactttaaaaattaacggatattttgaaggtacgtacatatataggtattaaataaaagtaaattgagtaatttaagatgtaataataatattgttgcgtatccgaatggttaaaatagaaacataatagtatctttatatgctttttaggtataatgatggacgactctgaaataaaggagcttattattctaactgggaaatatgccacaatttaaagctgggacagaatgatataatatatagcttcagaacaatattaagaaaggagttattaaccaactgcggggccttccagaaatagtagaacttcatacatgtcggtaagtacctttttaaaaatgtgtatacttatggatcaaaactataataggtttcttcaatgtatcgtcttctataaaaatatacaatacaaagctatatcaaacatggcgggtttatttgagataaagaaatcagttagtctaaaagaaatatgtgtttatggttaagaaatgatattgccgaaaaccgtgaattagttaatatgtattaaatgacttagatgtaacctaataatactttcccgtaataaaatttcttaatgattaggtatgctgtctctttctgattataaaaattaagaaaattacatattattatgtctgcttagatgtttacattggttgtattttccctcttcttttagctaacaatgtttattgtgtgacttnatattatacagantaataattaaatattcattnanc

SEQ ID NO: 12197 - DNA, 927 bp, Diabrotica virgifera
  misc_feature (828)..(828): n is a, c, g, or t
  misc_feature (857)..(875): n is a, c, g, or t
ataatgcaaggaaaacggaatccagacctattactattgttatcaattgttcgaactcgatggtaatatttttagaaataagcgataattttttataatatcccgtcgtcaagcattacgtcagatgttcttcgatattacgcgaaaatgaacattccgtgacattgccctcgtgacactttggcataatttcactccccttcgggtcgtgaaatcaaaactgtcaaagtgtcacttgggatacaaatcgataattttagagctctcgtgcaattaccactgatacaatacgcactgcgcatacacttttctcttcaaacatatgtgcatataatttttacatatttccagtagcttaccaaatctagccccgcctaaacctattccgcgctgtatcttgtgcgtttagctattctttccaatttgtatctcatatccaaggcatttatacacatgtgtttctgttatgtcggcatcatctattaatctattctgatgttttgtgcaagcactaattttgtcattatttgagttttgcttacgtttattcggagacctactgcagatccagcttatgtcatttcttcaagcatatacttggcctcgccgatgttattcgtgatcagaacgatgccacctacgaatttaaggtgcatcaatctttctccatcaatattaatgcctgttggtcgatataatggcctaaaaaggctacttgaatgcttttccttattagcaacgcactcagccggattttgctaatgtaaagtgcaatattattgtattagccattgtatagttacctgaaactaagaggtaccaacttanagtacgaatattttatttaagatattaannnnnnnnnnnnnnnnnnngtattaaaacaaagttagattaaactaaacaaaagtttgtaataatttgttt

SEQ ID NO: 12198 - DNA, 764 bp, Diabrotica virgifera
  misc_feature (452)..(469): n is a, c, g, or t
agcgattgctgtacatgcacacataattttcgtatatatttaataattgcctcgcacatatataagattatatacatagatatagaaagccccatttcgcaggtattgatttatgaaccacatactcttgcgtatgacctctccaacatgccatattagaattgattgccaatgaccagagaaacagaacaacaccatcatatgggccattcccatacacaaaacgctctcttcttatatgctgccaagaaccctcaatacatgaaccccgtaccacaatgtttgatgccacacgcctaattgaccagctgatataatgactgaggtgaacattctgacatgaaagattgaacatttgaacaacaaaatgatgcaggaaaaccaattatcagatgtgcgtgcaagggcgattaccaattcttctacccacaataaataacttccatgctccnnnnnnnnnnnnnnnnnnctacacaatcatacttactaaacaatgtcaccaacgatctgcttcacagtgacctgcatatttcaaggactcacaacgtctgaatatcatggatgctgcaatgattgttgcactccaagaattacttattataaacaaacccaccgctgttgacatcgtctatgtctaaaactccaccgcacaaggtgagagactcgtactcattttccatctgagcgtcgatatttttgatgttctactcttaacaattgaatatgctatctttcaactcaaatatgctgctgtagacactcac

SEQ ID NO: 12199 - DNA, 639 bp, Diabrotica virgifera
  misc_feature (8)..(120): n is a, c, g, or t
  misc_feature (130)..(624): n is a, c, g, or t
gtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggggttggatga

SEQ ID NO: 12200 - DNA, 798 bp, Diabrotica virgifera
aaaaactccaaaaacaaaatcatcggcgttatacagttaataaacaagttcaatgatctccctttcacacaaaatgacgaaaatttcgtcgaagcgttcgctattttctgcggaatgggcatccacaatacgaggatgtacgaagcagctacgacagccgtcgcgaaacagaaagtcattttggatgtgctgtcttatcacgccactgctagtattgaggaggcccaaagattaagggatttacgggtaccgtctaatgttaagtttagacttctggacttcgcctttgatgacattcgtatgagtgatgatgaaactttgactgcctgtttacggatgttcttggatcttagtttagtagaaacgttccacatagattttgatgtattatgtagatggctgttatcagttaaaaagaattaccgagatgttacttatcataactggaggcacgccttcaacgaaggacagatgatgtattcaatattgcacgcaacaaggtggtgggaatatttgggatccattgaatgtctcgcgatgatgatagcttgtctctgtcatgatttagaccacaggggaacaaataattccttccaaatgaagatacattcacctatagcccaactatattccacttctacaatggaacaccaccatttcgaccactgtctaatgattctaaattcgctccagcttctttcatatctagcaccagaacagcattctagagatatcagggtattagaagatgccatattagctacagatttggagatttattttaagaaaccagttgac

SEQ ID NO: 12201 - DNA, 593 bp, Diabrotica virgifera
  misc_feature (7)..(43): n is a, c, g, or t
  misc_feature (45)..(67): n is a, c, g, or t
  misc_feature (69)..(86): n is a, c, g, or t
  misc_feature (88)..(116): n is a, c, g, or t
  misc_feature (118)..(136): n is a, c, g, or t
  misc_feature (147)..(165): n is a, c, g, or t
  misc_feature (174)..(204): n is a, c, g, or t
  misc_feature (220)..(277): n is a, c, g, or t
  misc_feature (279)..(298): n is a, c, g, or t
  misc_feature (320)..(371): n is a, c, g, or t
  misc_feature (398)..(438): n is a, c, g, or t
gagtagnnnnnnnnnnnnnnnnnnnnnnnnnnnnnnnnnnnnnannnnnnnnnnnnnnnnnnnnnnngnnnnnnnnnnnnnnnnnncnnnnnnnnnnnnnnnnnnnnnnnnnnnnngnnnnnnnnnnnnnnnnnnncgaatttaagnnnnnnnnnnnnnnnnnnnctttagtgnnnnnnnnnnnnnnnnnnnnnnnnnnnnnnngagaaatgttactcgnnnnnnnnnnnnnnnnnnnnnnnnnnnnnnnnnnnnnnnnnnnnnnnnnnnnnnnnnngnnnnnnnnnnnnnnnnnnnnttataaatattacataccttgnnnnnnnnnnnnnnnnnnnnnnnnnnnnnnnnnnnnnnnnnnnnnnnnnnnngtagagagtacaaactttcgtatgaannnnnnnnnnnnnnnnnnnnnnnnnnnnnnnnnnnnnnnnncatgaatagattgttgattaacggataaatttaagttatttatattgagcaggaacgaagtattactatcgataaattgtatatttaagaaaaatatgtaggcatagtaaaagaatgcaggcaacattatgctcacctgtttattataaacatgt

SEQ ID NO: 12202 - DNA, 900 bp, Diabrotica virgifera
  misc_feature (218)..(265): n is a, c, g, or t
  misc_feature (340)..(358): n is a, c, g, or t
  misc_feature (447)..(496): n is a, c, g, or t
  misc_feature (521)..(543): n is a, c, g, or t
  misc_feature (841)..(841): n is a, c, g, or t
  misc_feature (864)..(864): n is a, c, g, or t
gataagaatcacccaatattttttcaaaatcgttttaaaatctatacattagtctttaaatttttaaaatcagtccaacactttattaataaccagggagcagtcgcgccgttagaaaaaagctaacattttatccttttccatgataacttgatgaacaattttgcaacataactttccgctcataagtgcctcgaggaagattgttgtaatgcgtnnnnnnnnnnnnnnnnnnnnnnnnnnnnnnnnnnnnnnnnnnnnnnnngaatttatggctttagtgagaaccagttagctttaaaattgatagaaatagatacatatttttaacgtaacaagnnnnnnnnnnnnnnnnnnngtcgaaatttgttttaaattcgtattgttagaattaatctaatcgcgcgactgcttatgtggcagaagagagcgcgactgttcccgtgnnnnnnnnnnnnnnnnnnnnnnnnnnnnnnnnnnnnnnnnnnnnnnnnnnaaattgttattcaaattatgaaagnnnnnnnnnnnnnnnnnnnnnnncatttacaatcaatattattagctggttacttatttcgtagttcacacacatattaaacacacgcacacacatttcttagtttatcaaatgttgaaaccgtcgtgcatacaatgataaaacgttttgttcaaaaggtactctcacactccaaagcatttgctgtgtaattcttcgggattcgttgacagttgttgacgtaaatcttttaaacatgctagttgtgttctacagattttacttttagctctccccacaaaaattccaggggaacaaatctggtgaagtgaggaggccagntgatgctacctacctcttctccnaatcaatgccgagaaaaatattggtctaaatattaa

SEQ ID NO: 12203 - DNA, 410 bp, Diabrotica virgifera
  misc_feature (2)..(208): n is a, c, g, or t
  misc_feature (215)..(252): n is a, c, g, or t
  misc_feature (272)..(285): n is a, c, g, or t
  misc_feature (288)..(310): n is a, c, g, or t
  misc_feature (318)..(340): n is a, c, g, or t
  misc_feature (371)..(402): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggttggttnnnnnnnnnnnnnnnnnnnnnnnnnnnnnnnngaaaggac

SEQ ID NO: 12204 - DNA, 81 bp, Diabrotica virgifera
tccccacccgcgtccgcaaaaggtgacgataacatcgtcgtctcctctacacctaaccttcaaaatatcagattgggatca

SEQ ID NO: 12205 - DNA, 682 bp, Diabrotica virgifera
gggaaatttgaagaatagacattatgaatataataagtgcttagatggtatctgatttggaaaaggaatgccttgcttagataggcaggcgtagaaccggagacaaaagaccatttaaaacgaacttgaattctctttctagcctaaaggttcattgcaaatcttctggcacatgatgtacaaagggagttatgaacaccagcgtttgcgaaatgaatggaaaaatgacactcaagaggtgtgagtggtgaactttgtaagaatcctatttcgagatctatatatcctacagacttgcaccaaacttccatcttatctcaggatatatggaagaggtttatccctgaatcagtgtgcgtatgcctgtgtccctgaggaggggacctgggggacagaagaaggcctagctttctttcgcgcgtgttcttgctgttcttgtgatgatatttttgccatatggagagtattattgagctgaaaatatgagatttttatgacgggttcagtctgagtctgcattcctgcaaacgagatatgtgctccaagatgcaggcgactcacccattatgctccctgagtctatggactaatgcaccatgatggtagaattccgtcgggttgttcgaattgctccatatatcagtgaccctatgagattgtaaggttgcaataacgctgatga

SEQ ID NO: 12206 - DNA, 796 bp, Diabrotica virgifera
  misc_feature (7)..(72): n is a, c, g, or t
  misc_feature (90)..(108): n is a, c, g, or t
  misc_feature (117)..(131): n is a, c, g, or t
  misc_feature (133)..(149): n is a, c, g, or t
  misc_feature (152)..(170): n is a, c, g, or t
  misc_feature (185)..(205): n is a, c, g, or t
  misc_feature (343)..(392): n is a, c, g, or t
  misc_feature (397)..(505): n is a, c, g, or t
  misc_feature (508)..(553): n is a, c, g, or t
  misc_feature (561)..(646): n is a, c, g, or t
  misc_feature (677)..(731): n is a, c, g, or t
  misc_feature (737)..(778): n is a, c, g, or t
caccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatccnnnnnnnnnnnnnnnnnnnnnnnnnnnnnnnnnnnnnnnnnnnnnnnnnnnnnnnnnnnnnnnnnnnnnnnnnnnnnnnnnnnnnntagatatatttaaaaacgaataacatttcannnnnnnnnnnnnnnnnnnnnnnnnnnnnnnnnnnnnnnnnnnnnnnnnnnnnnnctcttnnnnnnnnnnnnnnnnnnnnnnnnnnnnnnnnnnnnnnnnnnccctgatacacaaggtac

SEQ ID NO: 12207 - DNA, 931 bp, Diabrotica virgifera
  misc_feature (331)..(351): n is a, c, g, or t
  misc_feature (793)..(793): n is a, c, g, or t
  misc_feature (823)..(824): n is a, c, g, or t
  misc_feature (835)..(835): n is a, c, g, or t
  misc_feature (844)..(844): n is a, c, g, or t
  misc_feature (867)..(867): n is a, c, g, or t
  misc_feature (918)..(918): n is a, c, g, or t
ctagtttactgtagtttcttgtttccattttcaaccgtggatagaatattgttgcttttattttctgtttattacaagctgacactcaggtttacattatgacctgtaaaattgttataatcaatccaggtatttttcgtccaggtgatgcgataacaggaaaaataatatgtatattcgaaagggaagaacgaataagaggtattaaatgtcaatttcgtggaagagaaaaagttcactggaacgagcgaagagggaaacatacaacacattatcatggacaaaccgattttgtggtggctaataccgattttatggacgaaggtacaannnnnnnnnnnnnnnnnnnnnataacttctcgtatgtactacctccatcagatattccaagttcttaccaacatcagtttggtagtatcacatattttttgcacgcctacgtggatagaccgtttgcgttcgattacaaagatgacgtggcattacacgttgtatcacctataataaatcatccaacacaccaaatgagagcagtatcactggaagtcaacaaagaagtggggacatgttgctggcccaaagaaccctcgactatggagttgcgactagaaagagacaactatgtattaggagatgtgatctactttaaagcgatcatacgtaacacgtccgattcagaaattaacagcatagcggtacaactatcaacgactgtccaacttacggcttactccccatcaacaagacataaaacagagagaattcttttagctgtagcagaagggattctggntggtgcaccaggaagcacaaaaattcatannatttagtttanaaaattccntgaaactgctataaataactaanttttactagatgcacattattaaaaacaatgggtggttcattacggggtancagcactctatcc

SEQ ID NO: 12208 - DNA, 734 bp, Diabrotica virgifera
  misc_feature (22)..(535): n is a, c, g, or t
  misc_feature (542)..(579): n is a, c, g, or t
  misc_feature (599)..(612): n is a, c, g, or t
  misc_feature (615)..(637): n is a, c, g, or t
  misc_feature (645)..(667): n is a, c, g, or t
  misc_feature (697)..(728): n is a, c, g, or t
tactaatattatcatcattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12209 - DNA, 967 bp, Diabrotica virgifera
  misc_feature (659)..(660): n is a, c, g, or t
  misc_feature (702)..(702): n is a, c, g, or t
gaataaaattattacgatctctcgctgttccatttacagttaatcaagcggtgtttcgcttttattaaattaatgttacataaagtgttcaagtgaatgtgcattgtggatggttttcaaggtgtttgttgaaattgcattctattgatgatattaaaaagggaatatttaactgcagctatctgtacccttgtattttaaaatatggcaaacttaacagaattaaccaccctcccgacaactgtaactgaattaccaaaattaactagcaactcctcacaaaatgcaactattgaagaagaagcttatgcagcgttgagttcattttgtggatctcctttttgggacacaaacctaacatggaacacaaacgacccagagttcacaccgtgtttcgagaaaactgtactagtatggataccgtgtatttttctatgggtcttcgccggcctagaagtattttacatattcaacagcaaacgacgcaatataccatggaactggttaaatttatcaaaattagcaataacagccactctaatagttttaacaattagtgatatagtaaactcattcaaaacggcaggtaacagaggcagcgaagtgaatgatgtggatatttactcgccgttgatcaaaatactaacatttgcccttannccggagtttttattttctacaatagaaagcacggtctacaanacgtccggacttgttattcctgttctggttcttcgtcgtcctttgtgccattcctcagttcaggaccgaaatcagaagaagccaaaggaacgagatattgcccgattattactatttttacaccagctacctgatatattttcctctggtcgtgttgatgtttcttcttaactgtttcgcggataaggcacctttggaaagaaagtatccacaatcacagaatccgtcaccagaagagagtgccagcttcttatcacgtctactc

SEQ ID NO: 12210 - DNA, 744 bp, Diabrotica virgifera
  misc_feature (11)..(144): n is a, c, g, or t
  misc_feature (147)..(260): n is a, c, g, or t
  misc_feature (278)..(446): n is a, c, g, or t
  misc_feature (451)..(488): n is a, c, g, or t
  misc_feature (508)..(640): n is a, c, g, or t
  misc_feature (662)..(682): n is a, c, g, or t
  misc_feature (684)..(733): n is a, c, g, or t
tttttttgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggagaggagagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnnnnnnnnnngtgggtgttttaagggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccgccccccgcccgcgcggnnnnnnnnnnnnnnnnnnnnntnnnnnnnnnnnnnnnnnnnnnnnnnnnnnnnnnnnnnnnnnnnnnnnnnngtggtgagggg

SEQ ID NO: 12211 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12212 - DNA, 775 bp, Diabrotica virgifera
  misc_feature (2)..(44): n is a, c, g, or t
  misc_feature (52)..(164): n is a, c, g, or t
  misc_feature (173)..(361): n is a, c, g, or t
  misc_feature (363)..(449): n is a, c, g, or t
  misc_feature (455)..(477): n is a, c, g, or t
  misc_feature (480)..(537): n is a, c, g, or t
  misc_feature (539)..(552): n is a, c, g, or t
  misc_feature (564)..(583): n is a, c, g, or t
  misc_feature (605)..(617): n is a, c, g, or t
  misc_feature (619)..(637): n is a, c, g, or t
  misc_feature (671)..(761): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnncgatcnnnnnnnnnnnnnnnnnnnnnnncgnnnnnnnnnnnnnnnnnnnnnnnnnnnnnnnnnnnnnnnnnnnnnnnnnnnnnnnnnncnnnnnnnnnnnnnncgtctttttggnnnnnnnnnnnnnnnnnnnncgcccaccgattaatttgaacnnnnnnnnnnnnncnnnnnnnnnnnnnnnnnnncaatcattaagttttttcatcgaaagccggaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaaagaccctat

SEQ ID NO: 12213 - DNA, 867 bp, Diabrotica virgifera
  misc_feature (2)..(582): n is a, c, g, or t
  misc_feature (604)..(668): n is a, c, g, or t
  misc_feature (672)..(840): n is a, c, g, or t
  misc_feature (842)..(866): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccactggattaatttgaaannnnnnnnnnnnnnnnnnnnnnnnnnnnnnnnnnnnnnnnnnnnnnnnnnnnnnnnnnnnnnnnngaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnc

SEQ ID NO: 12214 - DNA, 161 bp, Diabrotica virgifera
  misc_feature (3)..(156): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctt

SEQ ID NO: 12215 - DNA, 995 bp, Diabrotica virgifera
  misc_feature (898)..(899): n is a, c, g, or t
  misc_feature (911)..(911): n is a, c, g, or t
ccgtaacctaaagtttgtttgcattttgcatagttaaaagttaaaataaaatacaaacatggaaaggaatagaagtaattttagacctcctaattcagacatgtttccacaaaggtttagaaatgattcaaggaaccattggcaacctcagtttaattcaaataatccctgtaattttaatccttgggtatccaattctctacaaaactctgcccatagaccatacaatgcaggaccaggattcaatactgtgcgacagagaggttcttcatggacgaataatggacataacggccaatggaatcaaaaccgtaatatgcgggggcaaaactggcccaataatactgaagataataatgggggttattggaagcaaatttcaggtaatcaaaatgaacagagatctagttttcaacgaggaaattttactagggaacgaaggacaccatatgatagacccagagaattttttaacaaccgaaatgacagatttaatgctcaggataggtgggagggacctagcaatacagaagttaatgactcatcatacgacactgtcccagaacctctgagtccactagaagcaaaaattgaaaaactgatatcagaagttcaaggccagcctgacaaaataggagaattaatattgctacaaaataataacgaaattcctccagtattgataaacaacgccgtacatcaagttaaaaattgtgtaatgaatattgacagagatgaagaaacaggtttttctaaattgagaataaacaatacagttatttgcgagggcatgtattcttcaaagaaagatgccaaggaagcactgtacgaaatggctctagatattttgaaaatgaaatgcttctttatttcttcaaatcacactacgaagaagttnncatggatgatantaataataaaaagacagagattccagaaaataacccagtcgacagcaatagtgttgctttaaaatgatgtaaaaatgggatggg

SEQ ID NO: 12216 - DNA, 570 bp, Diabrotica virgifera
  misc_feature (2)..(76): n is a, c, g, or t
annnnnnnnnnnnnnnnnnnnnnnnnnnnnnnnnnnnnnnnnnnnnnnnnnnnnnnnnnnnnnnnnnnnnnnnnnnttccgaattatttttattttacacaaattaaaaacatcactttgatccagggggggcttggaattttttcataaatttaactaaaaatttaacatcatctaaagtaacgggattatataaactagctcggattcccccaaaagatttgggcctttttaggtgaaacattttaattttctcgggttcaacaaaaaaaagttcttcgagtttttcgttgcccccacccactctgaagggaaagtacattttacttgggacggattattaaatgggggaaggggaaaaacctttaaattcaaccggggggttgaacaaaaaagtgttcttttctatgggtgggttttccggggtttcgagacctccgttctttttaatccactgaagtacctttaccatgacataaaaagagaatgttgtgggagggttatggacagatttttttatggataagaggatggaaccctttagagagggacggtatttcatgggatttg

SEQ ID NO: 12217 - DNA, 985 bp, Diabrotica virgifera
  misc_feature (16)..(40): n is a, c, g, or t
  misc_feature (45)..(115): n is a, c, g, or t
  misc_feature (117)..(785): n is a, c, g, or t
  misc_feature (809)..(809): n is a, c, g, or t
  misc_feature (850)..(863): n is a, c, g, or t
  misc_feature (866)..(879): n is a, c, g, or t
  misc_feature (953)..(977): n is a, c, g, or t
ctcccccggcgtccgnnnnnnnnnnnnnnnnnnnnnnnnncctcnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcgtaattttattggagangtcaaatcgataataaagattgcgaccctcgatgttggatnnnnnnnnnnnnnnggnnnnnnnnnnnnnnaattaagtctgttcgacttttaaaatttaactgatctgagtttaaaccggtgtgagccagggtggtttctatcnnnnnnnnnnnnnnnnnnnnnnnnngaaaggac

SEQ ID NO: 12218 - DNA, 959 bp, Diabrotica virgifera
  misc_feature (637)..(677): n is a, c, g, or t
  misc_feature (808)..(808): n is a, c, g, or t
  misc_feature (910)..(932): n is a, c, g, or t
  misc_feature (934)..(948): n is a, c, g, or t
caagtcgtaccgacaaacatgtcagcaaatagcagtacctggactttcgttttcatcgcgattttagccttaggggtgagtggggcgcgtaatcgaaacaagagaccccagcaagagcccgttgaagttgatgacagtgccgaaatctcagaccagtgtccggaaccagatgggtacttcgcggatgcggaacagtgcgataagtactaccattgttcgaatgggagaataacggagaaattgtgtccagatggacaggttttcaacgactacagttcggaatatgaaaagtgtgatttgccgttcaatattgattgcagctcaagacctaaattgcaggaacctcaacctagtgaacactgtcccagaaaacacggttactttgcccacgaccagaaaaacatctgcgacaaattctacttctgcgttgacggcaaattcaacgccatcacatgccccaacggtctagtctacaacgtcaaagccggcatctgttcctggcctgacgaagccaaaagaagcggctgcacctctgaagaagtcttcgagttccagtgccctaaagtaaccgaagatgtagccatcacccacccacggtaccccgatccagaggactgccaatacttctacgtttgcnnnnnnnnnnnnnnnnnnnnnnnnnnnnnnnnnnnnnnnnnccaagtatttcgatgatgtcaccaaacgatgcgactgggcgagaaacgtgccagaatgtgccgattgtaccaaggaagattgacagagcaacagttgaaagacttggaaaatccaccaacggcaaggcccnaagcgactaaaggaagtaaagaggaaaggtcagaggccacgagagagaacagtagtacatgacgatgaataactttatggtttagtcttttagtcgggaagnnnnnnnnnnnnnnnnnnnnnnngnnnnnnnnnnnnnnnattaacaaata

SEQ ID NO: 12219 - DNA, 443 bp, Diabrotica virgifera
  misc_feature (10)..(28): n is a, c, g, or t
  misc_feature (99)..(116): n is a, c, g, or t
tacgaaatgnnnnnnnnnnnnnnnnnnncctgatgctggttcgttaaattgataaatgtaatttcaattctaacagtaataaaagttagtttccacgtnnnnnnnnnnnnnnnnnntaattcaactttgacgttacgaattgtcgccgttacgaactaatggcgttacgaattttccgttaccgtttgtggggttacgcactgtcgcgctacgagatgtcttgatataaaatctataatgttgacgttacctgatagttaacagttgaaaagttaaaaaggtatttaaaaccgaatttcatacataaaaatcatcgtaataattattactacttattgtttaatattaaagtgcatatgtatatattgttaaaaattattgttagatataaatgctaggtactgtgtacttatttatgatatattaaaagaattattggtatt

SEQ ID NO: 12220 - DNA, 1100 bp, Diabrotica virgifera
  misc_feature (951)..(990): n is a, c, g, or t
  misc_feature (994)..(1018): n is a, c, g, or t
  misc_feature (1067)..(1093): n is a, c, g, or t
attgaaccatttaaaacgtgatatctcattttgacagatctagagtaattgctttgtgataacagggctttatttaaagtgatatttatcgcgagtatttttgaagttactcagagtgctgtatcgaaaatttaaaaaaaatccaagatacaaatgacatgaaggatcgccccagaggtggtagaactcgatatacaacagaagcacgagaccggcagataacattgatagctcgaagaaatcgtctggaatctacaagtggtatatccagagaaattgctacatgttcctaaactaatctaccaacacaaaatagtaaggttgcaatgggctagagaaatggtgcatcatggtcctaactggaataacgggatttcctttgatgaatcaaaaattggcttgttttctgattcgcgaagagtactggtttggagggccccaggataacaagtccgactagaaatagcccaaccgcgtgccccatttgaaggtggcagtattataatttggggtggtattatgagtggtacacggacgccactgctggttctggagagaagagtcactggtgttgtgtacatcgagaaagttttaaatcctgtcgtgcatctattccgaggggcagtaggtaataatggatttgtgtttatgcatcacaacgcgcctcctcatcgaacagcagcagtacataattttcttcaagaagaaggaatatctacattacagtggccttcgaattcccccgacatgaacgtcattgaacatgcttgggacattctcaaaacacgcatcaagaagcgaaacaatcctacacttcgagaactaaaagatgctgctcgtgaaaaatgggagataattacgcaagccccagctcaaccaagttattccaacaacttgccaaatccgactataaggcaggcatgccaggcccaatggaaggaaaatacacgnnnnnnnnnnnnnnnnnnnnnnnnnnnnnnnnnnnnnnnncatnnnnnnnnnnnnnnnnnnnnnnnnngggagaagctgggcaacttttgggaaagtttttttccccccccaaaagnnnnnnnnnnnnnnnnnnnnnnnnnnncaatttc

SEQ ID NO: 12221 - DNA, 278 bp, Diabrotica virgifera
  misc_feature (2)..(172): n is a, c, g, or t
  misc_feature (179)..(272): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttaag

SEQ ID NO: 12222 - DNA, 966 bp, Diabrotica virgifera
  misc_feature (210)..(236): n is a, c, g, or t
  misc_feature (243)..(262): n is a, c, g, or t
  misc_feature (402)..(419): n is a, c, g, or t
  misc_feature (471)..(472): n is a, c, g, or t
  misc_feature (814)..(832): n is a, c, g, or t
  misc_feature (846)..(846): n is a, c, g, or t
  misc_feature (857)..(857): n is a, c, g, or t
aaccatatccttacgaatttttatccatcacttacatttcttaataataatgccattgtaacgtatattgtattgacatttaaaaggtttttacgcatgtatttttgatggctcagcatgtgatttgctgtaacagcactgatgatgatctatttagatcgaaaacattatttcataaatgtggttatttcagtaaccctcttcgagggnnnnnnnnnnnnnnnnnnnnnnnnnnngacattnnnnnnnnnnnnnnnnnnnnggttaatggtatacagccagctacaagaaaattttttctctttgtagttgtctgtttgaagtcaaatgattctgaaattttatttcctaatttttaagttcctgaaagtagaaaaataatttctttgcaacaaagtaagnnnnnnnnnnnnnnnnnnggaattgattgactctcaacataactctcattttatgcttaactggtccagnntacagctgggttcctaaaaaaactgatacgactcttaaagcgtattttgtagaaaattgagcagtgtattttgaaggataaatacttattatttacctactgtcactgccaaatcttaaaatttgtcagataacttattctgttcaacctaaaaaataacaacagccctattttatgtaaaaaccatcatttataggtaggtatactctttataaaatgcaggaattcaaaatatgtaatatcaaaatttagaccttaataattattacaatttttcaattaacatatgtaatccagttggtttggttggtttgggttgtttattttagtatttctctgtcnnnnnnnnnnnnnnnnnnngtcagaccaatcanatacactgctncaaatgatcaatcttacttataagtcgtatcagtttttttaggaaccagcgtacatttccaaggtcgaaggtgtccttttagttttgcacataaagacaaaacatatgc

SEQ ID NO: 12223 - DNA, 926 bp, Diabrotica virgifera
  misc_feature (112)..(132): n is a, c, g, or t
  misc_feature (696)..(714): n is a, c, g, or t
  misc_feature (881)..(881): n is a, c, g, or t
acgtaataatcggttttaccggttgttttttgtcacggttataaccggtttttttcattttaaagtaataaccggtgaaaaaccggataagtggaaaaaaaataatgaattnnnnnnnnnnnnnnnnnnnnntttttactttcacacgcacgaatgagaaattttaagctgaccgaaaccgatttgacaacattgatgactaatttcgatactgatgtggattgatatcgattagaatggagtatcgcaaactaaagctcaatataaaggtaacttatttggtattggctattgactaaaaaaccgaaaactcttggtctattttatcctattcatatttttccacgttttgtagtctataaagtcaagaaattggccggtccattgaacctggggaagaggaaaatactcgggcggttcatcctgcactgttccaaggaagcttttcttggattttggtcgctctcgtggtgttcgagctttgtatagggcatgccactcgccagtaactgtttatacatgtcattttactttgttggcgtgtcgacaacaaactactggcgccagtagatccaagcatgtataaactcgcctttatgttataattgttttggattccttccgtggaagtgactaaccttccagcagaaggaaagcttattgcaaggtctgctcaacgcctgaatgttcctattnnnnnnnnnnnnnnnnnnntttagtttggatcaaagacaaatatattacctaaaattagataatgaatctcataaaactcaccttgttgtaatctttctttttcagtgctatgattccttcagatattacttacatgagtaaaatagaaggtatcacgtgtttttataagtattatgaattatttntgcataaatggtaagatgactttattaagaagtggcatttcaata

SEQ ID NO: 12224 - DNA, 807 bp, Diabrotica virgifera
  misc_feature (548)..(583): n is a, c, g, or t
  misc_feature (729)..(750): n is a, c, g, or t
gaaaaatttgatttttaagttttagttgcatttaaaatactatgataggaatttaaaatggtattttactttgaaagcactgtcgtttcacctcctacagtcttatttatgggtatagacaaaaatgaaaatgaagatctaatcaaatggggctggccagaagatgtttggtttcatgtggataaagtatcttctgcccatgtttatcttcggttaccacctggacagacaatagacgatataccctcaacagttttagaagatgccgcccaactcgttaaagctaacagtataaatggaaacaaaatgaatgatgtcgatgtagtgtataccatgtgggcgaacctgaaaaaaacacctggtatggaagttggccaagtgggatttcataaagaaaaggaagtgcgaaaaatcagagtagcaaaacgaattaatgaaattgtcaataggctaaacaaaacaaagaaagaagagcatccagattttaggggagaacgcgaaaagagagataggttagagagagaagacaaaaagaaaaacttacgggnnnnnnnnnnnnnnnnnnnnnnnnnnnnnnnnnnnnggaaagaagatgctgaacttaaaagttataattctttaatgaatgcagataatatggccaaatacgacgatggcaatgattccgatgattttatgtaatgtaagttttaaggcgatgatattgagaagaaaacatactcgttttgnnnnnnnnnnnnnnnnnnnnnncaactttttacatttgtgtcaaaattattttgtaacatcttttggttaagtttttat

SEQ ID NO: 12225 - DNA, 971 bp, Diabrotica virgifera
  misc_feature (92)..(108): n is a, c, g, or t
  misc_feature (305)..(328): n is a, c, g, or t
  misc_feature (701)..(716): n is a, c, g, or t
  misc_feature (779)..(811): n is a, c, g, or t
  misc_feature (814)..(834): n is a, c, g, or t
agcatctctaattttaaggaatcttgtcatttactccagtcaatgtaaaaggtacttaaaatcgtacgaatcccacttagcaaacgtagcgnnnnnnnnnnnnnnnnnctcgaggacgatagcacaaattctgttcgatatgaacgacggctcgacgcacaggtgacctaaacgtaaaaaaagtgactggagtacatgaacaattttgtgaagaattgtgaatataaaagagaacttgtgtaaattattaaaacaaagtgtacaaaaatatttagttggttaggtcgaacgagtaagatgcctannnnnnnnnnnnnnnnnnnnnnnncgtagtgtacggagatattggactcgacgagttatttctactgtgaacaccccaatcccttccttccccccaacatttaaactggaaatattataacagaatgtttatcggtgcaattcagaactaaataccacttggggaatcattaaacgctattagaaaagaaaaatcgttgaaatagtaattttatttagagttattcaaaatcagtttttatcagatttttaaaaatttacctatacaaaataaagtcgacatttcggcttcagagacattgtttatctctggcattggtaagccacacatttttatattatggcgggtctaacgtcatctgtcatatacttgtgtgtatattcgatgctgttatatnnnnnnnnnnnnnnnnacaacattcagtattttatggtactattaccgtctaaaaggctaaaaaaatgatattttcagnnnnnnnnnnnnnnnnnnnnnnnnnnnnnnnnnacnnnnnnnnnnnnnnnnnnnnnacaaattttgaagattacagaattattgtttttattgttcctgtattttaaagatggcgccacaatttgtttgtcaaaaattattgtccctggcggacagttattccctgggaacgacaaggtttaaacataaaaat

SEQ ID NO: 12226 - DNA, 492 bp, Diabrotica virgifera
  misc_feature (12)..(12): n is a, c, g, or t
  misc_feature (16)..(16): n is a, c, g, or t
  misc_feature (21)..(22): n is a, c, g, or t
  misc_feature (24)..(25): n is a, c, g, or t
  misc_feature (29)..(29): n is a, c, g, or t
  misc_feature (31)..(31): n is a, c, g, or t
  misc_feature (39)..(39): n is a, c, g, or t
  misc_feature (123)..(123): n is a, c, g, or t
  misc_feature (345)..(345): n is a, c, g, or t
ccttcaaggcgnccgngaagnnannagangnagaaagangacctttaaaaggaagagggagaggagaggaagggaagaaaggagagggagggagaaagaggggaaaagaggagacccggagcncagaaaaaagccgcggaaaggcgccacgaagccaaccaaaaaagcgcagcggacacagcaaacgccaggcaaaacgcgcgggagaagaccaaaaacaacaacgaaagaaacgccagccaaacggccgaagcagaggagaaagcaaaagaggaaacgaaaaacaccggagagaacaccacgcgcaagacaaaagcagcagcggagcaagcaaaagagaagcancggaaagcaggagaggagagccagaacgccggagagaaagaggccgagaacacggacaaagcacaacagaaagcggggcaagacacgcaggaaaccggagaaaggagcaaggagaaagcaggaaaaaccgccaagggagaagagccc

SEQ ID NO: 12227 - DNA, 783 bp, Diabrotica virgifera
  misc_feature (17)..(17): n is a, c, g, or t
  misc_feature (23)..(23): n is a, c, g, or t
  misc_feature (26)..(30): n is a, c, g, or t
  misc_feature (35)..(37): n is a, c, g, or t
  misc_feature (447)..(466): n is a, c, g, or t
  misc_feature (542)..(559): n is a, c, g, or t
ttactaggcgcccgctnatgtgngannnnngaagnnngactttaaaacaacagaagaaatttaaatggatgatattgaaattttataaagaatattggaaattgataaatattgcctggaaaaagtggataattattaaaatgttttgtaagtatttgaaatgaaaaaggagttgtttgatttaataaaaaaagatgataatattgataaatatattgttgaaaaatgtagagagataggatattaatattgagtaaggttagataatattaaaattagaaaatgttatagtaaataataatatataagtttagtgatggtatttgggtgtatttttttgtattgtgaatttaaggaaaggatgttagtatagatataatgaatggattgtaaatggtatattatgaattgatgaagtattttgagcgtgatatggaagaatagtannnnnnnnnnnnnnnnnnnngagaaatgaatggatggataatataaaaagtgtgtttatataattgataaagaattttatattgtagataagaagnnnnnnnnnnnnnnnnnnattagatgaatgtatagagttgtataatagtattaataagtattgttattattaatttgatttatagaataaattaatttagttggggtgattataaaataaatataactttcttgatataattatatgaaagaataaatatttgatccagtttttttgattatcagaataaattatcttacggataacagcgaaattttattggagagttcaaatcgataata

SEQ ID NO: 12228 - DNA, 400 bp, Diabrotica virgifera
ccttagcgacaaaggtttgctattttacgaccggcctgagttattatagaggtttaagatttttatgatggccgacacctaccctaatattattatgcattgttatattattgggtatttcacaatattatattcgggaaaataccattacttacagtaattagggcaaattttaacattttattagttgtattgtacaaactagttatattatatgttatgattaaaatatgatgacattgtcttttagaccgaaaaatacctaattatgggatatataagatttttaaaatatgcacactaatgtttggatcattatccaggtacctgacgcattcttataaaatttataaaggaataaaaccaggatttttgtatataacttatgtaaaggattctc

SEQ ID NO: 12229 - DNA, 525 bp, Diabrotica virgifera
  misc_feature (15)..(37): n is a, c, g, or t
  misc_feature (45)..(66): n is a, c, g, or t
  misc_feature (68)..(81): n is a, c, g, or t
  misc_feature (84)..(122): n is a, c, g, or t
  misc_feature (124)..(138): n is a, c, g, or t
  misc_feature (140)..(155): n is a, c, g, or t
  misc_feature (157)..(169): n is a, c, g, or t
  misc_feature (174)..(198): n is a, c, g, or t
ttcttaggcgtccgnnnnnnnnnnnnnnnnnnnnnnngaaccttnnnnnnnnnnnnnnnnnnnnnngnnnnnnnnnnnnnngannnnnnnnnnnnnnnnnnnnnnnnnnnnnnnnnnnnnnngnnnnnnnnnnnnnnngnnnnnnnnnnnnnnnngnnnnnnnnnnnnnttacnnnnnnnnnnnnnnnnnnnnnnnnngggatgagtttaggaatatgatttatttaaggcttcgtgtttattatgatagagacgacaaaccttgttcatatggacacataggtgatgatcaattactatatataattgtgagaagtgtatcattctcctatctttattttagaacatattggaaattcttggaggtagagattagctctaatagtagaaccaagtcgagtattgactcaaagaatgaggatcatagattgtgctctaagagaatactgtggaagcgggatgtttagagaggattggtgttatgaatgagcgattgtattaagaaagctggagtctggcttattt

SEQ ID NO: 12230 - DNA, 165 bp, Diabrotica virgifera
  misc_feature (13)..(31): n is a, c, g, or t
  misc_feature (33)..(47): n is a, c, g, or t
  misc_feature (49)..(123): n is a, c, g, or t
  misc_feature (125)..(146): n is a, c, g, or t
aattttgaccgcnnnnnnnnnnnnnnnnnnncnnnnnnnnnnnnnnncnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnncgagaaaaccccaatagag

SEQ ID NO: 12231 - DNA, 326 bp, Diabrotica virgifera
  misc_feature (2)..(63): n is a, c, g, or t
  misc_feature (65)..(185): n is a, c, g, or t
  misc_feature (187)..(220): n is a, c, g, or t
  misc_feature (260)..(272): n is a, c, g, or t
  misc_feature (275)..(293): n is a, c, g, or t
gnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnccctttaggggaataaccagcggaaattttttattgtggnnnnnnnnnnnnntcnnnnnnnnnnnnnnnnnnncgaacccccccaatggttgggattataaaggtt

SEQ ID NO: 12232 - DNA, 1064 bp, Diabrotica virgifera
  misc_feature (19)..(608): n is a, c, g, or t
  misc_feature (610)..(669): n is a, c, g, or t
  misc_feature (677)..(715): n is a, c, g, or t
ccccgttccacagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnagctaacnnnnnnnnnnnnnnnnnnnnnnnnnnnnnnnnnnnnnnncagggatgcatgctccacaaacctgacgaaatttacttcttacctcatcctacaatttggaccaagatcgccccttgtatatcgaaaacaataaaatttcctggaaaacaaggaaaaccactcccaatgggcctactgacaacttcttccattgaataatgaaacccgtttttaccatgggacccgacagtattacgcacaaaaacaacatgaaccctaaagtccccaataaaactaccaatctccaccaaccaccaaatgccatttggcccaataccgggacccaaagatacccgcaacaaaaccccacaacattttgaaggcctgggaaccacccccggaaggggga

SEQ ID NO: 12233 - DNA, 202 bp, Diabrotica virgifera
  misc_feature (7)..(44): n is a, c, g, or t
  misc_feature (64)..(77): n is a, c, g, or t
  misc_feature (80)..(95): n is a, c, g, or t
  misc_feature (111)..(133): n is a, c, g, or t
  misc_feature (136)..(136): n is a, c, g, or t
  misc_feature (174)..(174): n is a, c, g, or t
  misc_feature (177)..(177): n is a, c, g, or t
  misc_feature (181)..(181): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnattaagtctgttcgannnnnnnnnnnnnnnnnnnnnnnagnttaaccggtggaggccccaggtgggtttctatctttanttnatanttatattttagtacgaaagga

SEQ ID NO: 12234 - DNA, 787 bp, Diabrotica virgifera
  misc_feature (2)..(747): n is a, c, g, or t
  misc_feature (751)..(786): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcnnnnnnnnnnnnnnnnnnnnnnnnnnnnnnnnnnnng

SEQ ID NO: 12235 - DNA, 944 bp, Diabrotica virgifera
  misc_feature (2)..(42): n is a, c, g, or t
  misc_feature (44)..(939): n is a, c, g, or t
cnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggg

SEQ ID NO: 12236 - DNA, 948 bp, Diabrotica virgifera
ttcattgtgtacgtcgccgcaatagccgcggtagcttatgcccgaccaggcggtgattacggacacttggaattggcaggcggttatgaagatggtggacattatggaggccatgaagccaccagctaccagcatggtggactaatagctaacgagattggccacggtgacgaaggacatcatgaggagcacgtcgactaccatgcacccgctaaataccactacgactacgcagttcacgatttgcacacccacgacatcaagtcccaatgggaaaccagaaacggagacaaagtaaaaggcgaatacaccgttgtagaaccagacggttccagaaggatagtctcatacacagccgacaaacacaccggatttcacgccgtcgtcaaaaacgttcacgattactagaacttttatcgggtaagaacaaaaaattgttgaataaaagtggcataatatcaaaaattgcgtagaaaaaagtggtagtaaatttactaattttaaaatgtaatagtagatagtttattaacttattattctcattaattttaaaattgtattttggataaaagttttaaagtttaacttatatttaattgtatttaataattctcataataattcataaaattgcacaaggttcaaacaagttttcaatgtttattttattattagtgtttacactttatattagtcaatgcatatcagtatttcatattgctactgtaccaaattttactgataattagaaataaaccaatttgatattattaagtctaaaataccagtacatataatatagactatagactattattatgtcaaaatttaactatacctataaaatctgaaaaatgcatatagatccatttttttattaatctgtaggtctgattggcacagtaattttgaatagataaagattttcgtaatgatctaaaaatattt

SEQ ID NO: 12237 - DNA, 939 bp, Diabrotica virgifera
  misc_feature (116)..(139): n is a, c, g, or t
  misc_feature (355)..(378): n is a, c, g, or t
  misc_feature (391)..(408): n is a, c, g, or t
  misc_feature (442)..(464): n is a, c, g, or t
  misc_feature (690)..(710): n is a, c, g, or t
  misc_feature (873)..(892): n is a, c, g, or t
  misc_feature (895)..(924): n is a, c, g, or t
ggaataacctttgatcgaatacccctatttgtttgagctgtcgtaattacagcaatccttcttctattattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttggtgcacattttcattatggattatctataggagctgtatttgctattatagcgggatttatccaatgatttcctttatttacaggtatannnnnnnnnnnnnnnnnnnncannnnnnnnnnnnnnnnnnnnnnnnnnnnnngtgttaatttaaccc

SEQ ID NO: 12238 - DNA, 571 bp, Diabrotica virgifera
  misc_feature (12)..(12): n is a, c, g, or t
  misc_feature (17)..(17): n is a, c, g, or t
  misc_feature (19)..(21): n is a, c, g, or t
  misc_feature (28)..(28): n is a, c, g, or t
  misc_feature (30)..(30): n is a, c, g, or t
  misc_feature (32)..(32): n is a, c, g, or t
  misc_feature (36)..(38): n is a, c, g, or t
  misc_feature (53)..(53): n is a, c, g, or t
ccgtagaggcgnccggntnnntagagangngngggnnncccttaaaggaggancagaaaaacgagaagaacaaacaggagagaaaaggcgagaaggaaaaggaggaggagaacccccaaaagaagcccgaccacaagcaaagcaaacacgagaagcccaccgaccagaaagacaaacccaagaagcaagaccggaagaccaaacgcgagaagccagaccagcaacagcaacacaggaagcgagacccgaagaaacaacgcaagaaaggagaccagaagagccaacccgggaaggaagaccagaagcagcaacaccggaacagaaacgaaccgggaaatgacaaggcggagaagaacaaacaaagggaggaagaacaagcaaacaagacaaacgcccgccgaagacaaagagaaaagacggcgagaaacagaggaggggtggacgagagagcaaacaaaggacgacagagagaagatgacttagagaacaaggccctcccagacattcaaaggacgaaggctgatgcgtcccatgctatggacaccatcggaccaaaagatagaggtgaatt

SEQ ID NO: 12239 - DNA, 875 bp, Diabrotica virgifera
gccgattaaacagaacaatatgacctgatttgtatgtgacgtaattattatcaagacaaaacgcatatatgtctgtgagtagaagaatgtgtctatccagcgctttgaactcctaatatattaacgatttctgaatacagggtgaatgacacctcagacaagataaaaattaattcaatatttaaatggctcgaacaagttgtaaatgcctctatgacctggaacccataccaatataacactgttgtgttgcgccagtctgtcgagctcgtgtcgatattccgacagtagcctagagtccaccttagggcttataagaggcccagtggctgcttgtctatctgtgcatatgttaatccgctgcaattcgaaggccctcaagttgttttctcttgcaatctgcaagattgcaaaagtctgtgcctgaaatacagaggtatattctcctagtggaaaagaactgttgaaatttccaccgctttgtcagtagatataatctatcgtgtgataatacccggtccaaatatttcatttcatcctcggcttcgagttttgtcaccttttttgtaagaattgcttgcacgacccattttaaagacactaaactaatttaatatacaaaacgcgcatacgctttcacaacgcgcatgcgctaaaactgtacgtatagctctaacataaatttgaatttcttctttgatttttttataatctgtaccgactttgactactatcaggcattatataccatatatgttaggttgtccatttgcactgcaagtattagccacacaggttgggcgcggtatatgataccgggtccaactttaaatatattctaaaacactctttacatgagcaaaaatgtttctctg

SEQ ID NO: 12240 - DNA, 681 bp, Diabrotica virgifera
  misc_feature (19)..(19): n is a, c, g, or t
  misc_feature (30)..(30): n is a, c, g, or t
  misc_feature (222)..(241): n is a, c, g, or t
tttaaaggcgccggggatnaggaacgaagnaagcggaaacctttaaaaaggcacggaaagagccagaaaagaaacccaaggaagacgacgggaaaaacgacgcaagaaagagacccagaaaggaacagggggagacggacggagaaggagaaacgacacaggacgaaaagaaaaaagggatcaccgacaaagaaacgaccggcgacggcacgaacccacgannnnnnnnnnnnnnnnnnnngaacgccgagaaagataaggaacccaagctcagttgttaagagttggtggattttggttaaaagtaaagtatactagttctgtagggattgatttactgataggatttgacgatcactatgaagactgcctaaggtgttttataaaagaacaggcaggtgagaaagaagaaagtatttactaaaatttcatctaagtggagtgatgaattacgaaagaagtccaacgaaagggatttatagataatagtcgaataatgaaaagttgtcagatctattactcatattcagatgacagtgctaaaactacaacaagatgaaagactacattatggaaattatattgagaggtggtatggtattttacgaagaaccttgagccatcaaactctgtgaagaccgtattcctattgccctaccctttcgcttttgataaaatgat

SEQ ID NO: 12241 - DNA, 203 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (162)..(193): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccagggttggttnnnnnnnnnnnnnnnnnnnnnnnnnnnnnnnngaaaggacca

SEQ ID NO: 12242 - DNA, 101 bp, Diabrotica virgifera
  misc_feature (6)..(100): n is a, c, g, or t
ggggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 12243 - DNA, 304 bp, Diabrotica virgifera
ccaaaaaaaacaccaagaggacaaggaagacagataggaacaagacacgcaagcgacacagaagggagcacagggaaaacaacaaacagcaggggagacacaggagaaaagcacagcggaaaaagagggacaggacacacaagcacccccaacaggaacaaggaaagcaccagggaagcgacacgacacacaaaaaagaaaaagacgacagagggaccaagacaaaagggagaagaggacagagaggcagcagacgaccaacggcagcgaaaaaacgagcaaggaggagaacaaacagaaaaag

SEQ ID NO: 12244 - DNA, 955 bp, Diabrotica virgifera
  misc_feature (871)..(890): n is a, c, g, or t
gtacattaataaaatcattctcaaaactttcgtgacataagttactctgaatgtttctgtgataatgagtgtggttatatattttgttttctatgaaatcatctgcattagagtttttgtactttttgtatactacataaaattttcatagatactattagtaaaaatccgcacacttttaaaatatgtcatgctatgtctatctgtaagtattaggtacatttatgtgggtcgctgttttttggaaaacgttttcccgagatctttttttttgtaacaatattttatgatatttttaaggagagttgatataaactattgtaatttttaaatattcgggacactatatttttggcacacgaatctgataaaaaaatttgcagcttagacgcaacaacaaaacaatagggttatcggttagtgtgaataaaaaaatctacgaaagttacaatacatacaatagtttgtaacatatttatcttctcaaataaatcagaaaaaataaatcagaataaataaatcagaataaatttagtaatcgcaaaaaaaagagcgtaactattaatatacctatataactctttgtgcctatcctcacttatgcttataatatacttgtatataacagcgctacaaactttgtaggcctctggcttccaaaaacttattttacgtctctccacttttccctgtcccatgctcttgctttactgcttccaaccatttcttctttgggcgtcctctcatttttccccatttctcccccctcaggattgttttattattttggttctctggcattcatgtaatgtgaccaagccatctagctctttggtattttttccgtaagtattggtgttccatacatccnnnnnnnnnnnnnnnnnnnncgtcttctcccaatattttctggcatctgtcaaagatcatttattcaaaaatgtactttttcttt

SEQ ID NO: 12245 - DNA, 812 bp, Diabrotica virgifera
  misc_feature (2)..(623): n is a, c, g, or t
  misc_feature (625)..(652): n is a, c, g, or t
  misc_feature (654)..(676): n is a, c, g, or t
  misc_feature (687)..(704): n is a, c, g, or t
  misc_feature (707)..(768): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnncnnnnnnnnnnnnnnnnnnnnnnngatgaaggggnnnnnnnnnnnnnnnnnnccnnnnnnnnnnnnnnnnnnnnnnnnnnnnnnnnnnnnnnnnnnnnnnnnnnnnnnnnnnnnnngaccgagaagacccctatataagttttaataacatttatttaag

SEQ ID NO: 12246 - DNA, 610 bp, Diabrotica virgifera
  misc_feature (2)..(147): n is a, c, g, or t
  misc_feature (156)..(269): n is a, c, g, or t
  misc_feature (271)..(286): n is a, c, g, or t
  misc_feature (288)..(324): n is a, c, g, or t
  misc_feature (339)..(417): n is a, c, g, or t
  misc_feature (441)..(455): n is a, c, g, or t
  misc_feature (457)..(513): n is a, c, g, or t
  misc_feature (530)..(558): n is a, c, g, or t
  misc_feature (566)..(594): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttagtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnannnnnnnnnnnnnnnnnnnnnnnnnnnnnnnnnnnnngatgaatttaaatgnnnnnnnnnnnnnnnnnnnnnnnnnnnnnnnnnnnnnnnnnnnnnnnnnnnnnnnnnnnnnnnnnnnnnnnnnnnnnnngtcggcaacatttatttcacctgnnnnnnnnnnnnnnnannnnnnnnnnnnnnnnnnnnnnnnnnnnnnnnnnnnnnnnnnnnnnnnnnnnnnnnnaatttgaccgggctaannnnnnnnnnnnnnnnnnnnnnnnnnnnnggctgaannnnnnnnnnnnnnnnnnnnnnnnnnnnncatgtattatctttct

SEQ ID NO: 12247 - DNA, 727 bp, Diabrotica virgifera
  misc_feature (685)..(700): n is a, c, g, or t
gatacgcagtatttgatctctacttcagagttcaaaacgttcaaatcataaacaaataaggttatgtagaggacgagatctaattaaattttttcgcaaagaaaagatttttcgaaaaaaattagtgttgtcaacagtttgtgtgtttgttagtggcattgaattcaagtggtgtacaagatgacggacgcgaataataaaaaaatagggcaaaatagtatcgtccaacccctcctgactgatttataccaaataacgatggcctatgcctactggaagacaggaaaaatcgacggatacgcagtatttgatctctacttcagaaaaaacccattccaaggagaattcacaattttcgcgggcctagaagagtgtcttaagttcctcgaaaaattcaaatattccgagagtgacatcgaatatatcaaacaaatattgccagcgtcaatagaagaagagttttttgactacttaagaacagtcaccgcagaccagatcaaattttattctgtcaatgaaggtacagttgtttttcctcgagtgcctctaatccgaatagaaggtccgttgattatagctcaacttctagagactacactgttaaatctagtgaacgacgatagcctactggttactaatgatgatcgatacagactagcctcacgaatattgaagttgtacgagnnnnnnnnnnnnnnnnaggagggcgtgatgaacattagtttga

SEQ ID NO: 12248 - DNA, 713 bp, Diabrotica virgifera
  misc_feature (27)..(67): n is a, c, g, or t
  misc_feature (140)..(155): n is a, c, g, or t
  misc_feature (157)..(188): n is a, c, g, or t
  misc_feature (291)..(315): n is a, c, g, or t
  misc_feature (357)..(387): n is a, c, g, or t
  misc_feature (392)..(498): n is a, c, g, or t
  misc_feature (542)..(580): n is a, c, g, or t
  misc_feature (585)..(643): n is a, c, g, or t
  misc_feature (647)..(684): n is a, c, g, or t
aaaaagaaaaataggtagggataaggnnnnnnnnnnnnnnnnnnnnnnnnnnnnnnnnnnnnnnnnngttatagattaaaagttatcatattttaagatatgatatgatgtaatatgatatagtatgaattttatattgnnnnnnnnnnnnnnnngnnnnnnnnnnnnnnnnnnnnnnnnnnnnnnnnagatgataatatgaatattagaaaattgtgtatgtagttgtattggtatagggttgatataggaattcggtaagatttttgtggattgtttattaggaacatnnnnnnnnnnnnnnnnnnnnnnnnngatcgcctgctcactgattagtttgaatggaggcggaattgnnnnnnnnnnnnnnnnnnnnnnnnnnnnnnngtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccttataaagttttataaagtattaaaaaaggttttttaagnnnnnnnnnnnnnnnnnnnnnnnnnnnnnnnnnnnnnnnggggnnnnnnnnnnnnnnnnnnnnnnnnnnnnnnnnnnnnnnnnnnnnnnnnnnnnnnnnnnntgtnnnnnnnnnnnnnnnnnnnnnnnnnnnnnnnnnnnnnncttaagggtaaaaaccggcgaattttttt

SEQ ID NO: 12249 - DNA, 949 bp, Diabrotica virgifera
  misc_feature (25)..(44): n is a, c, g, or t
  misc_feature (73)..(92): n is a, c, g, or t
  misc_feature (106)..(131): n is a, c, g, or t
  misc_feature (140)..(164): n is a, c, g, or t
  misc_feature (710)..(732): n is a, c, g, or t
ctcttttccgcgtccggttgttctnnnnnnnnnnnnnnnnnnnngatgctgttcatccttgccgctgcccttnnnnnnnnnnnnnnnnnnnntctaggtgccttcnnnnnnnnnnnnnnnnnnnnnnnnnnccataacgnnnnnnnnnnnnnnnnnnnnnnnnngctgcgattcgctgttttccgagacaacgacatgaaaatatagaagattaatgctaaatatgaaggggaatgataacgataataatggagtgtcaacaaatacagctctatgtaaaggggatttatttgaaattaggtaatgacgaaaaaaccgtaaaatcttggactattctatcctatatagatggttcaccggttacgcagactataaaggactgaaattgttcgggtcattgatccaggggaagaggaacatactcgggagggtcatccagcactgctccaaggaagattttcttggattgtggacgctctcgtggtgatcgagctttgtataggcattgtcactcaccatcatctgtgaatacatgtcattttactttgatggcgcgtcgacaacaaactactggcgtcagtagatacaagcatgtataaactccatctttatgctatagttgtttaggattcctagcggggaagtgactaaccttccagcagaaggaaagattattgcaaggcctgatcaactgctgcatgctcctattnnnnnnnnnnnnnnnnnnnnnnngattggatcaaagacaaatatattacctaaaattagacaatgaatctcataaaactccccttgatgaaatctttctttttccgcgctatgattcccttcaatattactttactgatgaaaataaaggggaatccgcgttttattaaggaataatgaaatattttggcataattgggaaaatgactctattatgaagcgcatttccaaattttttatt

SEQ ID NO: 12250 - DNA, 813 bp, Diabrotica virgifera
  misc_feature (12)..(33): n is a, c, g, or t
  misc_feature (99)..(99): n is a, c, g, or t
  misc_feature (315)..(332): n is a, c, g, or t
  misc_feature (710)..(736): n is a, c, g, or t
ccttcctagggnnnnnnnnnnnnnnnnnnnnnngaaggagctcttagtaagggaaagaaaggggtgaaagaagggaaaaggaggaagggggaaggaagngaagaagaggaaaattccctaagagaagagaaaagagaaaagggaaaagggttattttgtgattgatgaatgagaaaatttaagatgagagaaaaagatttgataagatagaagattaattttgaatgtgaagagtaatgatatggattagaaagaagtatggaaaataaaagatcaatataaagggaagttatgttggaattgaggaattgatgnnnnnnnnnnnnnnnnnnggtgtattttatgatatatatatggataaattgttagtagtatataaaggtgtgaaattgttatgattattgatggagtggaggaggaaaataatagggaggtgtattgagttgtgttagaatgaagtttttgttggattgtggatggtatgttggagttagagttttgtatagggattgatagtgatcagtatctgtgaataaatgtaattttattatgatggtgtgtggataaaaaaatagtggagtgagtagatagaagaatgtataaactagggtttatgttatatttgttttggattttttgtgggggaagtgattaaagttagagtagaaggaaggattattggaaggaatgatcaatggttgaatgttgtnnnnnnnnnnnnnnnnnnnnnnnnnnngattggattaaagaaaaatatattacctaaaattagataatgaatcctctaaaactcttcttgttgaaatctttctt

SEQ ID NO: 12251 - DNA, 102 bp, Diabrotica virgifera
  misc_feature (4)..(79): n is a, c, g, or t
gggnnnnnnnnnnnnnnnnnnnnnnnnnnnnnnnnnnnnnnnnnnnnnnnnnnnnnnnnnnnnnnnnnnnnnnnnnnnntaagaaaaaattacccttaaggg

SEQ ID NO: 12252 - DNA, 926 bp, Diabrotica virgifera
  misc_feature (80)..(103): n is a, c, g, or t
  misc_feature (116)..(133): n is a, c, g, or t
  misc_feature (167)..(189): n is a, c, g, or t
  misc_feature (415)..(435): n is a, c, g, or t
  misc_feature (514)..(533): n is a, c, g, or t
  misc_feature (598)..(646): n is a, c, g, or t
  misc_feature (786)..(806): n is a, c, g, or t
  misc_feature (814)..(814): n is a, c, g, or t
gctattacaatattattaacagatcgaattttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctntttcttttcaacgaaaaagattaagaccttaaagaataacttcttcaattgaatgactacaatttaaccctccagctgaacacagatattctgaattgccaatattatcatc

SEQ ID NO: 12253 - DNA, 147 bp, Diabrotica virgifera
  misc_feature (2)..(52): n is a, c, g, or t
  misc_feature (54)..(72): n is a, c, g, or t
tnnnnnnnnnnnnnnnnnnnnnnnnnnnnnnnnnnnnnnnnnnnnnnnnnnnannnnnnnnnnnnnnnnnnntcgcggcattttgaccgtagcaaagaagcataatcattagtgtttgtattgaaagatggaatgagggatgggatg

SEQ ID NO: 12254 - DNA, 1193 bp, Diabrotica virgifera
  misc_feature (10)..(10): n is a, c, g, or t
  misc_feature (17)..(75): n is a, c, g, or t
  misc_feature (84)..(249): n is a, c, g, or t
  misc_feature (264)..(381): n is a, c, g, or t
  misc_feature (390)..(650): n is a, c, g, or t
  misc_feature (660)..(672): n is a, c, g, or t
  misc_feature (675)..(787): n is a, c, g, or t
  misc_feature (821)..(876): n is a, c, g, or t
  misc_feature (881)..(924): n is a, c, g, or t
  misc_feature (926)..(1183): n is a, c, g, or t
atttattttnaaataannnnnnnnnnnnnnnnnnnnnnnnnnnnnnnnnnnnnnnnnnnnnnnnnnnnnnnnnnnattgtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggtaaattccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttgaaaannnnnnnnnnnnncgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggggggggttcttttttttctctcctccggnnnnnnnnnnnnnnnnnnnnnnnnnnnnnnnnnnnnnnnnnnnnnnnnnnnnnnnnagggnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggggag

SEQ ID NO: 12255 - DNA, 471 bp, Diabrotica virgifera
  misc_feature (77)..(77): n is a, c, g, or t
  misc_feature (125)..(145): n is a, c, g, or t
  misc_feature (170)..(204): n is a, c, g, or t
  misc_feature (214)..(245): n is a, c, g, or t
  misc_feature (283)..(295): n is a, c, g, or t
  misc_feature (297)..(314): n is a, c, g, or t
  misc_feature (334)..(352): n is a, c, g, or t
  misc_feature (413)..(427): n is a, c, g, or t
  misc_feature (429)..(443): n is a, c, g, or t
  misc_feature (445)..(460): n is a, c, g, or t
cataaaaggggtccgatttttgtttaattgtaaggggatatcataaaaggggaggagaagaggagagaaaggaaagngaaggaaagggaaggagaagagagagagaaaaggattttttcaaaagnnnnnnnnnnnnnnnnnnnnnatcttgtgtgtgtgggattattagnnnnnnnnnnnnnnnnnnnnnnnnnnnnnnnnnnnagagttttgnnnnnnnnnnnnnnnnnnnnnnnnnnnnnnnnttgtaaagagttttttatggaatgaaaaggtaataggnnnnnnnnnnnnngnnnnnnnnnnnnnnnnnngtgaatatgattaattaacnnnnnnnnnnnnnnnnnnngaggagaaaacgagtaatatttaaataatgtgaagggatgaactttataataagagttgtnnnnnnnnnnnnnnngnnnnnnnnnnnnnnngnnnnnnnnnnnnnnnngttttaaataa

SEQ ID NO: 12256 - DNA, 952 bp, Diabrotica virgifera
  misc_feature (132)..(152): n is a, c, g, or t
  misc_feature (864)..(905): n is a, c, g, or t
  misc_feature (914)..(943): n is a, c, g, or t
tacaaaactaatacttaagtttcatgcccttagtattatcattacatccacttattccaaattatattttgataactaggtaactattgtgttaatagtgttataccaacacaacacatagtgccaaaggannnnnnnnnnnnnnnnnnnnngcgttagttggacaaatttgagtttgaaaatgttggatcgttcgaaaagtgttacggctatactggtgtatttatcggtgctagtgttttatgtattcagtttgtattgttcggactcagtaggaaaaaatattaaatcgaacaaggttaaaataccttcacagttaaggggggtcgtagaatacgggaagtgtttctttacattatggaattttatgctccaaatcttcttcatttcgctagccgtcctagatgaactctcaaaacttctgagcttaccatcaaaagtccagaatctcctcagcaaagtcagggcctacatattcaacagcctcgtgtttccatgcagcacattagtagtttttacgttttggtctatctgggctgtggatagagaactgatattcccgaaagttatggacacattctttccatcgtggttgaatcatgtgttacatactttcatagctattcctttagttatagagatattgctgccaaagaaagataattttgtgcaattcaagaatgcagctcctattttattattttatgctggattataccagacattgtatttttccatatacctcaaggatggagtatggctatatccaatatataaagttcttagcataccccaaatggtgttatttaatatagtacaaatggtattgatattaggattccagtatggaggtataagtctccnnnnnnnnnnnnnnnnnnnnnnnnnnnnnnnnnnnnnnnnnntcaagggannnnnnnnnnnnnnnnnnnnnnnnnnnnnncgccctaac

SEQ ID NO: 12257 - DNA, 136 bp, Diabrotica virgifera
ggggggaatttccggggtcttcctacgcgccggatttattagagaagaagtaaaagtatttttttagtgataggatggaatattttgagtataggatagctgattagagttgtgataaaatatttaatgtgattat

SEQ ID NO: 12258 - DNA, 133 bp, Diabrotica virgifera
  misc_feature (13)..(32): n is a, c, g, or t
ttttgcaataccnnnnnnnnnnnnnnnnnnnnccattcacacaagtgggcaatatagaaggttaaaaccaatttcattgtaagagaaactattctaaattatattgtttcctgcataaatttttaagctactc

SEQ ID NO: 12259 - DNA, 172 bp, Diabrotica virgifera
  misc_feature (12)..(42): n is a, c, g, or t
ctctgaagtttnnnnnnnnnnnnnnnnnnnnnnnnnnnnnnncagcttgataggattattactaggatttggtaggactgaactaggtaacataatctaccgagtcgcttgcgtcggtttcaacaatactgtcaccggtaatattcgcccaatcctaaaaacacttcatctt

SEQ ID NO: 12260 - DNA, 218 bp, Diabrotica virgifera
  misc_feature (36)..(63): n is a, c, g, or t
  misc_feature (83)..(96): n is a, c, g, or t
  misc_feature (99)..(121): n is a, c, g, or t
  misc_feature (129)..(151): n is a, c, g, or t
  misc_feature (181)..(212): n is a, c, g, or t
gaataaattaccttagggataacagcgttattttannnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12261 - DNA, 1134 bp, Diabrotica virgifera
  misc_feature (86)..(103): n is a, c, g, or t
  misc_feature (539)..(580): n is a, c, g, or t
  misc_feature (785)..(785): n is a, c, g, or t
gtaaatatcccctctacgtacgagctcacagcgtatagggcttttcattcacagtcatttgtttcgagcttcagtcatgtgtcacnnnnnnnnnnnnnnnnnnctacgtcatacgttattggtatctaccaatgatgcaaaccaaagacgtatgacgtagctatattaatattgtgtgacacatgacgggggctcgaaacaaatggcaatcgatgaaaagccctattctctcatttttccgactgtaccttttttctgtcacttgtgacgcactgaaagatgtctctgagaaggagattagtaattatactacagattttcccgaaactctgaaattttccattcattccagcgataaggaaaacgtgccaggaaaacattgcgctgtatttgagtggaattttctgttttcatatatcgaatcctcagatcgaagttgtttttccataattgagtagtttgaaaaccttatacgatatttgcaccttgctgaagatttatgactgccataagaaatataattaaatggctgtttcacnnnnnnnnnnnnnnnnnnnnnnnnnnnnnnnnnnnnnnnnnngatatcactaatcctgccaatatagaactaccatatcgttattgtttcttgaaatcaactagagtttttagatgcagctaaagatataatactggcaaaattggtaaaacatttggaagcagccatgacgtaactaacagcattaattaacaatgattagattgaggttcgtcgaatgttatgtttagtcgtaactactacatgnggtagaagcttggactctgaaagtccaatccgtaaaaaattgggggcattggaaatgtggctatataggggtgagcagataaacgccctattagaaatattttgagacctaaaggcaacagaatcataaaaattgaaatgaaagggggttttgaagagtgatctatgtaatgaaaatattttcatcttattttgtacttccggtttataccggaagtttgttatatacttaattttttttaatggggaaacccctggaatttttttacatttttttggattcttgcctcaaaggctttttttccttaaaaaaaagaaggggtttggtaaagggttataaagggggcccg

SEQ ID NO: 12262 - DNA, 122 bp, Diabrotica virgifera
  misc_feature (2)..(19): n is a, c, g, or t
  misc_feature (21)..(34): n is a, c, g, or t
  misc_feature (52)..(97): n is a, c, g, or t
cnnnnnnnnnnnnnnnnnncnnnnnnnnnnnnnntaataaggaatttcggcnnnnnnnnnnnnnnnnnnnnnnnnnnnnnnnnnnnnnnnnnnnnnnaatataagtctcgcctggccactga

SEQ ID NO: 12263 - DNA, 391 bp, Diabrotica virgifera
tgtactcaaaaatcttgtcagttttgactcttgctgctgtggcacaggccggtgttttggactattcacatggccatgccacttcatacgcttcttctaacttaggtcttggacacggacacgccgtaccagtggttgcccatggatacaatgcaccggtcctttcacatggggcctctgcacaccatgacgtagattactatgctcatcccaaatacgaattcaactacggagttcaagatggccacactggagaccacaaaactcaacacgaagtacgtgatggtgacgtagttaaaggttcctacaccgtagctgaacctgatggtactcttcgtactgtccactacactgctgatgaccactacggtttcaacgttgttgtcgaaaa

SEQ ID NO: 12264 - DNA, 206 bp, Diabrotica virgifera
  misc_feature (2)..(50): n is a, c, g, or t
  misc_feature (53)..(65): n is a, c, g, or t
tnnnnnnnnnnnnnnnnnnnnnnnnnnnnnnnnnnnnnnnnnnnnnnnnnagnnnnnnnnnnnnngttttatttaacgtaaaagacaccacacatcgaacctttattgactttgaattttatttcacatccgcaatacatctcacgaaacacttcaataacacatacgactatccttcaactcttcacactctcccataaccaacc

SEQ ID NO: 12265 - DNA, 860 bp, Diabrotica virgifera
  misc_feature (488)..(510): n is a, c, g, or t
gttaaatttaatcaatcagctgctgaattatatagaaaaattactgatcttgtaaacaatgccgagaaaagaattaacagcaatatgcagaaagctaaagcaagtattttacaagaagtacgtctttatgcagatgactcgttggtaaagaaaaaaacatttgacgaagaaatggaaaaaattaaacaatatgtaaatatttcactaaatgctatacagcagaatagtacacataaatcacatcttgaatatattaaggaaaatgttgagtttataaacaatactataaaaaataaggttgatatatatgaagacaaatttcaaaaattagaaaataatatgaaaattatgtctgaagatcttgacaaaagtataacggataaaattgaggcagctttattaccttataaaaactctagtacagtatctgatgaaaaacttcttgatttagagaaaaggacaagccaaaaattgactgatctcaaatnnnnnnnnnnnnnnnnnnnnnnnacaaaaaatgataatcttctaaacaaaatagataccctagacacaaaaattatacaagcagaaaacaatattgcaaaacagaatatgatctcgcaaaaaattgacaagatacttgatgacataaggcaagataaaagctcgttaaacaatcaactcaaaacgcagcaaaacgctataaataatcttcacaatgaaatagccgatttagaccaaaaaatatcaaacaacactgacataaataataatctagactccattaataaaacttttagcgaaaaatatagaagatttacagcaagaagttaaaccaattgaggcaaaggtagatggtacaaattctaataaattga

SEQ ID NO: 12266 - DNA, 91 bp, Diabrotica virgifera
  misc_feature (17)..(75): n is a, c, g, or t
gttggaatgaggggtgnnnnnnnnnnnnnnnnnnnnnnnnnnnnnnnnnnnnnnnnnnnnnnnnnnnnnnnnnnnaagctataattttttt

SEQ ID NO: 12267 - DNA, 868 bp, Diabrotica virgifera
  misc_feature (553)..(614): n is a, c, g, or t
  misc_feature (689)..(706): n is a, c, g, or t
  misc_feature (790)..(790): n is a, c, g, or t
  misc_feature (855)..(855): n is a, c, g, or t
  misc_feature (858)..(858): n is a, c, g, or t
gatttgtaagtgtagtgatggagcttttcgatggtaatatggaatacagggtgttccatataaaattatggagaaagtcttgtatttacattttgacttgccctgtgtacaatttgtgtggttatggaaaaattgtacatttttgcaaaactactctaatattgacagtcgggagcattaaagagatgggtttacattacaccgttggaaacatacagggcgatcgaatcggtatgattttttgatggaggtgctcgaaactttgaagcactcagtataaccctggacaagtgttatatctctagagtcagggaagtgtagagaaaccagattttgaataaaatacagggtgttctatttaaaaaaacataactttggtttggcaccgtgttatggaggaccctgtatatttctcactgattttaaaatgtgtacattaaaggtgcctatggcttttgttaacaattttttttcatatattgtatgataacagatattttggactttgtcacagaagttgatcaccctgtatgcaacaacacatatacctacnnnnnnnnnnnnnnnnnnnnnnnnnnnnnnnnnnnnnnnnnnnnnnnnnnnnnnnnnnnnnncaattttgtatcctaccagatttcatcagtcatccattgaaaacaacaatgaatgacaaagaaaaacagcaactnnnnnnnnnnnnnnnnnnggtagctaacgaaaaatggatggaggataaatgcaaggaattagaaaagttgaatgaaaaacatgatacgtttaatatgtttanaaaagttagataaatagctggtctttatcataagaaaactccacatactataacggattcgtcgnaanaaatgataat

SEQ ID NO: 12268 - DNA, 269 bp, Diabrotica virgifera
  misc_feature (5)..(47): n is a, c, g, or t
  misc_feature (53)..(75): n is a, c, g, or t
tttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 12269 - DNA, 751 bp, Diabrotica virgifera
  misc_feature (4)..(31): n is a, c, g, or t
  misc_feature (138)..(161): n is a, c, g, or t
ggcnnnnnnnnnnnnnnnnnnnnnnnnnnnnaagatatataatctaggaaatacaaaaacaaataagggattgaaagtgagacacggtacccaggaaagagttttccggttagaattcatctcaaatcaagagttcannnnnnnnnnnnnnnnnnnnnnnntagaagcaagtacagctgcaagtaacgagttaccatcaaaggggaagatcgaacagaaacaggctgatattaaagaagcgattagttacgaatttaacgaacaagacgtagaacgaataattcaagaaaagtcccgtttcaagccaaaccctttcaactacgctatgaagaagactcaactaatgaaagaaagggatggagctctaagcagaggcgatgaagacgttgcgagggaattagctcagaagctatccgacttggaagaaagagcttcagaattagacaaattacgtacttcaaccatttccagtatctcttacataaacgatagaaataggaaaaagaatgtagaagaagccgaaaaggctattatggaggaagttagggcaaataaaggcaaaaaagctgatgatccattcaccagacgatcgacccaaccctaggatgaacttcaaagcaggagaaaaaagaggcccgtgccctccaaggaagctgaaattgcaaaattggcaagcgaaacgcaaaagaatgaaaaaatagaaggtcttgaaaccaaaaaatccgcccaacctgctcaagtttctcaggat

SEQ ID NO: 12270 - DNA, 1156 bp, Diabrotica virgifera
  misc_feature (846)..(867): n is a, c, g, or t
  misc_feature (870)..(883): n is a, c, g, or t
  misc_feature (1072)..(1092): n is a, c, g, or t
  misc_feature (1094)..(1120): n is a, c, g, or t
  misc_feature (1123)..(1135): n is a, c, g, or t
cacaaattggagacaagttcgcgtctaggcacggacaaaagggaacgtgcggtatacaataccgtcaagaggatatgatttttagtgctgaaggtattacgccagacattatcattaatcctcacgctatcccctcccgtatgacgattggtcacttgatcgagtgcatccaaggtaaggtatcatccaataaaggagaaatcggtgatgctacacctttcaacgatgccgtcaacgtacagaaaatctccactttgttacaagaatatggttatcaactcagaggcaacgaagtaatgtacaacggccatactggacgtaagataaatgctcagattttcttaggacctacctattatcaaagattgaagcacatggtggacgataagattcattcaagagctagaggaccgttgcagattctcgtcagacagcctatggagggtcgtgcaagagacggcggtctacgtttcggtgagatggaacgagattgtcaaatttcacacggtgcggcacaattcttaagagagaggctgtttgaagtttccgatccttatagaatccatatttgcaacttctgtggtttgatagctatcgccaatttgcgtaacaacacctttgaatgtaagggttgcaaaaataagacgcagatatcgcaagttagactgccttatgctgcgaaattactgtttcaagagctaatgtcgatgaatatagcgccgagacttatggtactgtagtgtttttaagtaaataaataaatgtccttatctaagaggattttatattgaaataaaccattaaaattttcccaccacaccccaccaccaccacccacacaaaccnnnnnnnnnnnnnnnnnnnnnngannnnnnnnnnnnnngggggggggcgctttaaagggatccaaggtttaaggcccgcggggaggggacagcctaaatctttttttataagggcccccaaaaattcaatttccccggggccgcgcttttttcaaacagcccggggacggggaaaaaacccctggggggtttccccaattttaatctcccctttggcaaaacccttnnnnnnnnnnnnnnnnnnnnntnnnnnnnnnnnnnnnnnnnnnnnnnnnggnnnnnnnnnnnnnacaattctcccccctcctccc

SEQ ID NO: 12271 - DNA, 555 bp, Diabrotica virgifera
  misc_feature (2)..(29): n is a, c, g, or t
  misc_feature (36)..(102): n is a, c, g, or t
  misc_feature (104)..(184): n is a, c, g, or t
  misc_feature (196)..(230): n is a, c, g, or t
  misc_feature (232)..(324): n is a, c, g, or t
  misc_feature (335)..(354): n is a, c, g, or t
  misc_feature (395)..(413): n is a, c, g, or t
  misc_feature (461)..(478): n is a, c, g, or t
  misc_feature (486)..(509): n is a, c, g, or t
cnnnnnnnnnnnnnnnnnnnnnnnnnnnnaatttgnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnngagaagaccccnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccattttttnnnnnnnnnnnnnnnnnnnncttagggaaaacagggaaattttttttgggagggtcccaannnnnnnnnnnnnnnnnnnccccccccgggggggggataaaaggttttttaattgggggggggagcnnnnnnnnnnnnnnnnnngttgtttnnnnnnnnnnnnnnnnnnnnnnnnctctgttattggtgggggtttatacaacccggcggggggggggggg

SEQ ID NO: 12272 - DNA, 606 bp, Diabrotica virgifera
  misc_feature (22)..(60): n is a, c, g, or t
  misc_feature (73)..(111): n is a, c, g, or t
  misc_feature (125)..(182): n is a, c, g, or t
  misc_feature (194)..(363): n is a, c, g, or t
  misc_feature (366)..(453): n is a, c, g, or t
  misc_feature (484)..(514): n is a, c, g, or t
  misc_feature (526)..(549): n is a, c, g, or t
  misc_feature (576)..(603): n is a, c, g, or t
ggatagttatttagaatggggnnnnnnnnnnnnnnnnnnnnnnnnnnnnnnnnnnnnnnnggaacctggggannnnnnnnnnnnnnnnnnnnnnnnnnnnnnnnnnnnnnnccgaatttaaaaannnnnnnnnnnnnnnnnnnnnnnnnnnnnnnnnnnnnnnnnnnnnnnnnnnnnnnnnngaaaggttatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaatttagtaaggaggataatattagaatnnnnnnnnnnnnnnnnnnnnnnnnnnnnnnnggttaattaagnnnnnnnnnnnnnnnnnnnnnnnntggtttatacaaaaccggtctttttgnnnnnnnnnnnnnnnnnnnnnnnnnnnngga

SEQ ID NO: 12273 - DNA, 1141 bp, Diabrotica virgifera
  misc_feature (110)..(133): n is a, c, g, or t
  misc_feature (349)..(372): n is a, c, g, or t
  misc_feature (385)..(402): n is a, c, g, or t
  misc_feature (436)..(458): n is a, c, g, or t
  misc_feature (684)..(704): n is a, c, g, or t
  misc_feature (866)..(915): n is a, c, g, or t
  misc_feature (1001)..(1024): n is a, c, g, or t
  misc_feature (1076)..(1106): n is a, c, g, or t
  misc_feature (1122)..(1139): n is a, c, g, or t
gaaggatagtagaaaggggggttggtaccggatgaacagtttacccgcctctgtcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactccctcattgatattgtacttctgatacctattatgttgttgccctttttcttatgtattatccataggagctgtatttgctattatagcgggattttccaatggtttcctttatttacagggaaaacnnnnnnnnnnnnnnnnnnnnnnnnnnnnnnnnnnnnnnnnnnnnnnnnnnggggaaatttcacccttcttccccccaccatcttttaaggataaataaggaatacccccgccgaaaatttcaaaatatcccggtgnnnnnnnnnnnnnnnnnnnnnnnngttccctcttcttgggatccccaaatttcttcttagggggggggaaatttcnnnnnnnnnnnnnnnnnnnnnnnnnnnnnnntttcttctttctcccnnnnnnnnnnnnnnnnnnga

SEQ ID NO: 12274 - DNA, 98 bp, Diabrotica virgifera
cttcagttgtgtttgtcttatcaaccagcggatgctttgatcctatcaaccctgctgacttgcatttcggcgttgtttgtatttttgagtatgtcgac

SEQ ID NO: 12275 - DNA, 323 bp, Diabrotica virgifera
  misc_feature (2)..(14): n is a, c, g, or t
  misc_feature (18)..(55): n is a, c, g, or t
  misc_feature (73)..(106): n is a, c, g, or t
  misc_feature (124)..(185): n is a, c, g, or t
  misc_feature (200)..(253): n is a, c, g, or t
  misc_feature (275)..(320): n is a, c, g, or t
tnnnnnnnnnnnnngagnnnnnnnnnnnnnnnnnnnnnnnnnnnnnnnnnnnnnnaccctgggggatccgggnnnnnnnnnnnnnnnnnnnnnnnnnnnnnnnnnnctccaatttaaaaaagcnnnnnnnnnnnnnnnnnnnnnnnnnnnnnnnnnnnnnnnnnnnnnnnnnnnnnnnnnnnnnngaaagggggactccnnnnnnnnnnnnnnnnnnnnnnnnnnnnnnnnnnnnnnnnnnnnnnnnnnnnnnccgcaaaatttttaatatgacnnnnnnnnnnnnnnnnnnnnnnnnnnnnnnnnnnnnnnnnnnnnnnacc

SEQ ID NO: 12276 - DNA, 314 bp, Diabrotica virgifera
accaaaaatttattgagaacatttggattagtactagaaattaggtagtttactgatattaagaatagctgaatgctgctgagactgagtagctctggtaaacagtacgctgcggaatctgcggcctgacaatattcttcccagcatagacggcaccaatattcaaacatctgtaaatcaagaagctgtgcgaaaggccaatatactcctgctatgaaacgacgagagccacgaatgttctatagctgaacaggttgccagaagtaggagaatggaacaggactggaacaagaagcaggggggaaagctaattc

SEQ ID NO: 12277 - DNA, 447 bp, Diabrotica virgifera
  misc_feature (306)..(330): n is a, c, g, or t
ctccaaccgggtccgtaaatcgattttagttggagagattcttcttgaaatcttaattcttcaataacatttcagaaacattttatatggttaatgtagataacttttagatgaaacaaaagtaactatatatacaaccaaagatctacaatttacttaaacagaaaattcgtggaatagacgtgaatttgacacataagatccactgcttgtcttaaccgtttatatttttacaagaggtgttggtgggatagggttttctttcctaattttgctcctttatgaactaagaggaaaagacgttcnnnnnnnnnnnnnnnnnnnnnnnnnctgagtatttttttacctctccaaagttatgtgacacataatatatgtgtatgaccgatcgttttcaatcgttagcttgcatttcacaaataaatatagtgtgtatatcgactattt

SEQ ID NO: 12278 - DNA, 302 bp, Diabrotica virgifera
  misc_feature (37)..(37): n is a, c, g, or t
  misc_feature (50)..(50): n is a, c, g, or t
  misc_feature (54)..(54): n is a, c, g, or t
  misc_feature (59)..(59): n is a, c, g, or t
  misc_feature (61)..(61): n is a, c, g, or t
  misc_feature (66)..(66): n is a, c, g, or t
  misc_feature (70)..(71): n is a, c, g, or t
  misc_feature (86)..(87): n is a, c, g, or t
  misc_feature (89)..(89): n is a, c, g, or t
  misc_feature (96)..(96): n is a, c, g, or t
  misc_feature (98)..(98): n is a, c, g, or t
  misc_feature (106)..(106): n is a, c, g, or t
  misc_feature (117)..(118): n is a, c, g, or t
  misc_feature (125)..(125): n is a, c, g, or t
  misc_feature (129)..(131): n is a, c, g, or t
  misc_feature (133)..(133): n is a, c, g, or t
  misc_feature (139)..(139): n is a, c, g, or t
  misc_feature (148)..(148): n is a, c, g, or t
  misc_feature (159)..(159): n is a, c, g, or t
  misc_feature (165)..(165): n is a, c, g, or t
  misc_feature (171)..(171): n is a, c, g, or t
  misc_feature (175)..(175): n is a, c, g, or t
  misc_feature (179)..(179): n is a, c, g, or t
  misc_feature (184)..(184): n is a, c, g, or t
  misc_feature (186)..(187): n is a, c, g, or t
  misc_feature (190)..(191): n is a, c, g, or t
  misc_feature (208)..(208): n is a, c, g, or t
tcaactgggtccgcctgtcagtagtcatatggttgtntcacctttaaganatgnatgtntnagtanaagnnaaattaaggtgaaanngngaaaggntnattaaatnagttatggttnnttagatngtannnanatttanttggataantgtggtaattntagagntaatanatgnaaanagagntnnaannggagaaggaaggagggnttttattagatgaaaaaaaatcggtggcgggttcgctcgtcatcgaataacttggtgactctgaataacaataaggtgatcgcacgggctcgcc

SEQ ID NO: 12279 - DNA, 415 bp, Diabrotica virgifera
  misc_feature (16)..(43): n is a, c, g, or t
  misc_feature (46)..(392): n is a, c, g, or t
  misc_feature (396)..(413): n is a, c, g, or t
cctttacgtgtccggnnnnnnnnnnnnnnnnnnnnnnnnnnnnttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacnnnnnnnnnnnnnnnnnnat

SEQ ID NO: 12280 - DNA, 1014 bp, Diabrotica virgifera
  misc_feature (13)..(886): n is a, c, g, or t
  misc_feature (888)..(920): n is a, c, g, or t
  misc_feature (931)..(951): n is a, c, g, or t
ttaacatgttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnngggggggatcnnnnnnnnnnnnnnnnnnnnntacctttcactctacttaaataattttctggcccctcctttttgagacacaaattacacttcc

SEQ ID NO: 12281 - DNA, 1035 bp, Diabrotica virgifera
  misc_feature (13)..(758): n is a, c, g, or t
  misc_feature (760)..(925): n is a, c, g, or t
  misc_feature (929)..(1021): n is a, c, g, or t
ccttcctcttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcggaaatt

SEQ ID NO: 12282 - DNA, 87 bp, Diabrotica virgifera
cgacagtgataatgatgatgacaacatttttagggggggaagaagtgatcatgatattgttcccccaagagagaaggaaatgaatga

SEQ ID NO: 12283 - DNA, 611 bp, Diabrotica virgifera
  misc_feature (19)..(39): n is a, c, g, or t
  misc_feature (62)..(62): n is a, c, g, or t
  misc_feature (64)..(64): n is a, c, g, or t
  misc_feature (74)..(593): n is a, c, g, or t
ggtctaacagatggtccgnnnnnnnnnnnnnnnnnnnnngaaatttcttttttggaccttgngnatcagggatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgattaattcgaatgg

SEQ ID NO: 12284 - DNA, 923 bp, Diabrotica virgifera
  misc_feature (236)..(253): n is a, c, g, or t
  misc_feature (263)..(275): n is a, c, g, or t
  misc_feature (277)..(296): n is a, c, g, or t
  misc_feature (774)..(797): n is a, c, g, or t
  misc_feature (852)..(853): n is a, c, g, or t
  misc_feature (895)..(895): n is a, c, g, or t
  misc_feature (903)..(903): n is a, c, g, or t
ccgaaagtcagactacggacgtcatcaattgcgacgttgcctttttctcttcatggcttgtgaagtaaaggtggctatggtatatgccaataacgtatgacgtggatatattaatgttttgtgacacatgacagaggctcgaaacaaatgactgtgaatgaaaagccctatacactgtgacagttaaaaatccttaaacattattcgaagtgatttgttgatataaattacaatgnnnnnnnnnnnnnnnnnncaagtttaannnnnnnnnnnnncnnnnnnnnnnnnnnnnnnnngtgccgtgcaccacttgagtctaacttcaacccgtgagtagtgacccgtgaataacttcagtctttgagtaatgaactattactcacgggtaaagtaatgggtgttattgtctattcaaaaattgtgaatagtgagcatattattaaacggtcgtagaaaaaataatttaatgtactcataatgctgaaatttactaaaaatttcttaatagtgaccaaattccattcaaatcaacaattttctggtttgtttataccacttatagtagtttacatttattccaacagaggtcagatactttgttttctatcgcgaatagacgttgcatttttccctattctactttgcaaaatacatatagtgtcacaacacttgtttatacatttaacgcactgtccgtcaacgtgttaatatgagtaaaatacagttttaatatgaatttacgttatatttaaagttaaaaggttgttaaaaacnnnnnnnnnnnnnnnnnnnnnnnntgcacacatccatctgctcatcatcatcattctctttgccttatccctatgcggnngtggcttccctaattgcatttctccacataattctatcttgngtcatatncaatgtaatcccctttacca

SEQ ID NO: 12285 - DNA, 297 bp, Diabrotica virgifera
  misc_feature (14)..(50): n is a, c, g, or t
  misc_feature (54)..(208): n is a, c, g, or t
  misc_feature (212)..(291): n is a, c, g, or t
aaaagggggagaannnnnnnnnnnnnnnnnnnnnnnnnnnnnnnnnnnnntaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnnnnnnnnnnnttatag

SEQ ID NO: 12286 - DNA, 855 bp, Diabrotica virgifera
  misc_feature (22)..(85): n is a, c, g, or t
  misc_feature (87)..(195): n is a, c, g, or t
  misc_feature (206)..(374): n is a, c, g, or t
  misc_feature (392)..(456): n is a, c, g, or t
  misc_feature (466)..(516): n is a, c, g, or t
  misc_feature (545)..(557): n is a, c, g, or t
  misc_feature (559)..(574): n is a, c, g, or t
  misc_feature (583)..(849): n is a, c, g, or t
cggacgcgttgtgattaaaacnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcattaaaaaattgcnnnnnnnnnnnnnnnnnnnnnnnnnnnnnnnnnnnnnnnnnnnnnnnnnnnnnnnnnnnnnnnnntaaacatgannnnnnnnnnnnnnnnnnnnnnnnnnnnnnnnnnnnnnnnnnnnnnnnnnnacgcgtaattttgaccgtgctaaagtaannnnnnnnnnnnnannnnnnnnnnnnnnnntaatgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacag

SEQ ID NO: 12287 - DNA, 719 bp, Diabrotica virgifera
  misc_feature (17)..(37): n is a, c, g, or t
  misc_feature (84)..(101): n is a, c, g, or t
  misc_feature (423)..(452): n is a, c, g, or t
  misc_feature (611)..(645): n is a, c, g, or t
aagatttgaagattagnnnnnnnnnnnnnnnnnnnnntttaccttctgaggccctaggccgtcaatatttttggaaaattatcnnnnnnnnnnnnnnnnnncagcccctcaaatagcagtgaagagtgaatgatgtgtttggatttccaaaatgttaaagtgtttttatggattttaattttcaaagtaatactcatacagtcgaaaacgtcattgtggaaattaaatattgataaaacgaaaattatcaaagttacgaaatttccgtctataatttcatattcggataatcaaccgatttttcattcgggggatcctttgtttgatattattttatccactgaacattatggagagacatgggtcaaacagcccattcagtattattgttcagattgtaaaaacagaagaaatggaacaaannnnnnnnnnnnnnnnnnnnnnnnnnnnnncgatgaggttttagactgtgggaaacctgtcaattttacctattttgacaatttagcaggcgttgtaaacagaaacaaacaccccacagttcccgaaccgcaggcaattttatgctttaccaagaattatgggaactacaagagtgaaatggaagagtnnnnnnnnnnnnnnnnnnnnnnnnnnnnnnnnnnngtcaaaaaggagaagccgagatctattcaattatacaacacagatcggggaaattttggtgtatttaaaggaga

SEQ ID NO: 12288 - DNA, 510 bp, Diabrotica virgifera
gaaagttttagttcaggagaaaagaccctttatggcatagaagccaataataaggaaagatgttgacccaatgtggcgccgaagaggaagcaatgatgtttgtcccccccagtgctgcccgtacgtgaagaggtagccggcatacgaaccaacggggggagtactgtggggggcgatacatagttcatggaagcatgtctggcgaaaggctcgatagtggggtcaccatggtagttgatctttcagaaaagtgcggacccgactcgataggatgctgggaagagcgcggataaagcacctgtacgtgcagccccggcttatgactacgaacaggacgtaattgtgacagaaagatgggacagctattatggcgctgggtgaattaggctcggcctttgtgagaaggctccgcgcccccggacatgcatgaagagacgcatggccgcagccagaaagatagaagcaggccgaacaccaggagggacataggagtatgaaaaaggcgaggct

SEQ ID NO: 12289 - DNA, 877 bp, Diabrotica virgifera
  misc_feature (51)..(70): n is a, c, g, or t
  misc_feature (258)..(287): n is a, c, g, or t
  misc_feature (310)..(414): n is a, c, g, or t
  misc_feature (424)..(457): n is a, c, g, or t
  misc_feature (459)..(489): n is a, c, g, or t
  misc_feature (706)..(864): n is a, c, g, or t
acctctcttccgatattacaaatgattgatttaagaagagtgaatagaagnnnnnnnnnnnnnnnnnnnngtatcatagagatacaacatgttatttttataacagacaaactcattgtttgtaccttgcgtatcaaggattatcaatcctcacctatatatctcctacttttgtaattttccacaactcaaaaactccaccttgtattgtaacagaaatatgttaactactttttttgaactgacatgatatccacnnnnnnnnnnnnnnnnnnnnnnnnnnnnnntaaacttacatctatttattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgattaacnnnnnnnnnnnnnnnnnnnnnnnnnnnnnnnnnncnnnnnnnnnnnnnnnnnnnnnnnnnnnnnnncctctaattacaatataaatttacatcatctaaatttactactgatgatactattaatattctctatgagtatatttcgaaaatgtctctatgttaagtacatccaattcgacagcatgctttttcacctatataatataaaactggctattcgtatactatataatttctcacactacctctgatgatatttacatgaacacactatttacatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaattattaata

SEQ ID NO: 12290 - DNA, 530 bp, Diabrotica virgifera
  misc_feature (7)..(26): n is a, c, g, or t
  misc_feature (28)..(51): n is a, c, g, or t
  misc_feature (53)..(67): n is a, c, g, or t
  misc_feature (69)..(163): n is a, c, g, or t
  misc_feature (174)..(235): n is a, c, g, or t
  misc_feature (237)..(322): n is a, c, g, or t
  misc_feature (494)..(520): n is a, c, g, or t
agcgggnnnnnnnnnnnnnnnnnnnncnnnnnnnnnnnnnnnnnnnnnnnngnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagttttatcnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnaccttacggataacagcgtaattttattggagagttcacatcaataataccgattgcgacctcgatgttggattaaagtttataattgctgtaccacctatattattaagtctgttcgacttttagaattttacatgatctgagtttaaaccgctgtgagccaggttggttnnnnnnnnnnnnnnnnnnnnnnnnnnnggacgaaagg

SEQ ID NO: 12291 - DNA, 483 bp, Diabrotica virgifera
gtaatttatattacctaattttaaaaacattgtgagtgttattttgtagatatcattctttatgtgctattgcaagtacttcttacaaaatgtccgatttatttagtgtttcggaatttgagaaacatgctttggaagttttgcctaaagatattcgcgattactacagaagtggtgcaggaagacaggagtcattggccgataacagaaaagcattcttcaggtataaagtaagaccaagatatttaagaaatgtagaaaatatagatttatctacagtaattcttggagagaagatttccatgccaattgggattgctccgtctggcatgctaaaaatgggtcatccaatgggtgaaattgaagatgctgaagcagtagatatagatgccgatgaaaaacttttatttcccggaagacgtaagaatttattgttaggtggcatgacagtctatattgtatgagataggtatgaaaactgaa

SEQ ID NO: 12292 - DNA, 157 bp, Diabrotica virgifera
  misc_feature (2)..(36): n is a, c, g, or t
  misc_feature (42)..(135): n is a, c, g, or t
gnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggaaaaaccgcggaat

SEQ ID NO: 12293 - DNA, 411 bp, Diabrotica virgifera
  misc_feature (8)..(292): n is a, c, g, or t
  misc_feature (294)..(357): n is a, c, g, or t
  misc_feature (359)..(403): n is a, c, g, or t
catttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnngggggggg

SEQ ID NO: 12294 - DNA, 875 bp, Diabrotica virgifera
  misc_feature (729)..(746): n is a, c, g, or t
  misc_feature (751)..(768): n is a, c, g, or t
  misc_feature (820)..(837): n is a, c, g, or t
gtttatgctatttgtacaaattttaatttgttataatctctactggaaaaacgtttgctagtgaattaaccaacataaatttaaccaaaattgagcaatgtctcgctcaactaccagattcgatgttaaaaaagtgaattcagagttagtaacgttaacttacggtgctctcgttgcccaaatgatcaaagacttggacaatgtcgatgatgtctcaaagcagctcgaaagattaggttataacatgggcataagacttattgaagatttcctggcgaagactggtactggaagatgtttggatttaaaagatactgctgataaaattcagagtgcttttaaaatgtatctgggaatacaacctaacgtaaccaattggagtccttctggtgatgaattttcttttatgcttgattcaaatcctctgactgagctagtagaactacccgatgatttaaaatcgttaaagtattgtaatttgctttgtggagctattagaggtgcccttgagatggtacagttagatgttcagagttggattgtgcaggatcagttgaaaggtgaccaaaatacagaaataagagtaaaattcatcagaagattagaggatgctatgccagctggggaagattgattgctatacaatcgtttatttattaaatgtatatatcggtatatatttaataaacaaaatttgatattgtaagatatacaatttgtataattccnnnnnnnnnnnnnnnnnngaagnnnnnnnnnnnnnnnnnnatattgtttaaaatggatatgtttattagaaagtaaataacaaaactaaggnnnnnnnnnnnnnnnnnnttaggtatattatacccatatgaacataatacatacac

SEQ ID NO: 12295 - DNA, 938 bp, Diabrotica virgifera
  misc_feature (26)..(57): n is a, c, g, or t
  misc_feature (490)..(512): n is a, c, g, or t
  misc_feature (861)..(861): n is a, c, g, or t
ttcaatccatagtaaataactacatnnnnnnnnnnnnnnnnnnnnnnnnnnnnnnnnagcaataccaacggaaatcctccacgcaaaaattatactgagagagagagagaaatgtttgctgttggaaataattggaaaatacaagcatattaaattgaaaacaaataatgtaccaatgctatgtccaccaaccaaaacaatgaaacctgggaaaaaatagcgctgaatttcccagaactcccaagcagctgaacactgcatatataaacttaaaaagggtcactagccaaaaagtagcagaggaaaatgtaagtgtataaaactttcggttgatttagagctatatggattaattacattgcagattcaaaaatataatgagcagaaggttttggaccagttgaagagagaccaaactgcggacaaagtaggtaacttaaatttaaagctcttaacaccaggtcagtcgaattacactatttctgagtgnnnnnnnnnnnnnnnnnnnnnnnccaatgaaactaattttatgattggaactaacctagtgttgagacaatagaagtttagtatttgagggtgttaacgccaaagaggtgtaagtcatatttgtgaaatgatggaagtcttgctttataactttgataaatagacattttttcatcaggaaaagtggtgtaagtatttacagtaaaaacttacacaccactttttctctgaagaggtctgtgtatataatgtcaagattataaaatagggcttacatcatttcaagaatatgacttacaccactttgattttaaccctttcatttcttaatcagtaatgaactaatgaattgttttcagaaagacatacttngcacaggtggtggcacatttaggcctcgtctcacagatgtaggggcacaaatgttgagtttgattggcaatcaaatc

SEQ ID NO: 12296 - DNA, 506 bp, Diabrotica virgifera
  misc_feature (411)..(433): n is a, c, g, or t
  misc_feature (437)..(458): n is a, c, g, or t
atgtacaaattatgttacaaatttatatggtttataaataagcaggagcagacaaatgatgaccgaacaaggagttccacaaacaatgaacgaaaaaatggtggccctcaaaatgatgattaataataacataatgaaagaaaaaatgatgaaacgtgaaatgatgaacaaaaaaatgttggaagaccaaatgataaaccaacaattaatgatgacaagaaaaatgatggctcaaaaacaagtacccctaatgatgaaagaaattgaccagcaaatgatgaatgaaaaaatgatgaacaaagaaatgatgaaccaaaggatgatgtctgataaaatgaccaatatggagatgatgaaaccgatgctaatgaacgaaagaatgatgtaccaaactcgcatgaatactatggnnnnnnnnnnnnnnnnnnnnnnngaannnnnnnnnnnnnnnnnnnnnntcaatattattattcaaacgagtatattaaataaaacactatttttat

SEQ ID NO: 12297 - DNA, 734 bp, Diabrotica virgifera
  misc_feature (2)..(677): n is a, c, g, or t
  misc_feature (695)..(724): n is a, c, g, or t
  misc_feature (731)..(731): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcttacatttttttacnnnnnnnnnnnnnnnnnnnnnnnnnnnnnnaatattnaat

SEQ ID NO: 12298 - DNA, 54 bp, Diabrotica virgifera
  misc_feature (2)..(53): n is a, c, g, or t
cnnnnnnnnnnnnnnnnnnnnnnnnnnnnnnnnnnnnnnnnnnnnnnnnnnnnt

SEQ ID NO: 12299 - DNA, 460 bp, Diabrotica virgifera
  misc_feature (2)..(241): n is a, c, g, or t
  misc_feature (251)..(351): n is a, c, g, or t
  misc_feature (353)..(404): n is a, c, g, or t
  misc_feature (406)..(424): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaagacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnngnnnnnnnnnnnnnnnnnnnttagggataaacgcagaatttttttgggaagttcaa

SEQ ID NO: 12300 - DNA, 99 bp, Diabrotica virgifera
taacagcgtaattttattggagagctcaaatccataataaagattgcgaccccaatgttggattaaagtttataattggtgtagcaggtatattattaa

SEQ ID NO: 12301 - DNA, 945 bp, Diabrotica virgifera
  misc_feature (26)..(64): n is a, c, g, or t
  misc_feature (198)..(221): n is a, c, g, or t
cttcaaaataaaaattttctttgatnnnnnnnnnnnnnnnnnnnnnnnnnnnnnnnnnnnnnnnttcagaaatagaaattaataactttagaacaatagagtatttaatggttattctataaaatacttgactgatattttaaggttaaatatctgtatatgccgggtaataaagtgataagaagtgattttgtttannnnnnnnnnnnnnnnnnnnnnnnagttctgctaagaaagttacatcttgtccaatatgtaataaagactttccaacggatgaaattgagagtcatgccaatcggtgcatatttttgaattgtgttgaagatgatttagccaaacgtaaaagatctcctagtccagtgataagcgttagtcaaccaaaagtatcatttacacaaaaatctccaagaaatctatcacgtcagtttgtagaaaatccagttaaacatacagaaaactcagcgagttgtagtaatagtacatccataagttttaaaccaaatttgtcatttatcatacctcttgcaaaacagattcagccaaagactcttaatgatttttatggacaaaaccaggttttgggaaaagccacagtacttcgagatttgctggaaaaggcagaaataccaaacatgatcctctggggacctccaggttgtggtaaaacttcattatctggtataataagtgaaatttgcaaaatgaactctaaaaaacttcgatttagttctctttgtgcagcaagtgctggtgtaaaagaagtacaaaatataattacgatttccaaaaatgaaatgaaatttggtaagaaaacagtcttatttatggatgaaattcatgcatttaacaaaaacaacagggatacatgttgctcagtgttgaacggggtgaaattactctagtgggagctactacagagaatccatcattttccattaactc

SEQ ID NO: 12302 - DNA, 346 bp, Diabrotica virgifera
  misc_feature (132)..(152): n is a, c, g, or t
  misc_feature (168)..(184): n is a, c, g, or t
  misc_feature (224)..(251): n is a, c, g, or t
cttttcgtcactgtgaaccgttagatcccgccttaatacagtaattcgaaaaaaaatccctttgcatcactttcgtgaacaccccagtaaggttcaagtcgcttcaagtcgaaaagtggtcctcattcgttnnnnnnnnnnnnnnnnnnnnnttacaaaaatcaacannnnnnnnnnnnnnnnnttttttctctaaagttgaaagttttcgagttataagcaannnnnnnnnnnnnnnnnnnnnnnnnnnnggcgattttcaaggaataaaaggaccagcaaaaaatactattttttattgaattcattagtattattagatataaaaagtaatacttagtgaatt

SEQ ID NO: 12303 - DNA, 572 bp, Diabrotica virgifera
cccacgcgtccgattgattattatgctaatctgttattgtttaagcgtcaataacggttttgttttgttttacggttgccggttgccagtccgggacacggcgggtccataggtggtggataatggaatattctctatttgtaaagagaataggggttagatcccccccgaaccaaaactggcaaataagaaaaaaagtacaagaaaaagcggaaatctatttcgaaatatggcgctagtggccgggttgtgttggcgtatatttggtggttgggaggggggggcgcttgtcaaaatcgtgccatagcgcccaagaccctaaaaacgggcctgattgctatccctattgttgacaggccttgtaccttttgggcgtcctcgtttctttactgccacccgcatcttaattgtccccccacccccatcgctcatttgaatagtttggtgactaataagacattcattttctcttgaatattcccctccacggaatctaccctaattatctcttgaccaactacctcacccccccgcgtacttaactttgaattacaaattcatcattactttca

SEQ ID NO: 12304 - DNA, 942 bp, Diabrotica virgifera
  misc_feature (882)..(899): n is a, c, g, or t
caacaaaattttcatcagatttgttgattgcgctatctttaaatacctgctttaatatttcatactatataacgatgcttttagtgctaattttagaaatcggtttttattgaattatttgatattaaaagtattacatttgcactgttaatcttattgtgaaattcacgaatcactatacttgaaagggtataggatgtgtaatagcttttcaggagcgccctacacctaaagtggatatgacaccacaagaagcaccttctaaaaagagacttcaaaaatgtccttctacataagatgctttgcgacagatttcgttttagcaatacttcaaacttcaattgccacaaatgggactttcttaaataactgttacatgtactatgtagatattttatttgcattcggctgtcatatttatctaaaacttcattttatgactttgaagaagaatcgtactgtttttgatttctttaagacgtatggtttgcacttttaatattcagcttttcacccatactttcggacacgcgtcttcttcgttttaccaagtttcactactagtactataagtttacactgttctccgacgccttccgactcctaaccgtcatgtttctctgtttaaccatagacctggaaggatttctctatcctctagttctttttcaatttcctccctccagcttcttctcggccttcctctttttctcctcccccgtggtgtccatgccaaaatctgcttacggatcctgtcatctggcattctctgtacatggtcgtaccatattagttgttttgttttgatgccctcattattgtatgtgaactcccatcatttctcggatttcctttttgttatccgacccaagtttctccggnnnnnnnnnnnnnnnnnnccgttaccaatggaaaaaggggccccccgcaaattcagttttg

SEQ ID NO: 12305 - DNA, 247 bp, Diabrotica virgifera
taattgtgtgtgtattgggtagtattgcttttttaactatacttgaacgtagagcattaggtaataaccagattcggtcgggggctaattcaagtgttttctttgccatatgtcgtcctaaggaacggtgcgcagaggcgggctaatccgcaacgggacaaatagccgccacctcaaatcgcacacgtactaaattatggactccctgcgacgtggagaatgtagcttctactgcactgacaacgtc

SEQ ID NO: 12306 - DNA, 904 bp, Diabrotica virgifera
  misc_feature (203)..(276): n is a, c, g, or t
  misc_feature (618)..(636): n is a, c, g, or t
  misc_feature (739)..(784): n is a, c, g, or t
gtattataatggaagcaagattctgcaggtcataaaaatctgaatggttcagtctacgtacttctaaggttttggtttgtgtcttgctaatcaaaagtgcccattcttcgatcgtgaatatctttttgtgcttacgagcatgctcaattgttgcatgaattgagtcagcttccaaataagaatggccagattccataaacttnnnnnnnnnnnnnnnnnnnnnnnnnnnnnnnnnnnnnnnnnnnnnnnnnnnnnnnnnnnnnnnnnnnnnnnnnntttgcccaccacatgtgtctgagaaagtggctacatgttcaacggtttttggcaaattatacgggtattttaaaaggcatgtacctatctctgaggcacctttggaaccctgggtttcatcccacacatagcagtgaccattttgatcaaatgagtcataagtggtaaaattaaaaactgaaagttttcgtttgtaataaatctgaggatctgcagaaaatggcactgtcaaaattgcttccaagtcaaacgtgatcgctctataattgacttcttttacttcaatagctttcttcttgtctgcttttttcattgctatagcttcttcttccctttgcttannnnnnnnnnnnnnnnnnnccaaagaaaatttgtctgaggcattatataaatattgcatgtataatattgatcctttttgagaatgtggaaggacagctgtggaagagcacaaatattgcannnnnnnnnnnnnnnnnnnnnnnnnnnnnnnnnnnnnnnnnnnnnnagcactaatattgtatatccaaaacatactatgttttgtgcacttccaacggacataatatatctgtgcaagtcgggttttagtacaaatgggaaatactatattttggcaaggcggttt

SEQ ID NO: 12307 - DNA, 541 bp, Diabrotica virgifera
  misc_feature (2)..(287): n is a, c, g, or t
  misc_feature (290)..(396): n is a, c, g, or t
  misc_feature (402)..(446): n is a, c, g, or t
  misc_feature (452)..(469): n is a, c, g, or t
  misc_feature (472)..(506): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnntttccnnnnnnnnnnnnnnnnnnatnnnnnnnnnnnnnnnnnnnnnnnnnnnnnnnnnnnctcccttaggggaataaaagcggggaatttttttt

SEQ ID NO: 12308 - DNA, 110 bp, Diabrotica virgifera
  misc_feature (37)..(63): n is a, c, g, or t
aggtgaatgttatagcgtttttcaaagtgtaaggtgnnnnnnnnnnnnnnnnnnnnnnnnnnngcaatcactatgggtaatgtgtttgcaaatttattcaaaggcctctt

SEQ ID NO: 12309 - DNA, 815 bp, Diabrotica virgifera
gttgctcaaattattctcatacctaagccagggaaaaataaaactcaggtgacttcatacagaccaataagcctgctacctgttctatcaaaaatcttggaaaaacttctccttaaacaattatccccagttatagaagaaaggaaactaattccccaacaccaatttgggttcagaacacaacacggaacgatagaacaggtacatagactggtaaaacacatcagaagtgatttagaaaataaaaggtattgttctgctgaattcctggacattggtcaggccttcgacaaggtatggtatgctggtatgctctttaaactaaagaaaaaccttccccatcctttttatcaaatcctaaaaagctatatttccaaccgacatttcctagtcaagcaggataatgaatacacaagcctaagaccaataaaagccggagtaccacaaggaagtgtcttgggaccgatattgtacttgctctacactgctgacctacccacaagtaacagaacaacgtgtgcaacttttgctgatgacactgctgtactagcctctcaccatgatccaaatacagcatccggaatccttcagaaagaccttaataatatacaaagatggcttaaaaaatggaagataaaggcaaatgagagtaaatccatccatgtaaccttcaccatgaaaagacaaacatgtccatctgtaacactaaatgaaacgcaactcccacaaaccgatactgtcaagtacctaggaatccatctttataggagattaacttggcaaagcacatttttacaaaaagaaaacaactagga

SEQ ID NO: 12310 - DNA, 449 bp, Diabrotica virgifera
  misc_feature (25)..(25): n is a, c, g, or t
  misc_feature (88)..(109): n is a, c, g, or t
  misc_feature (408)..(431): n is a, c, g, or t
caatataattcaaaatattgctatntccttgtctgatagacaattaaatccaatcataccattaaacggacaaacacatgtcattggnnnnnnnnnnnnnnnnnnnnnncaaaaaattgtaattcttggaccacggctaattccgactggaggaagaggagctagtccacaaccttcaccagaatactcccaaaggtgaataaaaatcatgtatctgctcaagatgaatctgaaaactatgttttcctgctgaggaagtgccagttctctaaataaatacaccaattattgaaaaagaaatcgctttaatacatctccctttagatgtaaaataataaatacctacaaaatttacatctcttgacatttgtgactggtatccaataaaaatgatgttttaccttatcnnnnnnnnnnnnnnnnnnnnnnnncgcacacaaatgactgaa

SEQ ID NO: 12311 - DNA, 137 bp, Diabrotica virgifera
  misc_feature (4)..(78): n is a, c, g, or t
  misc_feature (80)..(136): n is a, c, g, or t
gggnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnc

SEQ ID NO: 12312 - DNA, 187 bp, Diabrotica virgifera
  misc_feature (2)..(97): n is a, c, g, or t
  misc_feature (106)..(173): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggatgannnnnnnnnnnnnnnnnnnnnnnnnnnnnnnnnnnnnnnnnnnnnnnnnnnnnnnnnnnnnnnnnnnnacgagagaccctat

SEQ ID NO: 12313 - DNA, 427 bp, Diabrotica virgifera
  misc_feature (185)..(200): n is a, c, g, or t
cggatgagaatattgaagcaaactgccaagatgtgggcaataatttcaacgacataaacctaatagaggaacttttaagatgactttatgtctatggatttcgaaaacctcttgctctcctacggacacccgtctctccttgtgtaaaggcacaccatggtattgctcatgctcagtcctgtacnnnnnnnnnnnnnnnnttctccatctctattttacaacaaattgtgacgtcagagggggagagccaagctcttatattggcacccactcttgaattggctccccagatccaaaaagtagtagatgtcctaggatatttcatgtctgcgcattgacatgcatgaattgggggcaccaatgtacgataatatatgccaaaacttgaaactggcgcacatgttgctgccggcacccctcgccaaag

SEQ ID NO: 12314 - DNA, 1084 bp, Diabrotica virgifera
  misc_feature (139)..(156): n is a, c, g, or t
  misc_feature (442)..(442): n is a, c, g, or t
  misc_feature (972)..(1019): n is a, c, g, or t
ctgatggtggtgtcgtctgtattgatgagtttgacaaaatgagagaagatgatagagtagctattcatgaagctatggaacaacaaacaatttctattgccaaagcaggcatcacgactactttaaattcaagatgctnnnnnnnnnnnnnnnnnnacagtatttttggtcggtgggatgatacgaagggtgaagaaaatatcgactttttgccaaccattctttcacgttttgatatgattttcattgttaaggatgaacacgataaacaacgtgacatgactcttgcaaagcatatcatgggcgtacatatgagtgcaggagaaattacaaaatcttcaaaagatggagaaatgtcattggagttcatcaggaaatatataaactactgtagaacgcgttgcggtccgagactgaatccagatgcagccgaaaagcttanaaggcgctacgtcatgatgagatctggagccagtcaacacgagaaggaagcggataaaaaaagttcattccgattacagtgagaccactggacgctgtaattcgaatatctgaaagtttggccaaaatgcaattgccaccgtttgttaccaagacgcatgtagatgaagctcttccactgtttcaagtctctacgttggatgctgcaatgaaggaaagtttacttggggccaagggtttttccatgaggaagaacccacaaggttgtttcttttggaaaacactggaagcccgggttggtttttggaaacggggattcccaccgaaattttttccgagattttggaacccccaaatcccaaaaagaacagagataaagttttttttgctttgatatacccgggccctttgcatatttttctgaagaggggtgttttccctctttcgtataaaaaacgggttttccctctttcttctccacatattctttttcagacattggaggtgttccccgcaaatcttctttctccnnnnnnnnnnnnnnnnnnnnnnnnnnnnnnnnnnnnnnnnnnnnnnnncccccccccctgagggcaaccttctcctccgcccttcccccttcatccccctctccccccccccc

SEQ ID NO: 12315 - DNA, 681 bp, Diabrotica virgifera
  misc_feature (23)..(23): n is a, c, g, or t
  misc_feature (25)..(25): n is a, c, g, or t
  misc_feature (28)..(28): n is a, c, g, or t
  misc_feature (54)..(71): n is a, c, g, or t
  misc_feature (149)..(191): n is a, c, g, or t
  misc_feature (209)..(257): n is a, c, g, or t
  misc_feature (278)..(290): n is a, c, g, or t
  misc_feature (293)..(305): n is a, c, g, or t
  misc_feature (359)..(390): n is a, c, g, or t
  misc_feature (400)..(508): n is a, c, g, or t
  misc_feature (510)..(539): n is a, c, g, or t
  misc_feature (566)..(588): n is a, c, g, or t
  misc_feature (625)..(643): n is a, c, g, or t
cttaagggcgcacgcgcccgaananggnaagaggagagccttttaaaggaggannnnnnnnnnnnnnnnnnagagaaggagagaaaaaaagaagagagagacgaaaaagaaagtttattatatgatttattaattttttgtatcttgcnnnnnnnnnnnnnnnnnnnnnnnnnnnnnnnnnnnnnnnnnnngagtttaggagagttagnnnnnnnnnnnnnnnnnnnnnnnnnnnnnnnnnnnnnnnnnnnnnnnnnggagatgaaatgataataggnnnnnnnnnnnnncgnnnnnnnnnnnnnagataagttgaaatatgatttaatgaacaaatatattgtatgatttaaatatgnnnnnnnnnnnnnnnnnnnnnnnnnnnnnnnnggggatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnntgagattttttctaggttatattatgnnnnnnnnnnnnnnnnnnnnnnnccaatgtttgggaaaaggaatggtaaattaattaggnnnnnnnnnnnnnnnnnnngtttattatatgggaaaaatataatataaaggggtttt

SEQ ID NO: 12316 - DNA, 203 bp, Diabrotica virgifera
  misc_feature (7)..(44): n is a, c, g, or t
  misc_feature (64)..(77): n is a, c, g, or t
  misc_feature (80)..(98): n is a, c, g, or t
  misc_feature (113)..(113): n is a, c, g, or t
  misc_feature (117)..(118): n is a, c, g, or t
  misc_feature (132)..(132): n is a, c, g, or t
  misc_feature (159)..(159): n is a, c, g, or t
  misc_feature (173)..(197): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnaagtctgttcgactnttannattttacatgatcntgagttaaacccggtgtgagccaggtntggtttctatcttnnnnnnnnnnnnnnnnnnnnnnnnngaaagg

SEQ ID NO: 12317 - DNA, 410 bp, Diabrotica virgifera
  misc_feature (313)..(334): n is a, c, g, or t
ctaattatgtctctctgcgaggctgaaaaaacgtttgtgctacatggactagaggaaaattttatctcattatttcttagttccttgtggtctagcgactctcggagcgttaccgtctactcgccacccgcggcttggccagtggtgcggggtttgctttgtactcgcgcctcgacgctgcagagcctgatatccgcatagcaaggcgcgccgagggaatactcctccaaatctcccgaatctcccaaaaaacctacccaccaaggcccaccgcaccaattatgcaaccctatattttaacaaaacatcaagnnnnnnnnnnnnnnnnnnnnnnaaaacctaataacgacggtatgttctgtgacatagcgcccagcccgcttcaggaccctacaagttgaaggattttg

SEQ ID NO: 12318 - DNA, 63 bp, Diabrotica virgifera
atatatctaaaacacaataagcgtgtataccgttagtaatcaaataaaaatccggttattaat

SEQ ID NO: 12319 - DNA, 176 bp, Diabrotica virgifera
  misc_feature (2)..(27): n is a, c, g, or t
  misc_feature (72)..(89): n is a, c, g, or t
gnnnnnnnnnnnnnnnnnnnnnnnnnngttcggaacatttttttcccctgtttatcaaaagaattgcctttnnnnnnnnnnnnnnnnnngcttcgactggcccaatgagtaaatgagaatgggccggggtattttggccgaggctcacgggaactagttccttacttttttttttt

SEQ ID NO: 12320 - DNA, 404 bp, Diabrotica virgifera
  misc_feature (3)..(17): n is a, c, g, or t
  misc_feature (19)..(37): n is a, c, g, or t
  misc_feature (39)..(66): n is a, c, g, or t
  misc_feature (92)..(109): n is a, c, g, or t
  misc_feature (137)..(157): n is a, c, g, or t
  misc_feature (177)..(226): n is a, c, g, or t
  misc_feature (229)..(256): n is a, c, g, or t
  misc_feature (258)..(396): n is a, c, g, or t
ggnnnnnnnnnnnnnnncnnnnnnnnnnnnnnnnnnngnnnnnnnnnnnnnnnnnnnnnnnnnnnntatatagtctcgcctggccactgaannnnnnnnnnnnnnnnnnattttgaccgggctaagggaacataatnnnnnnnnnnnnnnnnnnnnncttgaattaagggttgatgnnnnnnnnnnnnnnnnnnnnnnnnnnnnnnnnnnnnnnnnnnnnnnnnnngcnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 12321 - DNA, 144 bp, Diabrotica virgifera
  misc_feature (2)..(80): n is a, c, g, or t
  misc_feature (84)..(140): n is a, c, g, or t
annnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnnnnnnnnnnnnnnnnnnnnnnnnnnnnnnnnnnnnnnntccc

SEQ ID NO: 12322 - DNA, 385 bp, Diabrotica virgifera
gtacactttcgctttttttaacaccaatttgcctatttacctactctagtcaaaatgaagtgttacgtcattctcgtaagttttttgagtgtgttcgtgttcgtgagttcggcaccattcttccaagcatcatcaggaggtaattctggtacccaactacagtccgccgccgctgacgagagcaacttgatcgcccgaagatcggcgaggataaccagataagcagctgcggatcaagcgccggcagaatcagtaccacaacctgcggaagatctttctgatctcgatgatgatgatttatatcggaataaaaggtttttgccctttggaagaggatagatcttcctcggctacggaaattaaggattcaaatttattaatactt

SEQ ID NO: 12323 - DNA, 794 bp, Diabrotica virgifera
  misc_feature (2)..(585): n is a, c, g, or t
  misc_feature (587)..(703): n is a, c, g, or t
  misc_feature (705)..(750): n is a, c, g, or t
  misc_feature (755)..(793): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnctggnnnnnnnnnnnnnnnnnnnnnnnnnnnnnnnnnnnnnnnc

SEQ ID NO: 12324 - DNA, 923 bp, Diabrotica virgifera
  misc_feature (89)..(111): n is a, c, g, or t
gtaaatttgttatattctgatcctaagtaaaatcttccaaaatcatttcaaatacaacgtatttttctctccccgtttctattttttcnnnnnnnnnnnnnnnnnnnnnnnaatctaaaatgatacatgaatacaaaggtttgacaattttataacaccgaaggtgtaggatatttcgaaggtacaataagttagaattattttgacgctacgcttccaacaaggtatattcttctgaaaaaatccaaatctaaaaatgtagactctttttgttagaataataaagcgaaagcttgcgaaatagatacaaaatgtattggtaaatttgtaatactctgatctaaagtaaaatctttcaaaaacatttcaaatacaacgcatatacaaattttcagttgcccctttcttatttatacatactatatcaagaaaaaactagaaaaaatctgatgatacattaatacaaaggtttgacaattttataacaccgaagctgtagattatttcgaaggtacaataaggtagaattatttcgacggtatgtttccaaaaaggtatattcttctaaaaaatgcaaatcccaaaatttagaccattattatttgaataatacagcgaacggttgcaaaatttataaaatattgattggtaaatttgtgatattctgatcaaaagtaaaatcttccaaacatttcaaacactacgtatatattttcaactgcccatttcttttatgtactatatcaagaaaaaaccaaaaatctaaaatggtacactaatacaaaggtttgacaattttataacaccgaaggtgtaggttatttcgaagggacaataaggcaagatttatttcgacgctactttccaaaaaggtataattcttctgaaaaaatcaaaatcccaaaatttaaactcctttattt

SEQ ID NO: 12325 - DNA, 905 bp, Diabrotica virgifera
attttattcaaaacaaaatcttcaaagcttgtattttcaaagtttcgcatctgcaaaagtggattacaacgaaaacgttttcgactatataaagaaaattgagaaaagagagggagatgacatgagtataaccgatatacatttacgagactatctttcgaccactgctaagcctaaaaacgaagtagaagaaatttttgatagtgtactatatcgtgacccctatcctgaatgtatttgtggaggggaaggattcagagaggggataaatataatggataaagatggcaacatccccgaaaaagatctgattcatttctctttgggacagttggagtataggtttatctgtggtaaacatttacaagacttcataacattaccaccagattttaagaacttttatcagcagcagttagacacaaacttggattccgattccagtacagataaagaggatgacgaagatgacgacgaacctgaaacttgctgccactatgctaacagctacgtgagtgccaccaataacctgcttacacctagtacgcatgatcgaacgccctcggtgcgtgaggaaatgactctgccaaatgaaggagcaagaaatcaatcgtttccagggtgcatccgtgttttcaagccacagatcaacaaagttaagcgtaagaagcagagttttagatcgaatgataatgcttttagactatatgtacaacattcttcgatggacaataacaacgcaagcagttccgatagtcgaacccacgaacagagcgattttggtatcgattccaataatagaattcatggacagagcgataatagcagcgattccaataaacgaacccatggtcagagcgatagtagcagcgattctaataaacgaacccacgatcagagctatg

SEQ ID NO: 12326 - DNA, 902 bp, Diabrotica virgifera
  misc_feature (67)..(148): n is a, c, g, or t
  misc_feature (195)..(212): n is a, c, g, or t
  misc_feature (309)..(334): n is a, c, g, or t
ataaactgatgtttatccgaagtaataaccagggtattatttataacgcctctctgataacacgacnnnnnnnnnnnnnnnnnnnnnnnnnnnnnnnnnnnnnnnnnnnnnnnnnnnnnnnnnnnnnnnnnnnnnnnnnnnnnnnnnnaacattttgtattttgacaacgacatccgacgtggaagtagaaaccnnnnnnnnnnnnnnnnnncaagtaaattgtggcttatttcctcattagaatagttaattacaaaaaagccacaaagaaatagatttttcacaaacaaataagtatttagtattcnnnnnnnnnnnnnnnnnnnnnnnnnnctttaatgtcctactggtacattatttgacaaataatgacatttcgaagtctgttaagtacgatataacgcccttgggcattaaatttaaataacgacttagatactgtcaagttgacaaatatcaacctaagtaaaactatggttaccacaattatgttactactgttactggtaaatgtacttatttaaaaactaatcaattcaaaattcattcaaatttttcgcatataaagaataatttagtcagacattaaacgttgaaggcaccacaggtattataataatgacgctttcagtcaacgtatatccctcaggcccttgttaaaaacaccattgacctcaagcgttattatccttataatacccttggtaccttaataactgtaacataagattataccttaacctcttgttttcgatttctgatgtttttatttatttacattgaatattaatctgttttgttgtataatctacttcacaataattatgtgatatatttgacttaaaatgaattcaaaaatttttttgcagttgggcaacaatgtcaacttagatctccgatg

SEQ ID NO: 12327 - DNA, 240 bp, Diabrotica virgifera
  misc_feature (2)..(23): n is a, c, g, or t
  misc_feature (48)..(85): n is a, c, g, or t
  misc_feature (105)..(118): n is a, c, g, or t
  misc_feature (121)..(143): n is a, c, g, or t
  misc_feature (151)..(173): n is a, c, g, or t
  misc_feature (203)..(234): n is a, c, g, or t
tnnnnnnnnnnnnnnnnnnnnnnaataaattaccttagggataacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12328 - DNA, 203 bp, Diabrotica virgifera
  misc_feature (14)..(37): n is a, c, g, or t
cggtaggataatcnnnnnnnnnnnnnnnnnnnnnnnntatgcaagggctgaacgaaggtggaagtaccgttatctcctgtagaaagaaggggattttaaaaaagaccgctggaatctttctgaacgcgggaaaaactataacgagttcggaacaagtcgcacgctacttttctcgattgccaactcaactccaaactccaaga

SEQ ID NO: 12329 - DNA, 564 bp, Diabrotica virgifera
cattaagcgtccggtgagatgatttcgaagatcaccctgcccttcttgaaaggcatagtcaattgagcgctagtgagaacatattagctccagaagagaggagtatttatgacagacgcctatatcgatatgtgagttgtagagcgagttatcagaagaaaataattattaatggagtatctccgaacgtacgaagacaaaaatatacgaatttttaatgaataaaagagcacagaaggctgaatatcgtatcatactctgaatcgcacttgcggatatcaaaagatctcaaagttttcaatgtaatgtgttataactcgaatagcctgatgattatgagtatgtcttactacctattcggccttacatgtttctaggcttgaactaaaaactgaactttcattttaatctaatgtgcagaccccgaggtcgttcaaccattctctgtacgtgtacggtggcgattgttcaaactgatgcccaattatcaccaatccgtgtgcttctctaattaaaccaaaaccttagaaaagtgatgcttcctgttgatacccaatacgtagc

SEQ ID NO: 12330 - DNA, 849 bp, Diabrotica virgifera
tcaaaatcaaaatggcagcggtagtcaaaatcaacaaggttccggtaataacggtcaacaggaaacacaaaaaccaaataattcaggcaacactggattagttacaaacaaaaagtgtgttaaagaaggttttgctaaagacgatggtgattgtaagaaattctatagatgtgttaacaatggtaaaggcggatacgacaagtatgaatttacttgccccgaaggaactgtttgggatgaaacaaatctttcgtgtaactggccatttgcagttacaggaaaatgtggacaaccaaattccaataacaataaccaaaacagtagtaaccaacaaaatggttccaacaatagcaacaaccaacaaaatataggcactaattccgaccaagataataaccaacaaagtaacggatcaaatgagaacaatcaacaaaatgcaggagacggatcaagtcaacaaaataatcaaggaggaaatggatctaataataataatcaacaaaatacgggtgataattctagtcaacaaaataatcagcaaggtggtggaacgaatagtaataaccaacaaaacactggtaacggatcaaatcagaacaatcagcaaagtactggttcaaatcaaaacactcaacaaaataccggaaataattcgaatcagcagaacaatcaaggtggcacatccaatggtaataaccaacagaatgtaggtgatggatcaaatcagaacaatactcagcgaaataatggatcaaatcaagacaatcaacaaaatgccggaaataattccaatcatcaaaataattcaggcggggaatccagtaataataaccaaccaaaaaaactcaa

SEQ ID NO: 12331 - DNA, 483 bp, Diabrotica virgifera
aggcgtcccctaataaaaatatggtgtggatttaaattattagaaattatgttcaaaagtatattaaaaagaaatatgatgaaatctatggagatatatgaggagtttgtgagttgtaaatataaatgaatgtataggttgggaaaaaagaagttgttgggagaacatatgacaatgtgtgattcgagagataagaatgatgagttttagagtttcataataggagggctggcagcgatcatcataccgacattcatacacctgcttaatgccagaaccttcaacctatacatttgaagaatgtaatgatcaaaattgatctgcgatatggggtgctaaaacgtaaagttaaaacacggaataaatacaaaacttagtgagctaaaaaggactccatttaacatgaatgatgaaatggaagaaggtacttgtgattaggaccgactttatatgagtaacaatgaagaactacttaaacgacaa

SEQ ID NO: 12332 - DNA, 218 bp, Diabrotica virgifera; identical to SEQ ID NO: 7300
  misc_feature (6)..(28): n is a, c, g, or t

SEQ ID NO: 12333 - DNA, 752 bp, Diabrotica virgifera
  misc_feature (12)..(74): n is a, c, g, or t
  misc_feature (82)..(108): n is a, c, g, or t
gattcggggtcnnnnnnnnnnnnnnnnnnnnnnnnnnnnnnnnnnnnnnnnnnnnnnnnnnnnnnnnnnnnnnncccccaannnnnnnnnnnnnnnnnnnnnnnnnnncgaaagttaattttaaaacttaaaactatgggccccccccgccggccggggaggaaacccccctgaacaaagggtgatcttggacggaaaattggcggggttctttggggggggccagcgggggcctttcgggggaaaattcttccccaaaattgcttacgcctcccattgcccccccgggaggaacaaaggggggggggattcggggaggaaacaattctccccccggaatatgtcaaaaaaaccccggtttctttacgcccccggcatctcccccccccaaaccaaaccccctatcgggactctttcggagaacccttcccataatggggggggcttcaaaagacaaaaacctgggaacccgcccttcgccgttcactatcaaatcaaaaactccctcttcttcttccccggggaagggggattccccccccaacctcccaaatatgggtccccctaaccccccccaaccgacggctctagaatacgacgtttcgggcaaaacttcgggggctaaaaacccgggggtcccgcaaaaggggcccgtcctatcgccgaagcccattccttccttgcacaatccaaaatctgctatttttacgaacccttccgtacccaacaaaaaattgtctagtttcaagccc

SEQ ID NO: 12334 - DNA, 275 bp, Diabrotica virgifera
  misc_feature (8)..(28): n is a, c, g, or t
  misc_feature (40)..(40): n is a, c, g, or t
  misc_feature (50)..(123): n is a, c, g, or t
  misc_feature (132)..(230): n is a, c, g, or t
  misc_feature (232)..(273): n is a, c, g, or t
ataatcannnnnnnnnnnnnnnnnnnnnggaatgaaaggngttggatgannnnnnnnnnnnnnnnnnnnnnnnnnnnnnnnnnnnnnnnnnnnnnnnnnnnnnnnnnnnnnnnnnnnnnnnnncgagaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnncc

SEQ ID NO: 12335 - DNA, 989 bp, Diabrotica virgifera
  misc_feature (834)..(834): n is a, c, g, or t
  misc_feature (853)..(853): n is a, c, g, or t
  misc_feature (890)..(890): n is a, c, g, or t
  misc_feature (895)..(895): n is a, c, g, or t
  misc_feature (910)..(910): n is a, c, g, or t
  misc_feature (965)..(965): n is a, c, g, or t
gcggattatatctacaaacacaattacggaatgccagatgaatcggccagggaaaatcgtgcaattcatctttacaatttggcaaatcgaaggaaatttaatgtaagcggggaattggatgtactaacaaagtggaacggtcaagaatactttctaactgccgtccactcaaaaagaattgttaagctctggacggactacgaggcccaggataaagggtacaagcagcattcacgactggaattgagtcccacacactggatcgaatacaacctcaatgttttgaacaagagtctggatgaaacgtttgacgctcagaaagttgtcattaacgtgatctacccccggcgcagcttcacggctcagggtttctacaatataagtgattcaattgtatcaactgacgtgtctctggtgtatgacaaggacaataaaacagttcaagcgggactggattggcgacgtgcctcgcttcatcgcgaacaattattacttcaaattaagcatccttcttttgaaagggacatcacaatgagtagcgaatatggatacgataactcgtcaatcgatgggcaattggtcggtggtgtattcattaaatccagatcaaaagctgactctatgcggaaaagtaaacgataattctaactcagtgacctataactacacgtacaatggtttgggcggaacacattgcgacgaatttaaatttaaattccacgggcgatttttactggaatcccaatgctttgggcaccgaacatataacgaattaccagcgatcatatttaccttcatctgtatcggaaacactggccaaaattaacctgctanataaacgaatttgaaattngaagagggataacattgcaaagcggaaaatcctattntctgngcaaggtacaatggnagaatatccctgttatactgcaaacatgtcagccatctacgatactaatgacacncaaaaggggagttttacattaatt

SEQ ID NO: 12336 - DNA, 688 bp, Diabrotica virgifera
gggcggtcttcagggtcagcgaggtaatcctctggacagatcggacgaaggtattttcgtatcgaaaatcaactctgtgggggcagcaaggcgagatggaagactcaaagctggcatgagattattagaagttaatggaaagtcattattaggtgcaactcatcaagaagctgttaatgctttaagagcttgtggaaacatgattcacatggtagtttgcaaaggatatgataagggtgatatagacagagcagtccatgagggcagattgacaagaggagggtctgtcagcagtcgttcgcagagcgtcagctctttagacgtaccagaagacgacctacaggacttgaaagtaaaatctgaattgcttcagttagaaaaggatgaagttgagaagcgattacagccgatccatcaagaagaagaggaattttctttagtagaagcaaaaccaccttctcctgcggataaggttttagacgtggtaagagcagtagagactctagcacacggtccgatggaaaattcagttcctccgaagtctcctaattcggaactaaaaactactacgatagttatgagcaaacatacgctagcacctcaacctaccactgacgagctaatgcatgtctctacgctaccgaaaacgacacagcctaaagtggatgtggaaacagaaagcaaaagt

SEQ ID NO: 12337 - DNA, 927 bp, Diabrotica virgifera
  misc_feature (223)..(237): n is a, c, g, or t
  misc_feature (240)..(254): n is a, c, g, or t
  misc_feature (897)..(926): n is a, c, g, or t
atttacctgtatacataattcactagaacagggcttcccaaacttattcgtactgggacgcctttgggactttgctattttgttgcgacgcccctcaacccaacccccaatgatacttaccaattttagtactagcctagtaacaggttacagttgtgacaaaaacacaatttgaacatttataatttttactagaaattaagaatgaaatcaaagcataggnnnnnnnnnnnnnnnggnnnnnnnnnnnnnnnactggctggttaatgtgagggatgtgcttgcttttttgagcacagcttatgaaaccggggctccagtttggaaattaccactcacatttctttttctaagtatatgtttgacctgtacttgcttttaattactgaaaatgcagaaaagcgcgtttcgcataagtacaaagtcacaaatagcaataaaacctttaatgcagcagggctgatggcatgatattcataagaaactgagctccaaaattcaaacaggttttctgaattcaaaattcagtgtggacgactggaaagggtttctgacctagtgatattactccagatcttcgggaaaatatttctcaaagtgttcgctcaatgataacatgtgttgtgtaaacatattttttaaagagggatcgaggattactatcgatttttcgtgtagaataccttgtaaagcagggaaacagtcaattttttgatcttctaattttctcttccataagaaaaacttcttctaaaacccagtaattttatctgccaattgcaggatatgagtattgtttccctgcaaaaacttgttaagattgtttaatttgttaaatatgtcacagaggtatgctaattttattataaactctgaattaataaagttttgggcatnnnnnnnnnnnnnnnnnnnnnnnnnnnnnnt

SEQ ID NO: 12338 - DNA, 72 bp, Diabrotica virgifera
  misc_feature (3)..(62): n is a, c, g, or t
ggnnnnnnnnnnnnnnnnnnnnnnnnnnnnnnnnnnnnnnnnnnnnnnnnnnnnnnnnnnnnatccattttt

SEQ ID NO: 12339 - DNA, 186 bp, Diabrotica virgifera
  misc_feature (4)..(177): n is a, c, g, or t
  misc_feature (180)..(180): n is a, c, g, or t
tgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnggtgat

SEQ ID NO: 12340 - DNA, 912 bp, Diabrotica virgifera
  misc_feature (843)..(843): n is a, c, g, or t
  misc_feature (879)..(879): n is a, c, g, or t
acgggtcaaaatactatatatacgggacacagaccaacctgaacagtccattgaactggcaagaaccacgattttttatcgagcagggaaccatgttgccctttgagcactcctaacatataaattaatcctctaacatcgacttggagttgctataaatattatagattaaaaatgtaaaccatatttctcgatgtcaccattttcataaggttgctagttacatgtactaggcagaacgcactgaagatgatctgatctagatcgaaaacgttttgcagatccttttggatgacttttaatagtttttaataaactttttataccattgtacaaatgaagttttttacttctgtatgattttataatataagtataaatataagtacaaaaatatatttaaataacctgagggctgatctttgtctcatagataaaataaaactgaaagttgctgtactaaaagggaaacaagcacatattggcaaaatatatggtaactgtttacatttgcgaagattactatgaatctgcattatttttgacaaaaagttgtaaaaattgggaaactacaaagataacaatttttaaactaactacaattcattcaacttggtaaaatgaatcccagttttttggtcactaaacaaaatattctgcatgtgtacaatattgccacaatatgggatttaaaggtgacaataatagaaagaaaaataccaacactgtatcacaaaaaaaaacatgagaagctgtaagatcctaaaatcaaaaaacttcttatgttggaaccaaaattctagtgacaacctgaatcccaccttccgacatgtgagaatctanaatatgtattccacatcctttattttatctaggtanaactagtctgataaactatcatgaatgattttc

SEQ ID NO: 12341 - DNA, 922 bp, Diabrotica virgifera
  misc_feature (553)..(587): n is a, c, g, or t
  misc_feature (759)..(759): n is a, c, g, or t
  misc_feature (803)..(803): n is a, c, g, or t
  misc_feature (825)..(825): n is a, c, g, or t
  misc_feature (853)..(853): n is a, c, g, or t
  misc_feature (896)..(896): n is a, c, g, or t
gaacggagctccaatcaaccagaaagaaacgcctcatggcgtttactactccgtaaagaaatatttacaccctggcataatccagttgaagattccatgtccacgaatttgatctaccaccaaatcgtccgtggagtcaaattcggcgaatatcggtgtcccaaagaaggtgatatagctgtcttgatagccattcagtattacgtagagaacggagctccaatcaaccagaaagctctgcattcgaggataggagagtacttgcctacatatttggtgaagagaagccaaaacgacttgaccaattgggagaacaaaatcgtttctgcgtttattaatttagcatgtgttaagcaaaaacaaccttcgatcaaagctaaggagactatggttaaatatgctcaaatgacgtggcccatattgttctccaaattctttgaagtctgaaccgcttcaaagaacaaaatgatcatagcggtcaacagcgccggtatattcatgatcgatgacgaagaacagatccatatggagctcacctttgctgacgtttccnnnnnnnnnnnnnnnnnnnnnnnnnnnnnnnnnnntatcctaaataccgtagctagagaagaatacgctttccatactttagacgcacaatcccttagcaatttgctacaatacattttggacggattaaagaagagatcagtgtatttgtgtatgtactgccgactattctcattcagtaggcgcagaatcattcctatctcttcngcaaaggagatctaatagtacttggaaacggccaaaccggtganacattaatgacagcttcctggngggatacgagaatggcacggaaaatccnggcgatttccccacagaaaacgtctacattctccccacactancaccacctcctgcagatatcctcgct

SEQ ID NO: 12342 - DNA, 427 bp, Diabrotica virgifera
ttaagataactaggtagaagttagtggaaagatgggggatgatgatagtgagtaggttaatgtagatgaaaaaagaaattataaggaataatgaaaaatatacgcaataattaaaaggaaaataaaatatcagatgcaagtatagatttgggacaacctaaagataagagtacaacttaaaagacaagttttaacgagaaagactagaatagatatattagaacttaaaaaagatgtcagagataaaagtaaacaggtaaaaatattaaatcaaaaacgaagaatatgaataaatgaaaaataaccaaagatctgagttatatgatcgaaaaaaaaaataacagatcacaatatgagagaagtcaataaacaataaaaatattgaacaatagtttgaactgaaaacaaaatacttcaggatacttat

SEQ ID NO: 12343 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12344 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12345 - DNA, 573 bp, Diabrotica virgifera
ctattaagggggcgtgcaaatttttttaattccatagggaccctttttagaacatttgaagagaggatataaataagtaatttttaggagaaataatgggaatagggaagcgatttctgatatgtatataaaaaatctgtatgttttggattatatgatagggatgaggactgtatactgattatattaaatggtagcgtgaagatgatagagctcaggaaggacaagcgtgaggattgctactgaaaataataaagaaggactgtatgaaaaaaaattatttgctattatatcagaaggaataacatagacatatgggaagcctaaattttgttaaaagaggagaagaagatataatgtgttatataactatgaatcattaaggtgaataaggagtgatttatatgaggaaatggtttcgtttggggagagagtagaggaaattaaactatttttataagataatgagaagcaagagtttgtgataaaatgaattttgcaactggagagaaatttctatgaagggagaggtttacaaaatcgaagcgttacaaaggatgagaaattattagc

SEQ ID NO: 12346 - DNA, 656 bp, Diabrotica virgifera
  misc_feature (189)..(257): n is a, c, g, or t
  misc_feature (261)..(439): n is a, c, g, or t
  misc_feature (451)..(503): n is a, c, g, or t
ctcgacccagtcaacataagcatcatgaactcttacagtgtggtatttgcgtttgcattggccgctgttgttgtagccgaaccaccttcaggctacaactacaaccggcccagcgggggtggcggcatctccttcgggggaagcagcctctccttggggtatggaatgattttcaaagtataaagaacnnnnnnnnnnnnnnnnnnnnnnnnnnnnnnnnnnnnnnnnnnnnnnnnnnnnnnnnnnnnnnnnnnnnnctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgttagaatgnnnnnnnnnnnnnnnnnnnnnnnnnnnnnnnnnnnnnnnnnnnnnnnnnnnnngtttacattatttaaatttactaatgatgttaatattagtattagaaaattgtctatttattataaaaactttagattataaaaattaaatacagctaacaactttttttttctgcttattataaaaaaatccccctttcttttactctataa

SEQ ID NO: 12347 - DNA, 653 bp, Diabrotica virgifera
  misc_feature (3)..(28): n is a, c, g, or t
  misc_feature (197)..(219): n is a, c, g, or t
atnnnnnnnnnnnnnnnnnnnnnnnnnngggaaaaatgttgatacaatttctagaaaattcagaatacatatagtgttctagttgtactgtatactgtatgtattataagtacttgctgacaagtaaggaccatagatgaggggtggtaaggacttgctaagactgacaagctactgcattaacaatgagtgacagnnnnnnnnnnnnnnnnnnnnnnncaccttactcaagactatttgtagtgggggcaagagatttaagggaggatgatatcaaaaatgctttcaataagtttggtgatgttaaggatgtgtgggctgtaaaagacaggaattctggcgactatagaggtatattttacgtaaaatattataaaacttcacatgcagctctggctctcgaagagatgagaggtaccaacttaggtggaagacccctaaaagtaatgattgcgcataatcgtgaagcaggtcagggccaggacttcaaaccagacatcgaggaagaggatcttaaaagattgtttattgtggtgtcaaaaactgagggacacaacgaactccataatcacttcaaacaatttggaacactggcgtttgactctatcgttcatgatagagaaactattcctaacatatcattcatttatgtt

SEQ ID NO: 12348 - DNA, 942 bp, Diabrotica virgifera
  misc_feature (784)..(784): n is a, c, g, or t
aggtaagctaaatcggtctctacaagtcagtgtaaattttcctccatggacaatccaaccacttaccattgacttaaccctcacaaaatatcccaaatcaactacaaatccgattttcattaaacacttgtactccgaagtgatatctcattatcctaattatctccaaatcttcagtgatgcctctaaagctcatgacggacatgctgctgcatactactgtaaataaactactcacactatatccatacctagaaactgctacattctcacaggcgagaccatagccattttggaagccttaattttgttcaaaacgcgtagtgagaataaatgtgtcatcatcactgattcattaaggtgaaacaggggcgatcagcaggtggcgaaggcgcgttccgggattgtggctgtaattttgagtattttttcgagatatttggcgcacgtgttcgtgatataatgaacaatggcggtgcagagtaatttccacatattggtatatttttgaaattgggctcggtaacgccgttctttgttatattgcgagtacgtgtgccaaatttctcgaggaaatgttcataattgcagccgcaatcttggagcgcgtttttgctacctgttgatcgctactgttccctcttaaatgccctattaggtgtaaaacaaatataccatacaaatccaatatttcgggctatcaaaaatgaaataaatataattcaatcaactcgaaaagaagtagcatttatctgggtaccgtcgcatgtaggaatagcagganatgagaaagtggacagcctagcaaacacaagtcgaataaactcacaacacacaacgaaatcaagaaatacccatactccgatctcaaaaacctaattaaagaccactgtatgaacatatggcaagactactggaaagattcaagaacaaaactaaatg

SEQ ID NO: 12349 - DNA, 607 bp, Diabrotica virgifera
  misc_feature (552)..(565): n is a, c, g, or t
  misc_feature (568)..(581): n is a, c, g, or t
aagatattgccctgtttataactttattactagaatttgatgatctgtggaactttctctcattaagaagtttagaatcaaacaaatgtcttcttttcttccccttttgttgacaatgaacaatatcatatggaaattgtcacgagtgctgcctacatgatgatctttcttatatatatacctattataatattgggctatcgaaagtgactggaacccgtataacctctcgattcacaatataacattccctctgagaagatatctatctaactttgactgttacccactattcttttactattaactattatatacgcgtatatctatatatgcgccggttagtgaaccgtcatccattaagtgttagctccaatctgcatgtctttactatacttgaaaaagtcaaacgcatatagaacatcttataatttcttaacattacttacagtgagagtcttatataattacaacatcattactctcgttaccactatgctcccatgaagatctttattattttccacactgttaattattgataaactgtannnnnnnnnnnnnngcnnnnnnnnnnnnnngattagctattttaacgaattttaat

SEQ ID NO: 12350 - DNA, 656 bp, Diabrotica virgifera
ctcactatagaggaaagcgtggtgacgcctgcgaggtgacgcggtgcgcggaatatccccgggctcctcttctacgcgtcctgggagaattattgcgttgacagatataaacaccaagttatttgaagcattgtggctaccaaattttccagactggttttgttcatggcgatccccatcctggaaatgttttagtcagaaaagtaaatggaaatgcccaattggtattactagaccatgggctatatcaagaagtgtcggcgaaggatcgaatagcactcagccatttttggaaagccattgtgttacgcgatcaccggaacatgatgaagtattccaatgaattgggagttaaagattacgaagtttttgccgaaattttgacacaatcccccctgaaagctcaaggtttccaattaaaggtgcatctttccgaagaggacttacaacatctgactgaaattgcaaaaaatagattcgacactgttatggcgtgcctaaaacagatgcctagatcacttttattagttttaagaaatttgaatactatccgtgccattgcttatcatcatggtaatcccataaatagatataccacattaggaagaacagctaccaaatctttttacggagtacaatcaagtctacttacaact

SEQ ID NO: 12351 - DNA, 996 bp, Diabrotica virgifera
  misc_feature (7)..(984): n is a, c, g, or t
cctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttttga

SEQ ID NO: 12352 - DNA, 88 bp, Diabrotica virgifera
  misc_feature (7)..(44): n is a, c, g, or t
aattagnnnnnnnnnnnnnnnnnnnnnnnnnnnnnnnnnnnnnngcgcggtctattgaaagacctaaagcaagatattcgttagcctg

SEQ ID NO: 12353 - DNA, 416 bp, Diabrotica virgifera
  misc_feature (4)..(328): n is a, c, g, or t
  misc_feature (332)..(361): n is a, c, g, or t
cccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctannnnnnnnnnnnnnnnnnnnnnnnnnnnnncaaattttatcacaattcacctattactcaagaattacgcttccaaattatcata

SEQ ID NO: 12354 - DNA, 504 bp, Diabrotica virgifera
ctacaatcagttggaaaatgtcttaactatatcagtgatcaaaacatggtgttggggaagattatcattagggtagttttcgcgatatgcttgcttttgctcatagttacggactattccgggattttgcacaaattgattggtggaaataggtccgatgatcaccatgtgtcaccccgaccgaccaatccaggatacggggattccaagactgatatagacatagacgctgacatcgaagaagaatctgtcaaacatttaggatctcaaacaacaaaatcaaaaatagtgaagacaattaaaaaagcctgtctgccaaaactgatatgtgagttaactgcttccacacagagggataaggtaacggattcatagaagtccttattaagttttttttgagatacgactatgcaaacaactgcccgactgacaacctaatacacctttgcccgccatatgggccagataataagcggagtcgaaggaaactgacgctaataactt

SEQ ID NO: 12355 - DNA, 915 bp, Diabrotica virgifera
  misc_feature (47)..(65): n is a, c, g, or t
  misc_feature (100)..(121): n is a, c, g, or t
  misc_feature (331)..(354): n is a, c, g, or t
  misc_feature (409)..(428): n is a, c, g, or t
  misc_feature (802)..(802): n is a, c, g, or t
  misc_feature (874)..(874): n is a, c, g, or t
gaaggtaggacgtgttaggtgttagtagctcttaggctaagtataannnnnnnnnnnnnnnnnnncggcacacaggcagttctaatggagaacggtgaannnnnnnnnnnnnnnnnnnnnncagagcatcaaaatggatcaggtgatgctccagccgatagtggaagtgcagaaacgcccggccgtgacgatgatagaaaattatttgttggtggcatgtcttgggaaaccactgatagggagttacgagaacattttggccaatatggcgaaatcgaaagtataaatgtaaagacagatcccaacactggtagatcaaggggatttgcannnnnnnnnnnnnnnnnnnnnnnngctattgacaaagttgtagctgcaggtgaccatgtcattaatggcaaaaaagttnnnnnnnnnnnnnnnnnnnnaaggcatggaaaaatatttgtaggtggtctcacctctgaattgagtgatgatgacatcaagaactatttctcacaatttggatcgatcattgatattgaaatgccatttgacaagcaaaagaaccaaaggaaaggattctgcttcatcacatttgaatctgaacaagtagtgaatgagttactcaagcaacccaaacaaaccattaaagacaaagaggccgaggcggctacggaaaccaaggaaactggaaccaagcctatggtggctatggttatggccaaggatacggctatgatggctacagccaaggttatgactactacggctatgatggctatgggggttttttgggaggttatgattactcaaactnatggcggcggtaactacggtaaatacacccacaggacacattaataaacttttactccaacccgagatgttngtatatctcgagtggtgcttgtaagccgggtgtatatgtca

SEQ ID NO: 12356 - DNA, 526 bp, Diabrotica virgifera
  misc_feature (487)..(501): n is a, c, g, or t
  misc_feature (503)..(520): n is a, c, g, or t
gaaaaacatctggatgaattgccatctagttctttagaagaacttatcaaacatggattgagggctcttagagatactctacctccagaggttgacctcacaacaaaaaatgtctccataggatacactggcaaaggtcagacctttaaaatcctcgaagaagaagaaacttccccctacttgtcccttattgagggtgaagaacgtagaggaggaggagctgcagctgctgcaattgaggaccttcctgcagatccgttgagagatgatgcgggggacgagcccagggatgcagtcccagctgtggaaacttctgccatggataccacagaatagaaggattagataaagcattaaagccacccgttgatcaggagagtgggtattggaaaggaatattgccgtggctgtctctgttagtctaaaacagactgagacagtcacggcagaacatcgtttgttatatccatactgtattttttaagcnnnnnnnnnnnnnnngnnnnnnnnnnnnnnnnnncgctcc

SEQ ID NO: 12357 - DNA, 152 bp, Diabrotica virgifera
  misc_feature (12)..(31): n is a, c, g, or t
  misc_feature (33)..(96): n is a, c, g, or t
  misc_feature (121)..(140): n is a, c, g, or t
caatgaaggggnnnnnnnnnnnnnnnnnnnncnnnnnnnnnnnnnnnnnnnnnnnnnnnnnnnnnnnnnnnnnnnnnnnnnnnnnnnnnnnnnnnnctaaaaagacccctaaaatagtttnnnnnnnnnnnnnnnnnnnnggtttttctagc

SEQ ID NO: 12358 - DNA, 913 bp, Diabrotica virgifera
caatttctattcgtgtacaaattgttcctttaacttgtaaatttgcagtgtgtttatttttaataatttgcgctattattggattgtatttaatcttataaatctgaaacctccaaaagtatgtccactatgttaccatagttttgttttaatgaaaagaactcacgatgatattttgcattcaagctcggctgaaaaagttcatgaaaattgtcatttgtgtggaaattcagaagatgttataaatgtttcaaaatgggctcattttaaggcaattggtaaagattttcctggttctaatggtgaaaatatatcaaatgtatgttccgattgcttatattatttagagacaaaaagtacagtcaaggaaaagttaatatcagaataccctatcttgaagcaagaatcaatcatttctcaatttgacgtattggggaattcaacacctacaagaagaacccgaacaaaagcagagagaaagtcccctattgatattgtagatttaacagttgcagaaccagttgcaactccaacagacaatatgaaatttagacctttaaaaaccgataggcatttaaggagatccagggcagttaacactgatccgaaattgcttaatcaagtacttataatcaagctaccaaatcagtcgctaaaagaggaagctaccaaatcagctcctaagaggaaatcacttacacctaaaagagttaggtttcgagatgaacatgagcacattatagataaatacaattctccttcattatatacagacaaagagaatgcgtataaagaaactgaaagaattggttgaatacgagataaaaacaacccctaaaaaggtctaggtacagaagcgttgacgacacagaaagtagccccgattctttaaatccacgaaaaaaatctttct

SEQ ID NO: 12359 - DNA, 911 bp, Diabrotica virgifera
  misc_feature (304)..(325): n is a, c, g, or t
  misc_feature (353)..(375): n is a, c, g, or t
  misc_feature (734)..(734): n is a, c, g, or t
  misc_feature (751)..(768): n is a, c, g, or t
  misc_feature (771)..(789): n is a, c, g, or t
  misc_feature (843)..(843): n is a, c, g, or t
  misc_feature (855)..(878): n is a, c, g, or t
agtacataccattttggttgttatattacctaatatattatcttagttaagttatcaaagtgtgtttccttatttaccaaagtgtaaaattattattggtgtattatttataatacacaaattcaagtttaatcaaatggaagtacaacaagaaattggcgggaaaacgtgaaactcatttgaagaaaaccaagaaattgaaaaagatcctctccaagagaagaatatggacattatgaagacaccaaatgaagattcatctcacgaagaaaatgacatgaatccacaagttgaagggaaaacnnnnnnnnnnnnnnnnnnnnnngtaacacacaatggaaagaaatctcagnnnnnnnnnnnnnnnnnnnnnnngtttattaaaccaagtcatttgaaaatacatttgagagtgcacactggtgaaaaaccgtacaagtgtgaactttgttataagcagttcagtgcatcaagtggtttgaaggtacatttcagaaggcatactggagaaaaaccacataagtgtaaaatttgttttaagcaatggagtacatcaagtcatttgaaaagacatttaagagtgcacactggagaaaaagctcacaagtgtgaagtttgttttaagcagtttagtgaagcagataatttgaaaacacatttgagattgcacactggggagaaaccttacaagtgtgagatttgttttgagcagtttagtacagcagatactctanaaaaacatttgagagtnnnnnnnnnnnnnnnnnntcnnnnnnnnnnnnnnnnnnngaagcaatttattcaagcaggtgcttacaacaaacacatgaaaagtcacactanagaaaaaacttnnnnnnnnnnnnnnnnnnnnnnnngttcactggaacagaaagtttgaaacacacttg

SEQ ID NO: 12360 - DNA, 752 bp, Diabrotica virgifera
  misc_feature (14)..(74): n is a, c, g, or t
  misc_feature (84)..(111): n is a, c, g, or t
  misc_feature (293)..(314): n is a, c, g, or t
  misc_feature (316)..(330): n is a, c, g, or t
  misc_feature (332)..(355): n is a, c, g, or t
  misc_feature (386)..(412): n is a, c, g, or t
  misc_feature (450)..(466): n is a, c, g, or t
  misc_feature (468)..(535): n is a, c, g, or t
  misc_feature (544)..(566): n is a, c, g, or t
ttctacgcgtccgnnnnnnnnnnnnnnnnnnnnnnnnnnnnnnnnnnnnnnnnnnnnnnnnnnnnnnnnnnnnnatatttaacnnnnnnnnnnnnnnnnnnnnnnnnnnnnggccctttcgtactaaattgtatcaagagattaaggaataataccaacctggctctcaccggattatactcaaattttgaaaagttaaaaaagtcaaactgacatagtaatatagctgttacacaaaattttaatgtaatgccatcgtataggttgttatctatattttctatttgaacacnnnnnnnnnnnnnnnnnnnnnncnnnnnnnnnnnnnnncnnnnnnnnnnnnnnnnnnnnnnnnggtattattacggatgagcttaagaataagnnnnnnnnnnnnnnnnnnnnnnnnnnngaaattatgattaaaaattttcgtatatgaaaatacgnnnnnnnnnnnnnnnnngnnnnnnnnnnnnnnnnnnnnnnnnnnnnnnnnnnnnnnnnnnnnnnnnnnnnnnnnnnnnnnnnnnnngatgatagnnnnnnnnnnnnnnnnnnnnnnntttaggaacagtatatagggttaataaaggtatgctcaaacattgatttcgcctgcttattaaaaacatgtctgtttgaatcaagtatataggctcgactgatcactgatcaactggaatgggcgcggtattttggccgtgctaaggtagcatgatccttaggtagttttattgtaagctggaatg

SEQ ID NO: 12361 - DNA, 707 bp, Diabrotica virgifera
  misc_feature (2)..(17): n is a, c, g, or t
  misc_feature (19)..(61): n is a, c, g, or t
  misc_feature (69)..(181): n is a, c, g, or t
  misc_feature (190)..(551): n is a, c, g, or t
  misc_feature (555)..(567): n is a, c, g, or t
  misc_feature (569)..(598): n is a, c, g, or t
  misc_feature (607)..(706): n is a, c, g, or t
cnnnnnnnnnnnnnnnncnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaacgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggnnnnnnnnnnnnncnnnnnnnnnnnnnnnnnnnnnnnnnnnnnncgcccaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12362 - DNA, 125 bp, Diabrotica virgifera
  misc_feature (13)..(109): n is a, c, g, or t
  misc_feature (122)..(122): n is a, c, g, or t
gttaaaagcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtggataaaanaat

SEQ ID NO: 12363 - DNA, 910 bp, Diabrotica virgifera
  misc_feature (242)..(261): n is a, c, g, or t
  misc_feature (273)..(304): n is a, c, g, or t
  misc_feature (753)..(778): n is a, c, g, or t
  misc_feature (802)..(802): n is a, c, g, or t
  misc_feature (854)..(854): n is a, c, g, or t
ccggcctcatatcggaatttgaatctttgtaggtgtagtatgtgtggtccaaattatatcgcttctaccattaaatgcataataattcttatattattatttgcacgattgtgccgcacatggtacctacatgtgaagatacgttatgctttatgcatttattaaatggtaattaatataactaaagagttcaaaatatttcctaaaaaatatttttacgcacttttcaacgtcggtattannnnnnnnnnnnnnnnnnnnatatagggtgannnnnnnnnnnnnnnnnnnnnnnnnnnnnnnnaaaataatcaggaacaacacaacttctggtaaaccgattcttccggttcaagagctcgatcttatacataaaaaaagaacttatataccaaatttggttgaaatcggacttgtcgttcaaaagttatcatgctattagtcacatatacagtactagtacagtcgccattttgaatgcccgccttttttgtaaaagacaaaatctgagccggcctcatatctaaatttgaatctttgtaggtgtagtatgtgtggtccaaattatatgcttctaccattaaatgcataataattcttatattattatttgcacgattctgccgcacataggtacctacatgtgaagatacgttatgctttatgcatttattaaatggtaattaatataactaaagagttcaaaatatttcctaaaaaatatttttacgcacttttcaacgtcggtattannnnnnnnnnnnnnnnnnnnnnnnnnagggtgaaggaattgaaaaaattnaacaacatatttttacaaaataatcaggaataacacaacttctggtaaacgnattcttccggttcaagagctcgatcttatacataaaaaaagaactatataccaaaa

SEQ ID NO: 12364 - DNA, 333 bp, Diabrotica virgifera; identical to SEQ ID NO: 12194
  misc_feature (6)..(28): n is a, c, g, or t
  misc_feature (219)..(292): n is a, c, g, or t
  misc_feature (297)..(331): n is a, c, g, or t

SEQ ID NO: 12365 - DNA, 927 bp, Diabrotica virgifera
tttcgtttattatgctgtggtgatgtgatgggcgaatataccaacggaatatacacgtatagtttgagtagtatataatatattctttatctatgcatatagtatagtagactatacactacaagaagtggtgagggcagggtgactcaggcctcatttgaacagtccaactccaagaaatttgagtgcaatttgagttttacagcagaagcgtcatgtctttaaatacatttaaaaagtgcacccagaaggaaggaatgcaaagaatgaattatttgtatcagatatgtaatctgatgatcactgagaataggacaaataatgcagctgctgcagcttactcaaaccttcttaataatatttccaggaaaacggttcaaagactggaaatagacatgaagcgaactatatgtaaggcttgcgtatgtcttcttattgttggagttacggcaaaaatagcaattaaaaagaaaaaacgcattttgacatgtcttagatgcaaccattcgaaaatatatattatcaataaataaatactattgttatattatgtacatatatatgttgttgtatttattatctgtttgaaagtgggaccaggcaaagtagccttaacccattagcgcccacgagatctgattttaagaattaatattccagcacttaatgagaattaggattaataggccacctattaatatcatctgtataattttgtttctcaccagacaaattgatagcgttttctaactcttcctctgtccgaagatcctttttttttatcgaatctgtcagtgtacttgtgttaagtacttagactaggtgataaaattttatagattttacttattaagtgttagcttgctaatgtattttcatgatgcattttaacagactttgacttatgtaaatactttgtatattgac

SEQ ID NO: 12366 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12367 - DNA, 152 bp, Diabrotica virgifera
  misc_feature (2)..(94): n is a, c, g, or t
  misc_feature (96)..(143): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnngggattaaa

SEQ ID NO: 12368 - DNA, 699 bp, Diabrotica virgifera
  misc_feature (22)..(281): n is a, c, g, or t
  misc_feature (290)..(326): n is a, c, g, or t
  misc_feature (328)..(374): n is a, c, g, or t
  misc_feature (383)..(403): n is a, c, g, or t
  misc_feature (448)..(460): n is a, c, g, or t
  misc_feature (462)..(489): n is a, c, g, or t
ccctgcccacgcgcccgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttacnnnnnnnnnnnnnnnnnnnnnnnnnnnnnnnnnnnnncnnnnnnnnnnnnnnnnnnnnnnnnnnnnnnnnnnnnnnnnnnnnnnnctcatttcnnnnnnnnnnnnnnnnnnnnncattttattagaatttaatttttaactaaatattatgattaaagnnnnnnnnnnnnngnnnnnnnnnnnnnnnnnnnnnnnnnnnnctattacttttatgtataatgacttttttcttccatatatcacatttaacttatatagatgcagctaatgatgataatatgagtatgacaaacttgtatatctacgaaacgtatataggattagtagaggaattcttccccattgcttgcatcctgatgatgaaaagcctgccttcatgtcttaaacacaaaagctcccctgcccactga

SEQ ID NO: 12369 - DNA, 703 bp, Diabrotica virgifera
gcttgaataactaaaaattctttaaagggctactactagatttggcttgagtattaactactgcttactctcactgagatgaaacacgaaaacgttcgaatgaaattctgctaaacgcatcagtataaaccgtatacttaaataaagacagctaatttacaactatctacattaaaggaagaagtcgtaccacaagaatataagcatatccaagtataagtacacatcgaaacacaacttcactggacacgaaaaaagactgaaacttttgcttttctgactgaattacacacaatgaacaagacaacccttgattcactacattgaaacctataagttgtccgtaaagagtggactccaaaagactctgagaggttgaaacccaatacaaaataggtgacgatatctgagacaagggtacagcatatccaacctaatatgaatattccaatagacaaatataaataatcagatctcgctaacataacagacactggaaaagaaatgactaatcttaatttccttatacatttactaactattgccaaatctgagtacagaactaatactctccattgcggattccgttgatacttaccagaatatcactgacatgatcggacaaatatgtagctgaattatactctaacttctatgtagcggataaagacatcgtcacatcaaaacataatgaaaatgaact

SEQ ID NO: 12370 - DNA, 583 bp, Diabrotica virgifera
  misc_feature (120)..(139): n is a, c, g, or t
gcagccacgaaggcttttatatgcagccttaacgtggctcgaaaagattcttattattcccttaaaatacgaaggactgggtagatttgcctgcgcattgcaactcgaataaagatggannnnnnnnnnnnnnnnnnnncatttttctatttacccgtgactccaatggaattagtatatacgtcctatcatctataaaataagcctagtaatggtattgataacatatctgtaaatataataaaactaatacgttatcatacatatatcgaatccttttacccagattagataatctctcaataacagccacccacctttccatccatatttaaaatgagataagtctattcccatcttccgaaataatgaccctcatgatattactaattatataccagtatctgtccttatcgaaatttccaaagtaatagaataaggttgaatacaccagaatgttaaagtttatacaagaatacattttattaactcctatacaacacaaatttagaccaaacgaaccatcactcacgactgcatgtaacttgtttgaccgtatgtatgatatattaaatagcaccag

SEQ ID NO: 12371 - DNA, 78 bp, Diabrotica virgifera
  misc_feature (9)..(28): n is a, c, g, or t
  misc_feature (44)..(44): n is a, c, g, or t
  misc_feature (69)..(69): n is a, c, g, or t
tttgatccnnnnnnnnnnnnnnnnnnnnataattaccttagggnatacagcgtattttttattggagangtcaatcga

SEQ ID NO: 12372 - DNA, 95 bp, Diabrotica virgifera
  misc_feature (7)..(44): n is a, c, g, or t
taacagnnnnnnnnnnnnnnnnnnnnnnnnnnnnnnnnnnnnnntgcgacctcgatgttggattaagtttatattggggtagcaggtatattatt

SEQ ID NO: 12373 - DNA, 138 bp, Diabrotica virgifera
ggactgagagaaagatcatttggcaccattgctgacttcgtcctgtctaaatgggtagatgtattatgtttgatgcagttattaaaagatattttgttgaagtgaacactactagagacgtcaaaggaagattatgac

SEQ ID NO: 12374 - DNA, 68 bp, Diabrotica virgifera
  misc_feature (2)..(17): n is a, c, g, or t
  misc_feature (19)..(67): n is a, c, g, or t
cnnnnnnnnnnnnnnnncnnnnnnnnnnnnnnnnnnnnnnnnnnnnnnnnnnnnnnnnnnnnnnnnnc

SEQ ID NO: 12375 - DNA, 89 bp, Diabrotica virgifera
  misc_feature (52)..(83): n is a, c, g, or t
ttctacgcgtccgcatgatctgagtttaaaccggtgtgagccaggttggttnnnnnnnnnnnnnnnnnnnnnnnnnnnnnnnngaaagg

SEQ ID NO: 12376 - DNA, 832 bp, Diabrotica virgifera
  misc_feature (2)..(27): n is a, c, g, or t
annnnnnnnnnnnnnnnnnnnnnnnnnctcccggtattccaggtgcacccggaccgcctggacctctaccagatttaagtgccttctaccaacaattatcacaatctcaaggtggtgacaaaggacctaactatcctgaaccgtttcaatatctgcaagcgcaagttggacctgtcggatctagaggaccaccaggtccaccaggcccagtaggaccacaaggtttccaaggtcttcggggagaaataggcgaaccaggaccagccggaccaccaggtcctgctggacccagaggacttacgggctcacccggcaaagatggagaacgaggagatgatggtgaagctggagcagcgggagcaacaggtccacctggttcacgaggtattccgggtatgcccggattgcccggggtaaaagggcatagaggatttcctggtctagacggttctaaaggtgatcaaggttctactggtgaaaaaggatcacagggagtgtcaggaccaatgggacagactggatctcaaggaccagctggcccaagaggagaaagaggacgcgaaggtcctccgggccctcctggaataagagggattgatggaattgctggaccaccgggaatgccaggttctattggtaaacctggagcaccaggatttccaggaaatccaggtgcaaaaggagatcaaggagcatcaggtccaaaaggtagtcaaggataccaaggaagtagaggcgaatcaggaagaccgggttcaccgggagaatctggtcctccgggtcccgctggaaaagatggatacatggagaaaaagggtacacaggagctcca

SEQ ID NO: 12377 - DNA, 834 bp, Diabrotica virgifera
  misc_feature (335)..(347): n is a, c, g, or t
  misc_feature (349)..(362): n is a, c, g, or t
  misc_feature (496)..(514): n is a, c, g, or t
  misc_feature (707)..(727): n is a, c, g, or t
ctttccttgtctaaggtttagccatccaccggccaccacttcacataacctacaaatttcaaatttaaattaaagtccggtaatactatattatttatctacgattaaagttgtaaatttattgtaaaacagtgtgtacaagtttgattttaataccaattaatactgtggtatgagtttgtctctgttttacaaatacaaataataagagtataaaaggaaagcacaaaattatattcctgtagtgaaaattgaaaattatgtataattcatatttttggaaatacgttatttaattaattacaggtaaaattgtgtggtttctactgtatggnnnnnnnnnnnnngnnnnnnnnnnnnnntcttttttgtttgtatgtttgctattctaaccagataaatagtccaggaaccgaagtggatagtcggatcaaaatctatatgatgccgaaaggcgctttcaccatgggagtggttgccccatctcgggggtggnnnnnnnnnnnnnnnnnnngactgcaaaagttgataaaacattcattttaaccctcgtaaggcggtccttatagactgggagatattatacgggggttctgccacgattttctaagtcctgccttttgcaatgctggaggggtggacgatgtaattacaatctgtggaagcatccacgggtttcctgtgacattttcctgtgaaaattggannnnnnnnnnnnnnnnnnnnngggatttgcgatgaatttctaagacctgccatatccgaagatagagaggatactatcgattttatgaaggggattttttgggcaggaccgtcgaaagagggcttgga

SEQ ID NO: 12378 - DNA, 264 bp, Diabrotica virgifera
  misc_feature (4)..(46): n is a, c, g, or t
  misc_feature (52)..(74): n is a, c, g, or t
ttgnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 12379 - DNA, 896 bp, Diabrotica virgifera
  misc_feature (243)..(265): n is a, c, g, or t
  misc_feature (417)..(431): n is a, c, g, or t
  misc_feature (647)..(667): n is a, c, g, or t
  misc_feature (818)..(837): n is a, c, g, or t
  misc_feature (842)..(842): n is a, c, g, or t
  misc_feature (867)..(867): n is a, c, g, or t
  misc_feature (879)..(880): n is a, c, g, or t
caaccagatacagatggcacagtatctgctccaacaaagtgtccataacaactctgaacgcaactactgaggggaagcctaatatatcaaacggaatgccatttccaatgatgaatatcatttgtgtaacacattccatttcgatctatgggcattatggttcattagctcattacataacctttaatatgaatccattatacattatatttttgtccattatagcaaagacttatattttcnnnnnnnnnnnnnnnnnnnnnnngttttcgttttctttatgtagagggtatttaccttttttatgtaagggtacacctatattggaaccgtatttctcccgaaccgatacggtgtactatcattgtttcatcatgagtttgttttcaatccgtcggatagggagaaatacggatnnnnnnnnnnnnnnntttaacagaagtgtcatacatacaaagaatctctatttacaggagttttgtctataaaagtattggactactgattaaatgtaagtctttgcatacaattgatgtaatcactgatttatttcataagattggtttactttataagtaataaggttcaggatcctagcacttcatactccaaatttagaaaaacaccgattgagcagtcatccaacnnnnnnnnnnnnnnnnnnnnnctgaatattcaagattattcagaaatattagcatttcattgtcatttactttttttctccttaaagctcacctttcgatagtgttttggatcataacggtcttgatcaaaacgcagattttgtgcctggatcgctgagctctgatacacgnnnnnnnnnnnnnnnnnnnntcctnttttctttgttttgaagaatgattntacttattttgnnaatgggacgtgtttat

SEQ ID NO: 12380 - DNA, 335 bp, Diabrotica virgifera
  misc_feature (3)..(136): n is a, c, g, or t
  misc_feature (143)..(180): n is a, c, g, or t
  misc_feature (200)..(213): n is a, c, g, or t
  misc_feature (216)..(238): n is a, c, g, or t
  misc_feature (246)..(268): n is a, c, g, or t
  misc_feature (298)..(329): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12381 - DNA, 115 bp, Diabrotica virgifera
  misc_feature (3)..(66): n is a, c, g, or t
  misc_feature (70)..(111): n is a, c, g, or t
tannnnnnnnnnnnnnnnnnnnnnnnnnnnnnnnnnnnnnnnnnnnnnnnnnnnnnnnnnnnnnnngttnnnnnnnnnnnnnnnnnnnnnnnnnnnnnnnnnnnnnnnnnngggg

SEQ ID NO: 12382 - DNA, 904 bp, Diabrotica virgifera
  misc_feature (345)..(362): n is a, c, g, or t
  misc_feature (785)..(785): n is a, c, g, or t
gccgccacccgcgtccggcaaaacatccagaaactgcaccattgcataataaacagcctacgtgactatagttttgcattcggctctattattttgcacactacccatagatttttattgactgatataatttattcgggaaatatttgggattagactatctacgtactagctattgttaccattttataataaaagaagactataaaattcgactgtttcaaagtgttacaattgaaaagactgatttctagtgttgtgtcgttgagaaacagctaaaatgattgaacttacagttaacaagcactgtcactcaaataaaactcctgaagtggacaaccgggnnnnnnnnnnnnnnnnnnatggccagtatattatgcgtaatatttatgttaggagaaatagtaggggggtatttatcgaacagtttagcaatagcatcagacgcagctcatctactaacagattttgccagttttatgatctctctattttcattgtacatggcaaacagaccttcaaccaaaaaaatgttattcggctggtatagagccgaagttattggtgctctaacttcagtacttttaatttgggttgttactggcatcttggtatacatggccgtacaaagaattatttacaaaacttacgaagtcgattccaaagttatgttgattacctctgggtgtcggtgttattgttaatatcataatgggtataactttacaccaacatggacacactcacagtggtagcgatggtgaacatggacatgcacatggtgnggaaaaaagaggaaaatattaacgtcagggcggctttcattcacgtcttgggcgattttctccaaagttttggagttttcgtagctgctatcgtaatttattttaagcagatctaatga

SEQ ID NO: 12383 - DNA, 652 bp, Diabrotica virgifera
  misc_feature (14)..(453): n is a, c, g, or t
  misc_feature (460)..(497): n is a, c, g, or t
  misc_feature (517)..(530): n is a, c, g, or t
  misc_feature (533)..(555): n is a, c, g, or t
  misc_feature (563)..(585): n is a, c, g, or t
  misc_feature (615)..(646): n is a, c, g, or t
ttctacgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12384 - DNA, 294 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(252): n is a, c, g, or t
  misc_feature (254)..(276): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnngnnnnnnnnnnnnnnnnnnnnnnngtaatctctaaggaaaag

SEQ ID NO: 12385 - DNA, 435 bp, Diabrotica virgifera
cggacaattttatgagagctgtgtttccccataagtacataggatttacgcccattataaataataattatcatagaaaaatgacttaaagtacatgcaagactatctgagtagtatacccctcaagcctcgaacatggtgccatggagatcaggtatagatagtgtttaaaaataatattgccgaaggacacgaatatttacttgcagaagaatggtagtagaaggtgctagcgaaacgacgagatcacctatgagaaataaatcacacgttctgactccacaggatagaattctggacaggatatacctacagataccagctatctgtaaacaagaggtgactacacttgtagaagcaggtgctgcaagactacagtataggtgaagatcacttcatatacacaatgctgctatgctgaatctatgtacgcaa

SEQ ID NO: 12386 - DNA, 227 bp, Diabrotica virgifera
atacattcataatggaaaaatgacattatctatatcagagatcagaacatgtttgttgagggatattatcattaggttgtgatcgagatatgattgctattgctcatagatacatactatgcccctagtgtgtccggaatgattgatgaatataggtacgatgatcaccatgtgacaccccgaacgtccaatccaggatacggtgatgccaagactgaaatatacat

SEQ ID NO: 12387 - DNA, 803 bp, Diabrotica virgifera
  misc_feature (550)..(638): n is a, c, g, or t
catatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgctt

SEQ ID NO: 12388 - DNA, 938 bp, Diabrotica virgifera
  misc_feature (3)..(684): n is a, c, g, or t
  misc_feature (690)..(800): n is a, c, g, or t
  misc_feature (802)..(936): n is a, c, g, or t
tcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnga

SEQ ID NO: 12389 - DNA, 492 bp, Diabrotica virgifera
  misc_feature (219)..(248): n is a, c, g, or t
gtcaaatgtatatgacatataatattatatattatatttgtaggttattgaactaaatataaatttctagaacaaatttttaccgagtgatagaaattcctcaactaaataatagaagatttagtttgcttaccccggctcatttatgagaatcaagtcaacaatcttatcacagggttattgagaacacgggtggatgcatcaacagcctctgtcgtnnnnnnnnnnnnnnnnnnnnnnnnnnnnnnatttatgtccgtgctaaggaagtatattcgttattttttttattgtaagctgtattgattgtattaatgcaaaaaatattgaatctacctaatgtattaagcaattgatcgattacgctaaaaagcttagatttgttttaaagactacaagaccctcttctatctgctagaatattaataggtgttctataatgataactatatataaaacaaagttattttacttgctcagatgatacaacag

SEQ ID NO: 12390 - DNA, 444 bp, Diabrotica virgifera
  misc_feature (2)..(245): n is a, c, g, or t
  misc_feature (252)..(289): n is a, c, g, or t
  misc_feature (309)..(322): n is a, c, g, or t
  misc_feature (325)..(347): n is a, c, g, or t
  misc_feature (355)..(377): n is a, c, g, or t
  misc_feature (407)..(438): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12391 - DNA, 568 bp, Diabrotica virgifera
  misc_feature (17)..(17): n is a, c, g, or t
  misc_feature (22)..(46): n is a, c, g, or t
  misc_feature (69)..(93): n is a, c, g, or t
  misc_feature (215)..(215): n is a, c, g, or t
  misc_feature (269)..(295): n is a, c, g, or t
  misc_feature (303)..(431): n is a, c, g, or t
  misc_feature (444)..(504): n is a, c, g, or t
  misc_feature (506)..(522): n is a, c, g, or t
  misc_feature (538)..(560): n is a, c, g, or t
ttcccaaccaagggtcncgttnnnnnnnnnnnnnnnnnnnnnnnnnccttatatatttggtgattttgnnnnnnnnnnnnnnnnnnnnnnnnngatagaaaaaaatatgggttaaataggtttaaaatgagataatgtaaaattttaaaagttgaaaagatttaataatatagttgatataaaaattataaagtttaattgaagattgaggtggnaatgtttattatggatttgaaatggtaaataaaattatggtgttattattaagnnnnnnnnnnnnnnnnnnnnnnnnnnntggattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggttttttcnnnnnnnnnnnnnnnnnnnnnnnnnnnnnnnnnnnnnnnnnnnnnnnnnnnnnnnnnnnnngnnnnnnnnnnnnnnnnngaatatttgattagannnnnnnnnnnnnnnnnnnnnnnggatgatg

SEQ ID NO: 12392 - DNA, 1005 bp, Diabrotica virgifera
  misc_feature (218)..(235): n is a, c, g, or t
  misc_feature (569)..(586): n is a, c, g, or t
  misc_feature (778)..(806): n is a, c, g, or t
  misc_feature (944)..(966): n is a, c, g, or t
cagtttttattgatggattgaatctattattatcaatatatgtgtaactttacatctctccctaaaggtattttaaggtacatatttttaattaggaaaaaataatactagtgcgaaaaaagtcttagaggttttaggcattatagaattttgcgccttttatccttaaattagatataaagaattatcgtgattgcattgacaatttcactgaatannnnnnnnnnnnnnnnnnttaaatgcctcgacaactaaagcccttggaatggtacggttgatttcacaatcagattatagtgtaatgtgtgtgttgagtaaatgtcttgttacttagtaaagtcgatctcattgtctttacaaagagacgctaattgtatccggacgtctgcggtccctctggtgaataccgatcccacaaggatagaaataactattgaatgtaatttcaaatatttaatcatttggttttcgatttacagaaagtacagaaccataaaaaacgtaaatagagtagtctgtgcgataaaaatgacgtgtattcaaatttgagtcacttgcggagaatgacnnnnnnnnnnnnnnnnnnctatttgtaagtcgtattgcacaaatcatgtttttaaatatgtttagcaataaaaatagcaaaaaattttgtaatatataaaataatatgacgattactaaaaaattggctttttaaatgaattaaaagttaatttgcgttcttaataagatttattttaagaatagttttaaccaattttaaaaagtaggnnnnnnnnnnnnnnnnnnnnnnnnnnnnntattacttataaatattgcataaaataaacagtacacgtttatacaatacacattttattttacaattaatttttaaacgcttttcttttagttcgttcttaaaatacacgaaatagtcaatacaaaaaaatttgatnnnnnnnnnnnnnnnnnnnnnnncaagttgtttttttacaatggaaaaaaggttgaaatttt

SEQ ID NO: 12393 - DNA, 530 bp, Diabrotica virgifera
  misc_feature (16)..(40): n is a, c, g, or t
  misc_feature (44)..(116): n is a, c, g, or t
  misc_feature (118)..(191): n is a, c, g, or t
  misc_feature (193)..(224): n is a, c, g, or t
  misc_feature (238)..(265): n is a, c, g, or t
ccgtataggcgcccgnnnnnnnnnnnnnnnnnnnnnnnnncccnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnntattaagttcacgnnnnnnnnnnnnnnnnnnnnnnnnnnnnatgacttaataacatcagattttgaatagatagtacggattaatgagagaaaaaatcgcgactgtcgtgttttttttttgagtatacggacgcgagcaagtccatcccgtggcctctaacatctgacatatattacattccggggatgtaatacgctgctgaggaagtattacttcctatattttatatagaaagatgtaattaatattatcgactgagtatatattgaatatacttatatgtgtaaagaaatgaccgttaggcg

SEQ ID NO: 12394 - DNA, 305 bp, Diabrotica virgifera
  misc_feature (5)..(108): n is a, c, g, or t
  misc_feature (116)..(153): n is a, c, g, or t
  misc_feature (218)..(239): n is a, c, g, or t
  misc_feature (267)..(297): n is a, c, g, or t
attgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagcnnnnnnnnnnnnnnnnnnnnnnnnnnnnnnnnnnnnnngggaacctcgatgtgggattaagtttataattggtgtagcagctatataattaagtctgttcgannnnnnnnnnnnnnnnnnnnnnagttaaaccggtggagccagggtgggtnnnnnnnnnnnnnnnnnnnnnnnnnnnnnnngaaaggac

SEQ ID NO: 12395 - DNA, 1228 bp, Diabrotica virgifera
  misc_feature (3)..(28): n is a, c, g, or t
  misc_feature (30)..(154): n is a, c, g, or t
  misc_feature (156)..(157): n is a, c, g, or t
  misc_feature (160)..(301): n is a, c, g, or t
  misc_feature (303)..(303): n is a, c, g, or t
  misc_feature (313)..(360): n is a, c, g, or t
  misc_feature (369)..(416): n is a, c, g, or t
  misc_feature (419)..(535): n is a, c, g, or t
  misc_feature (552)..(592): n is a, c, g, or t
  misc_feature (622)..(721): n is a, c, g, or t
  misc_feature (758)..(800): n is a, c, g, or t
  misc_feature (811)..(847): n is a, c, g, or t
  misc_feature (850)..(954): n is a, c, g, or t
  misc_feature (973)..(1197): n is a, c, g, or t
  misc_feature (1202)..(1227): n is a, c, g, or t
ccnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnanntannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnatttaacaannnnnnnnnnnnnnnnnnnnnnnnnnnnnnnnnnnnnnnnnnnnnnnngggattggnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggaaaatttannnnnnnnnnnnnnnnnnnnnnnnnnnnnnnnnnnnnnnnnggggtttttaaaagaggggatttgccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggcgcgggggatttttttttcccgcgccgaaannnnnnnnnnnnnnnnnnnnnnnnnnnnnnnnnnnnnnnnnnngagggggagannnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccaccccaaaaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccnnnnnnnnnnnnnnnnnnnnnnnnnng

SEQ ID NO: 12396 - DNA, 940 bp, Diabrotica virgifera
  misc_feature (489)..(507): n is a, c, g, or t
  misc_feature (592)..(592): n is a, c, g, or t
  misc_feature (669)..(669): n is a, c, g, or t
gttaggcaatgtcactacatataagttttatacaaaccagagcacaaataaatcaatatttatcgttttagcattcagccaggtataattcagaaataaacttggtgagtacttatataggtaaataggctatattttacctttaaatcagcttgaataaaataggctgtcggttttctgataaagtttaaccacaataattttgtctattaggcctttaaaagtactgaaagatgaaatcaaagagagtaaaatgtgacgaaaccgtgacgtttcctagggcatttttctaggagaattaaattttcccttctaaagaaaatttcatgtgctgcaatgattttctacattatgccattttacgaacccatagagagtattgcttctatttttaaaaattttcgcatttctcgctaaaagttttaccttggaaaagttgggataaatatagcaaaatagattttctaaaaaacgcaacttgattcaacnnnnnnnnnnnnnnnnnnnggttatctcatatatgacattttcaacaaaaaagaataagggataaaagcgtggttaatcttcatactgaaatccgccggtctanaataccaacattatttttcgacacagtcggaagaatatttggtttacaatttgcttttctcaaatctaccttatcanattaattttacaattaaatatcatttttctacaatcacttgataaagaagactttttcgcttggtcattgcaacgaaaagttgacgtttacagagtaccgacactttatcgctctagcgcgtaaagttttattttacgcgcgttgtccgtagcaaccgtacaaccataccatacaaacacattgaacattttaacaacgacataatgatataaaatagttacaataaagggacctgcttccaaacctagtttcattttattaagtggttgg

SEQ ID NO: 12397 - DNA, 956 bp, Diabrotica virgifera
  misc_feature (905)..(905): n is a, c, g, or t
  misc_feature (928)..(928): n is a, c, g, or t
tattaatgttgcagaacattgtgaatcttcatcagagaaaaattcttcaacaaataatttgaaaagtggaaaaaaggctgatacagaagaacttagtcatgttcatgaagaaactgataatatatctaaatccaaatcaaatgatcaagatgattctattaattctggagataacaatgatgaagaatcaatcaatataattgaacttgactcaactattgaacatgatcaaactattgaaagtagtagtcaaaaatctgtagaatatacaaaattggataaaaataatacagatgtgattaatcattctgaatcttcaacagagaaaaaatcgttaacaaaaaatttgaaacctggaaaaaatgcagatacagaagaacttattaatgttcatgaagaaactgataagatatctaaaaccaaatcaaatgatcaagatgattctattaattctgaagataacaatgatgaagaatcaagcaatataagtgaacttgaattaacttttgaaattgataaaactattgaaagtagcactcaaaaatcccccgaacacacagaatcagataatattaatcatatagatgtcactaatctttgtgaatcttcatcagagaaaaattcttcaacaaataatttgaaaagtggaaaaaaatgcagatacacaagaatttagtaatgttgatgaagaaaatgacatgaattcaacaaacataaataatactaaaaaatttcctactgatgcacttactcaaaaacgaaagaatgatgaaaaatcaaatgattttgacgaagaaagtaacaaaagtggcattacaaataatgaaaagcaattaagtggtttagaggacaaaagtgacagaccaattgatacccaagaccagcataatacagtaactatcganttatctagtagtcagaccatganagagtcccccagttcgaagtcacaaaaa

SEQ ID NO: 12398 - DNA, 998 bp, Diabrotica virgifera
  misc_feature (515)..(532): n is a, c, g, or t
cggacgcgtagggggaaaaattaactgaaatcgaaattcacacagaaatatctaaatcagtcatattcacttccaatggatccagtttcaatccgaaattgtacaaaagtgtcgaaatggcagcttcgtcctttgctgtttccggtagtagaagagtcagcattgttttatcggaaaataagaggaaagttaagttattcgaaatggaagctgaagaggaggacgatgaagaggctgatgccagtagcagcatgttgaaagatgatagtgtgcaggaaaatgtagctgaataaaaatattagaagttattttggaaaattttcgcaataaaacaaaggaacataagatcaccgatgcaattctatatttcgctcatccgaaagaaaagtgtcacaacttaaaagacaacttttttcgggagagacaaaaattgatttattagatcttaatttagctgtcagtttcaaacggcaactggtaaaatttttaaatcaaaaacgaagaatatggataannnnnnnnnnnnnnnnnngctgtgatatctgatctaacaaaaaaaaaacagatcacattttgagttatgtcacttttcttttaaaatattgatcacttttttgaacattaacaaaaatacccaggacacttctcgaaatacaacggttttcgtgataaataaccatactttcacgtcgaacatcagagcataacctcaaaagtgtcattgtttccgaataaaaatattcattttactgccaaatgaataatgaccgtacagccatcttacgaagttagaagtagtctatgtgacacttttcctggtaaaagtataggatttttggagtcattttaacaagatatctggaaaaatgcattttttgaagtgtgccacttttcttcctgacgagcgaatttatggttttcttaactttttaacacagattttacatgatggtatttaaatctatcatttattttgtattcataaaaaattttttaaa

SEQ ID NO: 12399 - DNA, 132 bp, Diabrotica virgifera
  misc_feature (43)..(65): n is a, c, g, or t
  misc_feature (95)..(126): n is a, c, g, or t
gttaataatatagctgctacaccaattataaagtctgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12400 - DNA, 67 bp, Diabrotica virgifera
  misc_feature (6)..(66): n is a, c, g, or t
gggggnnnnnnnnnnnnnnnnnnnnnnnnnnnnnnnnnnnnnnnnnnnnnnnnnnnnnnnnnnnnnc

SEQ ID NO: 12401 - DNA, 835 bp, Diabrotica virgifera
  misc_feature (135)..(166): n is a, c, g, or t
  misc_feature (278)..(297): n is a, c, g, or t
  misc_feature (396)..(411): n is a, c, g, or t
  misc_feature (413)..(425): n is a, c, g, or t
  misc_feature (474)..(492): n is a, c, g, or t
ctaccagcgtccggactagttctaggtcatagagttcacactggacaaatatcattgttctctcttttcattggtactccttctacttgtgccttctttgacataggaaagcaataattaataacatataattcnnnnnnnnnnnnnnnnnnnnnnnnnnnnnnnncctaattcttataaaaaaatggttcttaaatgggaaaataaattcttcattagtgcttcactattcagtcggaagtcaaaatacaattattgtagtaggtataggcaattannnnnnnnnnnnnnnnnnnngaatatctaaacaaaattcactattagttggcatttatatacatagatttataatactctagattgcgccttacatttcagaactctttgtctttatgnnnnnnnnnnnnnnnngnnnnnnnnnnnnngacctttgaacaaaggttcaacaagtggttgtcatgaaacaagctatgnnnnnnnnnnnnnnnnnnntttaagttacctgggcaattccagaacccatcaatccacctccgataactgtaacattttttataacgtttaaggttgaactggtagaaaaacaccttttagcaatattggaaatagtggccatcgtataggaagtagtaagaagtatttacacaaacaaacaacaacttacaaccccggcaaactccagacaaaaacagtaaattgattattatccactccacgtaggatgggttgtataactttgtatattggagtttggactttgcacagactacacaccaatatacaatacaaacagctgacgacagaggcgtatactgtagtaaatgaagggcgtatt

SEQ ID NO: 12402 - DNA, 915 bp, Diabrotica virgifera
  misc_feature (703)..(703): n is a, c, g, or t
gagaaatttaatttagatgtacccagtgctaatacgaatactatgtttaaaatgttcgaaccaaagaaaaaggacaatccgtcatctaagcaactgtcatatatagttagtttcactgatccaaatctggagatacctcaaggacctaaggaacctatatttaagattgtccaggaaaggtgcttagaagaaatttatgaaaagataaagcagcttttcgatgagaggccaatgtggaccaaagctgcaattcaacacaaaatcgggttcactaacgagatgtctaagatattactaccggcaaacgcttacttatggtcaactggtccgtggagaatgatatggactaggcttggttatgatcccagagttgacctgagcagtagaatttatcaaattttagattttcgaatcagagaaagtgaaggaacaaaaatcatggtcaggctaaacgcgctgcttataggaaagacatattacatcccaaaatggacgaaagtcactacatcttgagaccagacacaattccacccgccaggcaaatgttttatcagttttttgatgtactcttacccgaaattcaagagatgatgcagagattaccgaaagcccaggcaaaattagatgtaaagaatgggttggttgcctgttaattttttagatcaatgtcgagaaatagcaaacaaatatgtaatgaagaacngtacaccagcagttggtcgcttacagcttaaaaaccgcacaaggacaacaggacaaagaagaatccgaagaagacgatgaagacaatcccgtggcttattcccagtaggatgttaagccaaatgaagatcgggttcaaaaggagcttcggtggagctcaggtcgaggacatcacggaactgtcgttttgtcctcagacgatgacagtgatgc

SEQ ID NO: 12403 - DNA, 232 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(229): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnngat

SEQ ID NO: 12404 - DNA, 173 bp, Diabrotica virgifera
  misc_feature (2)..(33): n is a, c, g, or t
  misc_feature (44)..(110): n is a, c, g, or t
  misc_feature (123)..(144): n is a, c, g, or t
cnnnnnnnnnnnnnnnnnnnnnnnnnnnnnnnncttcatcgggnnnnnnnnnnnnnnnnnnnnnnnnnnnnnnnnnnnnnnnnnnnnnnnnnnnnnnnnnnnnnnnnnnnccaattctttttnnnnnnnnnnnnnnnnnnnnnncccttaaagggaaaaccagggtaaatttt

SEQ ID NO: 12405 - DNA, 945 bp, Diabrotica virgifera
  misc_feature (885)..(905): n is a, c, g, or t
ccttacgcgtccgaaacaaagtaaaatttcccatagttagtgagtgatttttatatggacgcactattttgtataaaaaaaaatgaactgaacatgttcttcgaagtttattggaactgattattttgcagatatgggatcgagcatgagtaatgacaaagtgcaacctagtggggtaaacaaatttaaagacttccagaaatctgaatcagaagatagcgaacaatacaaatcaaaaaatcgaagttcaactgatgtctgttttttaatagtatttgtagtattcttaacagctctgatatgttttttggcttactgtttttttaatggagatatattcagaactataaatggttacgatgattgtggaaacatatgtggaagaaacaataaaaatctaaaacgtttagacaacaaaaataactctttacaatgtctagggaccagtaaaattaacgaaccataccatatagtattacgaaaaggttcagcaaaggaatttaatagattatgcatatcagattgcagtttgtacgaaggatacaggaagtttttcaatcgatgtatgccaaataaaagtcagacggtggtgaacacaattttttccaggactggactgagtaacttttttacagaagtatcagaagactttcaaatatgttggactgaaatttgttacctctgccttattgctttagtattatcatctttgctcctagtattattcagatacctagtaggagtggttgtatggataacacttcttagagttatttgaccgacctgttaaaagagaactacttcctttaccccgctatacccccccctctcaccccctcttttactacccctagttttttatcttttttttctcttccctctttnnnnnnnnnnnnnnnnnnnnntattgtatttttttgcccctattttcctcccccccccccc

SEQ ID NO: 12406 - DNA, 929 bp, Diabrotica virgifera
  misc_feature (2)..(50): n is a, c, g, or t
  misc_feature (52)..(896): n is a, c, g, or t
  misc_feature (898)..(922): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnctaggga

SEQ ID NO: 12407 - DNA, 884 bp, Diabrotica virgifera
  misc_feature (2)..(805): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagaacaccctatcgagttctcctcaaatttatcccccacttcttttttatcaccccacttatccccccccccccccc

SEQ ID NO: 12408 - DNA, 85 bp, Diabrotica virgifera
  misc_feature (2)..(14): n is a, c, g, or t
  misc_feature (17)..(32): n is a, c, g, or t
  misc_feature (59)..(79): n is a, c, g, or t
cnnnnnnnnnnnnngcnnnnnnnnnnnnnnnncaacccactttattttaatcggcggcnnnnnnnnnnnnnnnnnnnnncttttt

SEQ ID NO: 12409 - DNA, 350 bp, Diabrotica virgifera
  misc_feature (12)..(30): n is a, c, g, or t
  misc_feature (32)..(58): n is a, c, g, or t
  misc_feature (68)..(99): n is a, c, g, or t
  misc_feature (101)..(126): n is a, c, g, or t
  misc_feature (137)..(178): n is a, c, g, or t
  misc_feature (321)..(348): n is a, c, g, or t
atttattttagnnnnnnnnnnnnnnnnnnntnnnnnnnnnnnnnnnnnnnnnnnnnnngataggtagnnnnnnnnnnnnnnnnnnnnnnnnnnnnnnnncnnnnnnnnnnnnnnnnnnnnnnnnnnggaatcagggnnnnnnnnnnnnnnnnnnnnnnnnnnnnnnnnnnnnnnnnnngaagagctaaacaaatacaaattttattgcaagatacatattttaaagactttttttgtaaaggaatgtaattcgatttctaatattacgataccaactggaatcagattagatttattacatcatgaatatatttatagatnnnnnnnnnnnnnnnnnnnnnnnnnnnnga

SEQ ID NO: 12410 - DNA, 1083 bp, Diabrotica virgifera
  misc_feature (12)..(12): n is a, c, g, or t
  misc_feature (229)..(249): n is a, c, g, or t
  misc_feature (800)..(827): n is a, c, g, or t
  misc_feature (913)..(928): n is a, c, g, or t
  misc_feature (931)..(945): n is a, c, g, or t
  misc_feature (959)..(981): n is a, c, g, or t
  misc_feature (1008)..(1036): n is a, c, g, or t
tctataggggtnccgggaattcatacacaaattaggaatattacatggattagtattttcaaaatcggaaaaataattaaagagggaatgcagaacagctaaatcgccaggcacttgtttgtaagggacttctaaagcacaatttaattactgcttttgtacattgtaattgtttgtataataaaagattgtctaattatattctcacattttgatatttactgtctannnnnnnnnnnnnnnnnnnnngtaatttgtatattgagtatattgaggtgtatagcattttggttataatgccatgattggattaaataaaattagacccatcgaaattattgtgcaattatttttacggttcaaaaagggaaaattaaagtaaagataatagaaagtaacccttccatcactttaaaggccctccatgggacacttcaatttacgtggtaccttacagcgtatattgctatccgacaatcgcaaaactcgcccacttcgagtgattgttcgaaaccctcaatgagcttgataagttcgaagtataactaacataagtacgcttcccctccaaagtactttcccccccccctgttctccaaccatcgctcatccatcaatctttcttttttcctttttcgacttacgcccccactacccgccctcaaaaggcacgctctaccccacacaaacaatctaacgacccataacttctctgacagtccctattttatttatgatttcttcatcctaccccactatcgtctcccccgaccccccccgcgcccttattcttctgtcgnnnnnnnnnnnnnnnnnnnnnnnnnnnnccatgaactaccgctctcctctttatttccctctttcccttcccccctttttctcccccttcttcttgtttccgcttgttctttgnnnnnnnnnnnnnnnnatnnnnnnnnnnnnnnnccctccccccacannnnnnnnnnnnnnnnnnnnnnntccacctacgcgttttttttccttctnnnnnnnnnnnnnnnnnnnnnnnnnnnnnttgttactttttctcgtctcatcgctccctcctctctatttccctcc

SEQ ID NO: 12411 - DNA, 763 bp, Diabrotica virgifera
  misc_feature (14)..(14): n is a, c, g, or t
ccttaggggtccgnttacgcttatctagaactgatttgatcctgaataggtactttcatatttcttacaatgaaaccccagttaaatagttcaataaatccagcatataggcaatcgggttaatattcgtaatctgtgctaatcatttcctgcaaagtgaatcagttcaattacaatcaaccaagtataatacatacctacacgtgtttgtgtttatttcttatccatgctaatgtgatcggtaaaaatattagattggaaaatgttttagttttctttaatattttagtattttcttgctgtttcttctttgatttacaaaaatgtcttataactatgagagctgcgctgctatcgtacctcctgaaactggcaagggtacgccaaccacgtttaataagaatagaaggattagagccttaactgcctattggattcttgggttatgcaacaattatggatatgtagtcatgttgacagcagctaacgaaatagtgaacaaagaaacaggtggtgataccccccctaaagaggaaactactgctcgagactgtacatatttatcaacaggtgccatattattggccgacattttgccaggtttgattattaaagtaattgctccctttttgcctttctttgtgcacttaagagtagcaatatgtgttgtccttgccgcttcaggatttttgtgtgttgcctacagcgaaaccttggttatcgcattattaggggtagttattgactcattggcatcggcgcc

SEQ ID NO: 12412 - DNA, 612 bp, Diabrotica virgifera
  misc_feature (11)..(12): n is a, c, g, or t
  misc_feature (15)..(15): n is a, c, g, or t
  misc_feature (19)..(19): n is a, c, g, or t
  misc_feature (25)..(25): n is a, c, g, or t
  misc_feature (28)..(28): n is a, c, g, or t
  misc_feature (31)..(31): n is a, c, g, or t
  misc_feature (50)..(51): n is a, c, g, or t
  misc_feature (61)..(61): n is a, c, g, or t
  misc_feature (64)..(64): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (80)..(80): n is a, c, g, or t
  misc_feature (90)..(90): n is a, c, g, or t
  misc_feature (124)..(124): n is a, c, g, or t
  misc_feature (135)..(135): n is a, c, g, or t
  misc_feature (138)..(138): n is a, c, g, or t
  misc_feature (146)..(146): n is a, c, g, or t
  misc_feature (148)..(148): n is a, c, g, or t
  misc_feature (156)..(156): n is a, c, g, or t
  misc_feature (169)..(170): n is a, c, g, or t
  misc_feature (172)..(173): n is a, c, g, or t
  misc_feature (176)..(176): n is a, c, g, or t
  misc_feature (191)..(191): n is a, c, g, or t
  misc_feature (198)..(198): n is a, c, g, or t
  misc_feature (204)..(204): n is a, c, g, or t
  misc_feature (206)..(206): n is a, c, g, or t
  misc_feature (214)..(215): n is a, c, g, or t
  misc_feature (219)..(219): n is a, c, g, or t
  misc_feature (222)..(222): n is a, c, g, or t
  misc_feature (238)..(238): n is a, c, g, or t
  misc_feature (242)..(242): n is a, c, g, or t
  misc_feature (244)..(244): n is a, c, g, or t
  misc_feature (247)..(247): n is a, c, g, or t
  misc_feature (263)..(263): n is a, c, g, or t
  misc_feature (272)..(272): n is a, c, g, or t
  misc_feature (277)..(277): n is a, c, g, or t
  misc_feature (281)..(281): n is a, c, g, or t
  misc_feature (284)..(285): n is a, c, g, or t
  misc_feature (298)..(299): n is a, c, g, or t
  misc_feature (302)..(302): n is a, c, g, or t
  misc_feature (324)..(324): n is a, c, g, or t
  misc_feature (326)..(326): n is a, c, g, or t
  misc_feature (336)..(336): n is a, c, g, or t
  misc_feature (339)..(339): n is a, c, g, or t
  misc_feature (348)..(348): n is a, c, g, or t
  misc_feature (350)..(350): n is a, c, g, or t
  misc_feature (358)..(358): n is a, c, g, or t
  misc_feature (367)..(368): n is a, c, g, or t
  misc_feature (370)..(371): n is a, c, g, or t
  misc_feature (387)..(387): n is a, c, g, or t
  misc_feature (408)..(427): n is a, c, g, or t
  misc_feature (500)..(500): n is a, c, g, or t
ttcctggggtnnggnaatngggagnttnttngtagttagtcttttgtgannagaggttaangtnatnaagaangttnagngatggtgttngataggaagtggtttattatattgatatgtttanttgttgaagtntgnagtagaangnaattgaangataatggagttnnannatnagtagattttaggtnaagtganaaaatnanattaattnnattntanggaggaggaaaagganaatntnttnaaattatagaaaagtnagatggttnggttnatanatnnataattaagaagnnaanaaaagatgaagaagatgaaagnangggtataganaanataattgananatttgagntagaaaatnnannggttggatgaaaattngatttagaagattttggaagnnnnnnnnnnnnnnnnnnnngttatggtgagaagataatatggttagaagaaattattaaagagaaaggaaaattaagtgtaggttacgaagnagtgtataaagaaaatatggggagattatgtttttctgtcttaggattggatgaaataagagaaagaaagtaatgttatggtagtagaaataagagaaggtagaagtgtttt

SEQ ID NO: 12413 - DNA, 52 bp, Diabrotica virgifera
atgaggggtggctagtatagcttcggattttctgcttttaagagagaagaaa

SEQ ID NO: 12414 - DNA, 705 bp, Diabrotica virgifera
  misc_feature (21)..(21): n is a, c, g, or t
  misc_feature (23)..(23): n is a, c, g, or t
  misc_feature (42)..(453): n is a, c, g, or t
  misc_feature (456)..(477): n is a, c, g, or t
  misc_feature (537)..(577): n is a, c, g, or t
  misc_feature (580)..(593): n is a, c, g, or t
  misc_feature (616)..(678): n is a, c, g, or t
  misc_feature (685)..(704): n is a, c, g, or t
tcacggcggccgattttttgnancttgtgtatgagggattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncannnnnnnnnnnnnnnnnnnnnnggtttaaaaaaggaaattcgcaaaaactttttttcccccggtttaataaaaaacagggcnnnnnnnnnnnnnnnnnnnnnnnnnnnnnnnnnnnnnnnnntgnnnnnnnnnnnnnnggcccccgggtttttttcccccnnnnnnnnnnnnnnnnnnnnnnnnnnnnnnnnnnnnnnnnnnnnnnnnnnnnnnnnnnnnnnntggctcnnnnnnnnnnnnnnnnnnnnc

SEQ ID NO: 12415 - DNA, 133 bp, Diabrotica virgifera
  misc_feature (7)..(44): n is a, c, g, or t
  misc_feature (79)..(101): n is a, c, g, or t
  misc_feature (109)..(130): n is a, c, g, or t
taacagnnnnnnnnnnnnnnnnnnnnnnnnnnnnnnnnnnnnnntggaacctcgatgttggattaagtttataattggnnnnnnnnnnnnnnnnnnnnnnntgttcgannnnnnnnnnnnnnnnnnnnnnagt

SEQ ID NO: 12416 - DNA, 889 bp, Diabrotica virgifera
  misc_feature (100)..(119): n is a, c, g, or t
  misc_feature (590)..(611): n is a, c, g, or t
  misc_feature (665)..(682): n is a, c, g, or t
gttgtaatgtattggatttttagtagaatcagcacgtattttataagggtgcagacaatttctcatattttttaagttgtcattaaaccaatttacaggnnnnnnnnnnnnnnnnnnnnccaatgtttttagtggaaaataatgagatactgcataattataattatctattaaaaacgttgctaagcaatctacatcaaaatcactatcaaaaatgttccagtcgaaccctgataaaaagtttctcattttcaaaaataccttcctgtgtaaaggctctagtgcaaacacttgattttaatttatttgatgatttgcttaaattaatatactgtccgcgatggtctgaaaaacaaggttcagggacatttgtctgaaactgattttcttcaaaatttgtcataatattgtatatacaagtggcagatgtagcagtaactcgagtatagtcataaattgtttgttttataccaaaagatgatgttatagaagtcaattcactaatgtttggcgtttttcctttaaaattgatattaaaatctcccaaaatcactacattcaaatttggcctcataatgtgatccaatagnnnnnnnnnnnnnnnnnnnnnngacttaaaatcgttacatttactagatctatacactaccaatacaacagtgttnnnnnnnnnnnnnnnnnntccacaaaattcacatgtttgttcaatattaaaactatcgcagtttatagcttcaaattttaaagtgtttttaacatagattacagtaccaccgttctttttattcttcctacagaaactgctagcaagtaaatacctatcggatatttatgtatctgagatttgcttcactctgccagtgctctgagaagcagacaacgtcaaagt

SEQ ID NO: 12417 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12418 - DNA, 890 bp, Diabrotica virgifera
  misc_feature (38)..(51): n is a, c, g, or t
  misc_feature (53)..(71): n is a, c, g, or t
  misc_feature (90)..(110): n is a, c, g, or t
  misc_feature (141)..(166): n is a, c, g, or t
  misc_feature (168)..(186): n is a, c, g, or t
  misc_feature (195)..(219): n is a, c, g, or t
  misc_feature (222)..(234): n is a, c, g, or t
  misc_feature (236)..(258): n is a, c, g, or t
  misc_feature (264)..(358): n is a, c, g, or t
  misc_feature (382)..(445): n is a, c, g, or t
  misc_feature (448)..(466): n is a, c, g, or t
  misc_feature (468)..(500): n is a, c, g, or t
  misc_feature (511)..(539): n is a, c, g, or t
  misc_feature (544)..(569): n is a, c, g, or t
  misc_feature (571)..(584): n is a, c, g, or t
  misc_feature (586)..(625): n is a, c, g, or t
  misc_feature (627)..(640): n is a, c, g, or t
  misc_feature (653)..(688): n is a, c, g, or t
  misc_feature (690)..(708): n is a, c, g, or t
  misc_feature (713)..(802): n is a, c, g, or t
actcttatttattcccaactaataaaaccttttctacnnnnnnnnnnnnnncnnnnnnnnnnnnnnnnnnncactagcattgtgagaccnnnnnnnnnnnnnnnnnnnnncaactttattttttgtacctcgtgtatcccnnnnnnnnnnnnnnnnnnnnnnnnnncnnnnnnnnnnnnnnnnnnngacctaacnnnnnnnnnnnnnnnnnnnnnnnnnccnnnnnnnnnnnnncnnnnnnnnnnnnnnnnnnnnnnntatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagggatgaccttaaacataacnnnnnnnnnnnnnnnnnnnnnnnnnnnnnnnnnnnnnnnnnnnnnnnnnnnnnnnnnnnnnnnnccnnnnnnnnnnnnnnnnnnncnnnnnnnnnnnnnnnnnnnnnnnnnnnnnnnnnatatacatttnnnnnnnnnnnnnnnnnnnnnnnnnnnnncattnnnnnnnnnnnnnnnnnnnnnnnnnncnnnnnnnnnnnnnngnnnnnnnnnnnnnnnnnnnnnnnnnnnnnnnnnnnnnnnncnnnnnnnnnnnnnncattacatatacnnnnnnnnnnnnnnnnnnnnnnnnnnnnnnnnnnnncnnnnnnnnnnnnnnnnnnnctacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaatagcttacattttttaaagaccagagaccctatagagattataaatatcataagacttttacaacaaacttattaaataaaaatt

SEQ ID NO: 12419 - DNA, 826 bp, Diabrotica virgifera
  misc_feature (30)..(47): n is a, c, g, or t
caggaagataagtaaataatctgatgtggnnnnnnnnnnnnnnnnnngtaaactctagttttttttataatgtcttgatagaaattgaatgataacatggcgtaccagactttaaggaatgagtacatgaatatgcccccggtaacgagggcatataccactgcttgtgttattacaaccctagctgtgcaactggaattggcctccccgtttcaactctattttaatccaatcttaattgtgaagcaaggtcaactatggaggctggtaacaacattcctgttttttgggacatttggcttcaacttttttttcaatatgattttcacatatcgatattgtagaatgttagaggaaggttcatttagaaataggacagctgattttgtattgatgttcctctttggagcagcttgcatgattggttttgcattttttgttaacttattattcttagggcaggcgtttacaataatgctagtgtatgtatggtctaggcgaaacccatttgttggattgaatttctttggactcctgaattttcaggcgccatatttgccgtggattctcttggcattttcgataattttaggaaacgcggtgtgtttctctacacggtcacagtggtcaactgtgaaaaatttggctttggtgggttcaaggagatttttcaacgctgcctctccgtctatatgtagttacaaacgttataaaactaatacatgcgtttatgtcgattgaaatgtgtttattcctatcccggtgttttgttttgatacaaatgattttccgggtttgtaattcgcgatttggcattactttcttg

SEQ ID NO: 12420 - DNA, 902 bp, Diabrotica virgifera
  misc_feature (739)..(768): n is a, c, g, or t
  misc_feature (791)..(809): n is a, c, g, or t
  misc_feature (822)..(843): n is a, c, g, or t
atgtcatccaacgaatctgctgcctacgaaattatgacagctttagacgtcgattatgtattagttatttttggcggtgtcatcgcttttcccaccaaagcaatgtgactgttattccacgtgttattatcaaccagagtagtcctattgctttggtgggaaaagcgatgtcatccaacgaatctgctgcctacgaaattatgacagctttagacgtcgattatgtattagttatttttggcggtgtcatcggatattcaggtgatgatattaataaatttttgtggatggttcgtatcgctgaaggagaacatccaaaggatatcagggaaagcgattacttcacggaacatggtgaatttagaatcgacgccgaaggttctcccacattgttgaactgtcttatgtacaaattgagctattatcgatttggaaattgaaattagactacagaagtcccgcaggatttgaccgtactagaaacgccgtcattggaaacaaagatttccagctcaattacttagaagaggcttatactaccgaacattggctcgtaagagtatacagggttaaaaaaccagatgaattcaacagacctagaatccccgttgcaaacatagtagttaaaacgagtaactacgtatcagaaaagaatactaaacgtaagaaggggagtattaaaaccagcccattatagttaatggagagagactgtctacaaaactatagattacgatcnnnnnnnnnnnnnnnnnnnnnnnnnnnnnngtttgttctcgttattgttttcnnnnnnnnnnnnnnnnnnncttttactttaannnnnnnnnnnnnnnnnnnnnngaggggatttaacctactgatttcccttttttttaaagggttctttctaaaagaacttt

SEQ ID NO: 12421 - DNA, 159 bp, Diabrotica virgifera
  misc_feature (24)..(37): n is a, c, g, or t
  misc_feature (40)..(62): n is a, c, g, or t
  misc_feature (70)..(92): n is a, c, g, or t
  misc_feature (122)..(153): n is a, c, g, or t
agattgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12422 - DNA, 911 bp, Diabrotica virgifera
  misc_feature (118)..(151): n is a, c, g, or t
aaaataagggttccatttttattcagttgcaatgtgaaggcaaaagaatcttatttttcacttagaatacggagggctgggttgttttgccttcgcattgcaactgagtaaagatggnnnnnnnnnnnnnnnnnnnnnnnnnnnnnnnnnncccgtgactccaattgaactaaaaaatacagtctatcaactaaaaaataagcctagtactggtattgataacatatctgtaaaaataataaaactaataagtgatcatacatatatcgaatccttttacccatttagttaatctctcaataacagccagccaatttccatccatatttaaaatggcaaaagttattccaatcttcaaaaataatgaccctcatgatatttcaaattatagaccagtatctgtccttagcgtaatttccaaagtaatagagaaggttgtatacaacagaatgttaaattttatagaagaatacaatttattaactccaaaccaacacagatttagaccaaaaaagtcgacactcacggctgcatgcagcttgtttgagcgtatttatgatgaattagatagtagaaaccacgtggcaggactattttttgatctatcacgagcttttgactgcttagacataacatttattcgcaataaattatataacgttggttttagagggatatttctagaatgggtaataaatttcttaagtggcaggaagagtgttgttaaaattaaagaatcaagctcagaaccatacacgacaaataaaggagtaccacagggatccgtgctgggaccattattattccttaatttttattaacgacctaccagatcacacaaggtgcacttataatagcaatatttgctgatgatacctcgttaataatctctgcaccgaacctcgaggaat

SEQ ID NO: 12423 - DNA, 819 bp, Diabrotica virgifera
  misc_feature (282)..(299): n is a, c, g, or t
  misc_feature (739)..(756): n is a, c, g, or t
  misc_feature (800)..(800): n is a, c, g, or t
tcaatgtataatttttattttcgcctaatttttcagggatcaaaagacgcaaacaaaacatctttatacgtatattcaaagaataatttgtattaagcaaaccttagtcaatacaggtgattctggatatgctctaagtcagttgatgttgacatccatccaaaatgcattgcctgctactctagaagaaatattcatcacagaagaactgaatcccctatagagagatgcaatgggattttaaaatggaggcatagaattttacactccaaccatggctgnnnnnnnnnnnnnnnnnngcatgcactgtgctgcacaatttgtgcattggtatgcataatgtaccccctattggtttaggtgatgaagaaaacaatcatatagatattgattatggacatgtcaatggaataaatatagaaggtagaattcgtgatagagatctgctcacaggaagaagactccaacaaatgctaattcaaattaattttagaaattaattcagtaagtttggaaaaatgtatgttctgtgttatttgtactttatgtaaatattgttctgaagctattttcttgtttcctatctaaatagttgattatgtaaatatgtagtgtgttagctgttgttttatgaacaacataaaacattatgtgaaatattgactgtatgttatccatgacacagaacagaagttaaaatgcatgtttttacatttgtagcctttgaataccttagtcnnnnnnnnnnnnnnnnnnggcaagaaatttatgcctcagtaagttggaaccatggacggacngggaccccctgggggtttg

SEQ ID NO: 12424 - DNA, 333 bp, Diabrotica virgifera; identical to SEQ ID NO: 12194
  misc_feature (6)..(28): n is a, c, g, or t
  misc_feature (219)..(292): n is a, c, g, or t
  misc_feature (297)..(331): n is a, c, g, or t

SEQ ID NO: 12425 - DNA, 56 bp, Diabrotica virgifera
  misc_feature (2)..(18): n is a, c, g, or t
gnnnnnnnnnnnnnnnnncatatagaagtctcgcctgaccactgattagtttgaat

SEQ ID NO: 12426 - DNA, 935 bp, Diabrotica virgifera
  misc_feature (18)..(43): n is a, c, g, or t
  misc_feature (53)..(890): n is a, c, g, or t
  misc_feature (892)..(931): n is a, c, g, or t
cttcagggcctcgtccgnnnnnnnnnnnnnnnnnnnnnnnnnncttaccaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnngggg

SEQ ID NO: 12427 - DNA, 847 bp, Diabrotica virgifera
  misc_feature (16)..(608): n is a, c, g, or t
  misc_feature (615)..(652): n is a, c, g, or t
  misc_feature (672)..(685): n is a, c, g, or t
  misc_feature (688)..(710): n is a, c, g, or t
  misc_feature (718)..(740): n is a, c, g, or t
  misc_feature (747)..(747): n is a, c, g, or t
  misc_feature (770)..(801): n is a, c, g, or t
  misc_feature (804)..(804): n is a, c, g, or t
  misc_feature (808)..(841): n is a, c, g, or t
cctccccggcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnnganaggnnnnnnnnnnnnnnnnnnnnnnnnnnnnnnnnnnaatatt

SEQ ID NO: 12428 - DNA, 948 bp, Diabrotica virgifera
  misc_feature (17)..(59): n is a, c, g, or t
  misc_feature (513)..(529): n is a, c, g, or t
  misc_feature (617)..(665): n is a, c, g, or t
  misc_feature (857)..(857): n is a, c, g, or t
ggataacgaaaaggagnnnnnnnnnnnnnnnnnnnnnnnnnnnnnnnnnnnnnnnnnnntagaaaatgacgaagaaaccgttaatgcttttaaacaattatcaactttctacacagaaaatagtttacaagctcgtaggaacttgagaagtcaaatagaaaaaagaagtttggatgtgaacaaacaattcttgaggtcattccaagaagtaaagcatgccttcgattcaatttacaatgatatagcagacatgagtaagtccatacaggatatggaaagtaggttacagagtacaaaatccagaactaagcatttgcttcaacaaactagtgtgctgcaaaatgaaagggaaagaagcatcaaccaacaaaaaattgtgaatgttctcctagagagatttcaactaacttcagagcaactctatatcattcaaggaaataaggagtttttattgactcctgaaatatttaatgtactagataagatccaagaaatacgcaatgattgtaaaannnnnnnnnnnnnnnnncttcaaacgttggctttagatattatggagcaaatgaccacatatcaggaggcagggttggaaaaattatatagatggacccaaagtnnnnnnnnnnnnnnnnnnnnnnnnnnnnnnnnnnnnnnnnnnnnnnnnncaatggcaaggcttcaacacagacaagttttgtttaagtatgtaatcgatgaatactgcatatgtcgcagaagcaagataactgatgattttatcaacgctctaacacgaggagggccatctggaaatcctgctcctatagaaatgagagctcacgattctcagatctatgtcacagatatgctcgtttggntgacaaagcgattgctttggaaagcagaatgttagtttattgttgaaaatgtgcataaagtagagctagatgacattattaccgactcttt

SEQ ID NO: 12429 - DNA, 760 bp, Diabrotica virgifera
  misc_feature (595)..(615): n is a, c, g, or t
  misc_feature (725)..(742): n is a, c, g, or t
caaagctatatatgcacttgtatcaacactttttcaaaaacttagggaaattgaaactttattaaagaggtcacagcttttaattaaagaaactaagtttaacccatggctggcaaaagttttaatagtggaattattatggggtaaaacttaccttccaggacagagcaagcccgaaaatacaattcgtgcatatgagcaaatatttaaagcacatttaagtgactctacagttacagaaattgaacacaaagataagggcaataaaccacggtatgttcggataaataccttattttccaatttagatgaagcagtagaatcatttcgtgaagatggatgggtactcaatagattcttaaataaaaatgattacaatggatttttagaaataatttcatctttaaaagagggagaatttatgatagacattcatgttcccaacctgctagtttttcctcccaaaactgaattttatcgacacccagcttataagaatggatcaattattttacaagataaagtatgtgttttttggtgaattgtttatcatattggaaataagagattttgaagacaaatcgcgaaacaggtnnnnnnnnnnnnnnnnnnnnngtttttggtatatatatcacactactgacaaagtagtgaaataaaaataaggatagaggttgtgtgcaagctcatttaaaaaggttataattatttatgcagggttgccnnnnnnnnnnnnnnnnnnaaattaattgacaataat

SEQ ID NO: 12430 - DNA, 886 bp, Diabrotica virgifera
  misc_feature (93)..(114): n is a, c, g, or t
  misc_feature (499)..(525): n is a, c, g, or t
  misc_feature (685)..(707): n is a, c, g, or t
acccactagcgcagcgcaaagttaagatctagccgttctttctatttttgaatctgtgcttctgaattttttcttccattaaaaaaaccgcannnnnnnnnnnnnnnnnnnnnnttgttggcatgtgttgctgtatttaatgccgtaagcgcacttgattgctacacttgcaccgacgatgcctgcaaaaaagatgtaaaagaaatgcaaaaagttacgtgtggtaaacccgctgaccaaaatcaagaatccgtttgccaaaaagtaacatacaaaggcaaggatggcaaggaacacatcgaaagaaaatgtgcctatgctcccaagaacggagaggctcagtgtcccgcatccataaacaaagctgatgtaactgacctaaaatgcccatcctgtaaagctgatctttgcaactcagctaccaccatcaacttcagcctaacagcattcgctgcagtagtttttgccatcgtaggccaaaaattcttaatgtaaaacnnnnnnnnnnnnnnnnnnnnnnnnnnntacatgtcgctcctccggaagaaaactggcacaactcaaaaaacaacttttttgataaataatggaagaacatggatacgtgaatgttcataactgtgtaagaacaaaaacaaacacattttgagttatgccacttttcttccgaacgagcgaatgtgtnnnnnnnnnnnnnnnnnnnnnnngtgtttaagaactaaaaattgtaacgtttttgataaatgtgtatggtgtattaaaatgttgttttgctactatatttgtcccaaattattcataatgatatgaagaagctacttaaaaaaaccacatacgcatagaaattgcttttacttgtagacccattacctgaaattagattttg

SEQ ID NO: 12431 - DNA, 122 bp, Diabrotica virgifera
  misc_feature (5)..(24): n is a, c, g, or t
ggccnnnnnnnnnnnnnnnnnnnntagagaacggtgtatcctatcgagctaaattaggagtactttttagtactaaaataccttacattttaataatccagactcaaaaatgcttaacaatt

SEQ ID NO: 12432 - DNA, 898 bp, Diabrotica virgifera
  misc_feature (4)..(692): n is a, c, g, or t
  misc_feature (699)..(736): n is a, c, g, or t
  misc_feature (756)..(769): n is a, c, g, or t
  misc_feature (772)..(794): n is a, c, g, or t
  misc_feature (853)..(884): n is a, c, g, or t
ctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaattttacttgatttgagtttaacccggtgtgagccagggtgggtnnnnnnnnnnnnnnnnnnnnnnnnnnnnnnnncaaacggaccaaac

SEQ ID NO: 12433 - DNA, 458 bp, Diabrotica virgifera
  misc_feature (2)..(37): n is a, c, g, or t
  misc_feature (83)..(108): n is a, c, g, or t
  misc_feature (303)..(320): n is a, c, g, or t
annnnnnnnnnnnnnnnnnnnnnnnnnnnnnnnnnnnctaatattattatcataatatttagatcttttataagattctaacnnnnnnnnnnnnnnnnnnnnnnnnnntcatgatattatgataacattagtattaattaattgtaaatttagcgagatgatataggtacaatatatgcaatccctcaatatttttttcattgttaaataaaaccatgtgttttgtatttaatctcccccctccccgcgctcttgtttaattggattgtgccactattttgatcgccgcacgataccccactnnnnnnnnnnnnnnnnnncaactcggcacctgagctcaactcaaaataccctgtctttaatttcattccaacacattacttgttaggttaacaggccttatttttttcaaaacgcggtcagaacccctcccagtatttctccgatttttccacatc

SEQ ID NO: 12434 - DNA, 369 bp, Diabrotica virgifera
  misc_feature (188)..(256): n is a, c, g, or t
  misc_feature (266)..(285): n is a, c, g, or t
  misc_feature (290)..(311): n is a, c, g, or t
ccttctacgcgtccgttttttaaactaaaaaactttattctcctcttatttattagatgtcaaaaagaaggcatatgtaaggttagctagagattatgatgctctagatgttgccaacaagattggcatcatataaattaatatcttaccttgttttattttttttgacatctaataaataagttgannnnnnnnnnnnnnnnnnnnnnnnnnnnnnnnnnnnnnnnnnnnnnnnnnnnnnnnnnnnnnnnnnnnnaaggaagacnnnnnnnnnnnnnnnnnnnntaatnnnnnnnnnnnnnnnnnnnnnntcatgtatgaaatgtaaaagttaacaacataatctataattctcggaattactaagat

SEQ ID NO: 12435 - DNA, 910 bp, Diabrotica virgifera
  misc_feature (491)..(506): n is a, c, g, or t
  misc_feature (537)..(564): n is a, c, g, or t
  misc_feature (616)..(634): n is a, c, g, or t
accaaaattataacccaggaaggatattgaaaatattcagaacttttaggaacccagaaggacgcgaattcacccgcgtagaatacgtccggaagcaagtcgtgatagacgcctacgtcaaaattcgtatgaccaaagacgaagaattcataagacagttcgctacgttagacgaagcgcagaaggaagagatgaagagagagaagcgacggatacaggagcaactgaggcggatcaagagaaaccaagagaaggaaaagatgggaggtgggcatacgcatatgcattcgacgcctatcgtaccgcctgcagggactgcgattgaaaagttgccaaatccaagtgactctctttcgacacctgttacaccaacttctagtaagagtatgtcctcgtctcctcctaaatcaaggaggaaaaccaaactcaagccagatctcaaactcaagtgtggagcctgtggaaatgtcggccatatgagaacaaacaannnnnnnnnnnnnnnncaagccacaactggtcagaacccgcctattnnnnnnnnnnnnnnnnnnnnnnnnnnnnaagatatcgagaagcaaattaatacagacgatgaagatctcgtaaacgtagnnnnnnnnnnnnnnnnnnngtctggaaagttgttgaagaattactttcagcatgccgaggagattaagcgtaggagcttaatgttaaaagtccctaaggacgctttaggtaaccgaaaaagaagaagaggggtgcaagatttacattgtgattatttgaagaaacacaacaggccagcgaatagaagacgaacggatccggttgtcgttttgtctactattttagagaatatactcaatgaaatgcgagatatgccagacgtccagccttttcttattccctgtcaatcaaaaac

SEQ ID NO: 12436 - DNA, 859 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(796): n is a, c, g, or t
  misc_feature (799)..(845): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnctcatccctaaaaa

SEQ ID NO: 12437 - DNA, 809 bp, Diabrotica virgifera
  misc_feature (650)..(666): n is a, c, g, or t
  misc_feature (736)..(760): n is a, c, g, or t
  misc_feature (789)..(806): n is a, c, g, or t
cacggaaacgtcgaaacttaatttcatgaactcggggtttgaccagttaaaccccgaggatcaatggaagttttgtaaggttctagcaaagcaagagcaaggcacgtacacggtgtagtgaactgtatagtaaaacaattgatttaatgtgcacaaagttataaaagaaacattattcaaatgaatagttaactaaattcaaaattccagcacttaataacaaagttgccacgtactagtatcatgagtatcattttcccaagtagcaattttacgacctgcaaccaattttgtcctaatgggacgttaaatttaaggacaaaattggttcacaataagccttaaccaaggacaacgtctgtttttcctatggaccaacgttgctgctaataagtaatataatctgatgaccaaccgacatcgggaataacgacgtcaattattattataaggtttgacgttaagctgacgtcggtcttaacctatctgtagtataagtgcagttaagtggcatacaccaacgactatgcaacgatgccaacgttcagaggacgttggtgttttatcgagtatggtagacgtatttttcgggaagacgacaacgacaatccaacgttgagaataccaactttaattattaggttaaggtnnnnnnnnnnnnnnnnntcgggtataacctctatactacaatgtaatttactgaaagacttttaacgcctgcttcaacgttaaggannnnnnnnnnnnnnnnnnnnnnnnntttggaatttctcattatattatctaccnnnnnnnnnnnnnnnnnncac

SEQ ID NO: 12438 - DNA, 569 bp, Diabrotica virgifera
  misc_feature (2)..(483): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtttttattagaatataaatatatatggtaatataatttattgacgcttgttactattctgatgaagatattgtatgtatagaa

SEQ ID NO: 12439 - DNA, 593 bp, Diabrotica virgifera
  misc_feature (16)..(16): n is a, c, g, or t
  misc_feature (32)..(32): n is a, c, g, or t
  misc_feature (77)..(77): n is a, c, g, or t
  misc_feature (91)..(91): n is a, c, g, or t
  misc_feature (93)..(93): n is a, c, g, or t
  misc_feature (104)..(104): n is a, c, g, or t
  misc_feature (117)..(117): n is a, c, g, or t
  misc_feature (136)..(136): n is a, c, g, or t
  misc_feature (162)..(162): n is a, c, g, or t
  misc_feature (165)..(165): n is a, c, g, or t
  misc_feature (216)..(216): n is a, c, g, or t
  misc_feature (272)..(272): n is a, c, g, or t
  misc_feature (278)..(278): n is a, c, g, or t
  misc_feature (465)..(491): n is a, c, g, or t
  misc_feature (493)..(510): n is a, c, g, or t
  misc_feature (514)..(541): n is a, c, g, or t
cttctcctaggggtcncgaaatttacataaanatattatattatactttatataggaaatattttatttgttaatanattttgaggtatgntngttgtttatgnaataagttgtgtntaggattgaaaataaaatngaaaatgtagaattgattatattaanaanaaagaaattttggtagtattattaaataaggaagataaaatggataatagntgaatagtattttatggtattataaattgtatttagagaatgggtatatatgaaantaaagngggagataattggtgagaaggagattagaatgatttgagatttttgtaagatgagaaattttttttttatgtgttttgaagtgtggggaagatagatttttaaaaagattttgattagaagatataattggtaggtgaattatatatagttgtgtaaggatgaaatttattaaaagttaaagattgnnnnnnnnnnnnnnnnnnnnnnnnnnngnnnnnnnnnnnnnnnnnngttnnnnnnnnnnnnnnnnnnnnnnnnnnnngtaatggatgatgatatttagtagtatttaattgtatattttagtggatatg

SEQ ID NO: 12440 - DNA, 887 bp, Diabrotica virgifera
  misc_feature (766)..(782): n is a, c, g, or t
  misc_feature (784)..(806): n is a, c, g, or t
cccactctttctttagtgacgtatttgatgttctgaaacagaaaaactcattatatgtttccgagacccaatcagtatagaattcgagtattttattcctatcaaagaaacgacttcctttattaacatggcgtcccatcttatgatctataaacaattacacatgatcttctgtctgaatttaccgatgtacttacttaaattcctcatggtatcacatatgttttcgatgcttgtcttccttctcaatgtgatctctactcggaattcttgaattgtttcatgaactttgttatcttaatttgcaacgacatctttattgtacctactttatatatgattctaatgatacattcctacgtatctgccttgggagatgcttgaggtattttgataacattcctgacggattgtcatatcttcctatgagaactttttatatgaggttatatatttgtattcattatcaatcctatgatatatggatttactacttaaacatctttataatatattcttctctaataatgtcgcttttgttaataactgggaattgaaatactttcctgactgtttggatatctgattttgattccatcacattttctacactggcatattccttgatgggattattcaatattatatactgactcatctgcccactgatcaaattatatggacgcttaattatgaccgccgataggtagcatagtcattatattttttattgatatactgtaatgaaggtctggatgagaaatgnnnnnnnnnnnnnnnnncnnnnnnnnnnnnnnnnnnnnnnnctagcagcttagatttttttacaagacgagaacaccctatagagttggataaattacttaatacgtttttttagtattaat

SEQ ID NO: 12441 - DNA, 916 bp, Diabrotica virgifera
  misc_feature (14)..(904): n is a, c, g, or t
tccaccgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatttttttga

SEQ ID NO: 12442 - DNA, 710 bp, Diabrotica virgifera
  misc_feature (24)..(24): n is a, c, g, or t
  misc_feature (30)..(30): n is a, c, g, or t
  misc_feature (39)..(42): n is a, c, g, or t
  misc_feature (193)..(213): n is a, c, g, or t
cccctccgagggtccggtagtttngaaagngaagaggannnnacctttatacagtacacctctaagagaagaaacatgaaataggcagcaggatcatacgaaaccatggacaaccactgaccgcccaccccaatcacaaatatgccgtgccagacgaagcgacgaggaacaacggcaggaaaggatacttcannnnnnnnnnnnnnnnnnnnngacggcagggagcgaagaggaatcgacaagcgagctcaaaatcgccggacctaaaggagctgcaactgccacgactgcatcacaaaggggaagagctgaaataaaggcatctattgtgtaatcaccctaccaaacgtcgtaacgaccactactaccgcgcaataaagtgacggtagtggaaggtctcaggaaaactaacatacgccaaaatcctcagattgaagccactgactgggggcggtaacgggttgcgggatgcagagccttgtaggtagaggagcagttcagtctgaagaaggaacagttatgggtgacctcaagagcaagaaaggaatcgcgatcgaagggggaaaggagtccaggggtgtgtcagctagagaagtaaaagataccggaccacgtcccacaagcttagaacgtgtctacacatgcgtccctgtactgatatcacaaaacctgtgaccccgcagttcaaagcaccttctatgggaaaacaa

SEQ ID NO: 12443 - DNA, 711 bp, Diabrotica virgifera
  misc_feature (357)..(374): n is a, c, g, or t
  misc_feature (592)..(621): n is a, c, g, or t
ccttactcgtccgacgatcaccagaaatggaggattgctgggatatgggagtactttctttgttttatggaatatgatctcgatgactcacattatgaaactgaatactatggagcctgtgcaacctattccaatgcaatgatcgacccgactaaaaaacggcatcttaatgttgaattctgacaccatgcgaaattgttaaaatgtttaaatgcaaaaatggtaatcttgaactggctacattccaattgagtgatattgatatcgtaacagataaaaaataagcaaatatttgaccttctacacccgagatggatgcaccccatgttacacgtgcagattatcagttgacagatnnnnnnnnnnnnnnnnnnttatcccttatgtctgataatgaagaattacccgtatatttaaaagctccacatgctgaatgtgctgttacagtgggtgcgaaagatgctgcagatgaagatatatgatgaccattgttgaagtttcgagacaggagaagttacttatagattttgtaaaaagagcagaatatgatggctatgaagaattactatgttaccgcgcattttgctctatnnnnnnnnnnnnnnnnnnnnnnnnnnnnnncactcaagacaccacctcgtcttcagtcgatcaattgcaaccagtatacagaggcccagaatgcaataaccttccatgacgctactgcac

SEQ ID NO: 12444 - DNA, 977 bp, Diabrotica virgifera
  misc_feature (310)..(335): n is a, c, g, or t
  misc_feature (668)..(681): n is a, c, g, or t
  misc_feature (683)..(695): n is a, c, g, or t
cctttatactggcaggacacatcatttcgcattagatgtagtgacgtgagtctacttgtgaatagtatatctatatataaataagaatgaaaatggtctgattatccgaccgcgtctgcccaattaggtggagacgtatatcagatagattatagtctctgagggaagtaatatgggtatcaaatatttcacttcctttattattcaaggctccaatcatacccgatgtagacactttctatcaccaacaggtttctatgaaccatcgtcgaccctacagcgtaagagacaaagctgaacatcaaacatnnnnnnnnnnnnnnnnnnnnnnnnnnagttgctgatcctattccccgtgtaagaggaggtggaacccaccgttctggacagggagttttcggtaccatgagcataggggcctatatgtatgcaccaaccaagccatggcattgctgacacgcacgtgtaaacatcaagcaacgtacgtatactgctttgttgtcctggatggagtgattagagcagttgcacgcttagttatgagatgaggtaatgtcatcgatacaatccctgatattgtatgaggtcgatgaggccaagggaccagatatgaactagagtagatgacatatatttttcatttccatatcagggtgatgttatatttnnnnnnnnnnnnnncnnnnnnnnnnnnngattcgtcgaaataaccatgggttaccattctttgaaaggcttagctggaatgagatctagaggtgaagaacctcccttaaatatgggaatgctacctgaatatcaacaaaaaatttcgatttgcaactatagatttatcagagaatttacaaaagggcgttgaaggagattggaccgtaaatttactaaatcactttaagcccatttgatgagcaaaaatagaatttgtttttgtaatttgactgataataataagagaattagtaaaaatttgcaattaa

SEQ ID NO: 12445 - DNA, 771 bp, Diabrotica virgifera
  misc_feature (356)..(373): n is a, c, g, or t
ttttattccttcggcgatcttttttgatcacattttgctcgctcccttcaatatctatcataaaaaatggaatataatctcgatgaatcaccttatgaaactggatattatggagcctctgcaaactatcctatgtaatgctcatcgcaacttaacaacggcatcttaatgttgtatacgagaccatgcgaaaatgttaaaatgcttaaatgcaataatggtaaacttgatcaggctaagatttcaattgtttgatattgatatcttcacaggaaaaaaataagcaaatatttgcccttctacacccgtgatggatgccccccgtgttactcgctcagattatcagaagacagatnnnnnnnnnnnnnnnnnnttatcccttatgtctgatcatgaagaataacccgtctagttaaaagttccacatgtctgaatgtaccgttacagtgcttgcgaaacctgctgcacgatcaagaaaatatgacgacccttaccgaagtctcgggacagaggaaaccacccaaagaatttgtacatacaacagaaaataatggctatcaagcattaatagttaccgtgcattttgctctatatgacatacattcatagagacttcagaacgcaattaaagagaccacctcatcttcagccgatcccattttaacaagtatactgaggccgataacgcaataaactttctatgagttcactgccccctgaattttaatgcagctacattacttggctaaaaactcatcctattctacccca

SEQ ID NO: 12446 - DNA, 230 bp, Diabrotica virgifera
  misc_feature (14)..(36): n is a, c, g, or t
gaatcattaggtcnnnnnnnnnnnnnnnnnnnnnnngggtggatgatattaaaactgcctttatttgatctagaacgaaaagtatttgtaagtaaaacagattaaaggctattaacagatgtaaggacccgatgatgtcacataaaaggattaataggtaccgaaaagaccagactgattataggatagactcatgtcaaagaggtgatgaaaacagaaatgcccgaaag

SEQ ID NO: 12447 - DNA, 277 bp, Diabrotica virgifera
ttgaaaattgggacttcctctcctgattattaatttgaaagagactgttatgtcgtacagtaacctattttttctagatttcagagggatggatttcctaataacgagaacgaagagacgatattgacacaggcgtagtagggaattatatgaatcctctgaaaaaaagtcagttgtttaagtgtatttatgttgagctagagtggggattatttcaacctttggggaatcataaaatatctctatcgaaatcattgaaaaaaaaaacggaaaagcc

SEQ ID NO: 12448 - DNA, 634 bp, Diabrotica virgifera
  misc_feature (11)..(43): n is a, c, g, or t
  misc_feature (45)..(539): n is a, c, g, or t
  misc_feature (546)..(583): n is a, c, g, or t
ctcacacgggnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattatagtttatagcttggtgcagcagctatatc

SEQ ID NO: 12449 - DNA, 682 bp, Diabrotica virgifera
  misc_feature (16)..(46): n is a, c, g, or t
  misc_feature (49)..(430): n is a, c, g, or t
tgcctcaccccggcgnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatataccaatgaagaataagaactttcatattatagaatatggaattatatattgtcatagattattatctgatatatgttatcaaatgaatattataatataaatagaaattatttaaactgaccactgacgatgagatacgcaccacaaccgtcgtatgttccgcacccaacacataggttcactcaaggacgtcccacaccatccctgccccccggccccttacgaacattgcccctctggcactacc

SEQ ID NO: 12450 - DNA, 911 bp, Diabrotica virgifera
  misc_feature (2)..(393): n is a, c, g, or t
  misc_feature (400)..(437): n is a, c, g, or t
  misc_feature (457)..(470): n is a, c, g, or t
  misc_feature (473)..(495): n is a, c, g, or t
  misc_feature (503)..(525): n is a, c, g, or t
  misc_feature (555)..(586): n is a, c, g, or t
  misc_feature (593)..(629): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattaagggacgtacaactaaagaaccaatccaattcctcccaataaacccttcccccacaaaaccaacaatggggcgcccgttctaaagacccaacttaccgcccgcggcaggcgccgtcaaacccttcaaaagcgccccctaaatccatccatgggcgcgcttttaaccacgcggggatgggaaaaccccggggctaccccatttattccctttggaccacctcccccctttctcccgttgcgcaaaaacccaaacagcccccccccacccccccttcccc

SEQ ID NO: 12451 - DNA, 103 bp, Diabrotica virgifera
cattttttcaacgacgacaagaccctatagagctttataacctcattaataagccttttcaccacaaattcatcttcatacaaatttattcacctgggcgggc

SEQ ID NO: 12452 - DNA, 997 bp, Diabrotica virgifera
  misc_feature (672)..(695): n is a, c, g, or t
  misc_feature (697)..(712): n is a, c, g, or t
  misc_feature (734)..(752): n is a, c, g, or t
  misc_feature (757)..(788): n is a, c, g, or t
  misc_feature (846)..(882): n is a, c, g, or t
  misc_feature (918)..(935): n is a, c, g, or t
  misc_feature (945)..(970): n is a, c, g, or t
ggaaccgcgccgcaattcccgcgcctcccctttttccccctatattcatttttagtataatgatatatttcccccttttcagtaaaaaaaacttatatttaacgaaagcttaacaattattgagataagaacattattattgtttatgacacgaaaccttaattttacagtacctgtgtgcatctttgaattagtcccttagactctcatcccaacatacattctcatctccgctacagctatttgccaaaccgctcttatgttaccagatacctggataagacttaaatgacaacgaaacctcccaattgctgtattgtcttcccccgactgcccattgcgacctccccctttgctatgcaccccatgaagttgcatcaccatccccattcactgctgatttgcattgcagaactttaccacttccctatgctacaagaacaacacgacttcgattaccaaaccagatgacccgcacaatgcattccccacttgcactcacccctcccccccccaacaacgcgcccggaatctagacaccgcctacgctttatgcccgacacaccttcccacaaaccacgcactcccccctcccacccccctttccgaccccacccccccctccaaacccagacctaccccctccccccccaacgcccccgcccctccatnnnnnnnnnnnnnnnnnnnnnnnntnnnnnnnnnnnnnnnngctccccacgccccctccccgnnnnnnnnnnnnnnnnnnnacctnnnnnnnnnnnnnnnnnnnnnnnnnnnnnnnntcccccccctccttctccccccccctctattaccccccacctccccccacaccccctnnnnnnnnnnnnnnnnnnnnnnnnnnnnnnnnnnnnntccaacccctccccatccccctccgctccccccatnnnnnnnnnnnnnnnnnntccccgtcannnnnnnnnnnnnnnnnnnnnnnnnntatatcagctcccccgctcctcctcct

SEQ ID NO: 12453 - DNA, 320 bp, Diabrotica virgifera
  misc_feature (15)..(37): n is a, c, g, or t
  misc_feature (41)..(58): n is a, c, g, or t
  misc_feature (62)..(87): n is a, c, g, or t
cccttcatattgtgnnnnnnnnnnnnnnnnnnnnnnngaannnnnnnnnnnnnnnnnntagnnnnnnnnnnnnnnnnnnnnnnnnnnataattaggattgagagataaaagttataatcatctaattgaaaatatttatgagtgtgagattcttgatcaaagtattaagaatattatgcaataataaattaccaatgcggtttatttaattgattaagagtttttatgtttagagaaaaatggatatttttcataagcaacggaaactagcccgttctgtattgtcttccttcgataggacattgggaaagtcacctttt

SEQ ID NO: 12454 - DNA, 573 bp, Diabrotica virgifera
  misc_feature (159)..(178): n is a, c, g, or t
ccgttctgttgtgataatgtcatatacccccttttaaggaatagtgacttaaaaaaaagggagattaactatatttgctgcaaagcagttaatggtatagaccccaagttgagatgtgacgagtgcgagcttcgttgtttaggccaaggaaattcgtcnnnnnnnnnnnnnnnnnnnnccatgaggacatttgatttatcggtatcaggtttagaaagatctggattatcttaaaaatcaagcgaatctaacaatgtcagaaatgcctttagtgaaggggacaaggggagagacaccattttacaagaagatgttgaaatggtgtcagccatcggataacatggctgtagtatatgggagaactatttgatttccctatgcaaaaagaacatggagatttggacatagatgtcaatatgcccctgaactcagacgttgataaatcacaaaaacgacttgcagcgtgaaaacgtagctgcaattaaaaattccggttgtctgcgaaaattcgcacaccgttcgcatgaagaacacactacaggctctcgaaacttatctgatgccggatgccga

SEQ ID NO: 12455 - DNA, 322 bp, Diabrotica virgifera
gccccctttaattgtcagatattcgtgttagatgatggtatatcccctttatttggctttgttgccttttaaaagccagaggtgacccagacatgggagggagcgttgtatgtcaacgacctgaagctttgttatttgttctacgggtgccgaggacggggagtggagaacgctctcatgatacaagtcctcatgtcgaagctcttttgatttagcgtttttatctccccgccagattgggattttcttcatgctgtgggggcatcacccctttggctggactgccatcaccgaagttgtgattggccaagccttcattcct

SEQ ID NO: 12456 - DNA, 152 bp, Diabrotica virgifera
ggacgcctgggggggccgggccgggatttccggggcccttttaatgggcagacaaccagaagagaagaagggagagcccttttatttggcattggtgcctatgaaaagccggagatgacccagaattaggagggagctttttatgccaaaga

SEQ ID NO: 12457 - DNA, 231 bp, Diabrotica virgifera
ctccctttttttgccccgcaaactcatgaacatgctcttcttgccttcacccttggggtatgacaacttatagtagccagaggcaacctgaactccagtgaaacattttaatgtgaatgcacgtgatggaggaaattccgaagtatgtacatcgaggcataaagaaaaatgaactctaccatgatcaattaccgtatgtaagaaagccataagatgcaccgtcttcatcgc

SEQ ID NO: 12458 - DNA, 419 bp, Diabrotica virgifera
  misc_feature (6)..(385): n is a, c, g, or t
cacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacttaattaaaaataactttataattacgactt

SEQ ID NO: 12459 - DNA, 677 bp, Diabrotica virgifera
  misc_feature (5)..(5): n is a, c, g, or t
  misc_feature (482)..(508): n is a, c, g, or t
gaggnagataaaaaaaaagggccaacaatattactaatatattatacatttgtttacctccatattgaacaattattattgacagatcatttcaacacccaatcagagcccgtataacgactaataccatactgtcggtgtgcgcatgcgcgcagaatagaaaaaaatcaccctcaatcgagcctaaagaagtataacttcaaaacaaatgaacacgttgaaaattttgacatgcttcaaaattttgcattttgctctgttccccttaagtgtctaaatgaagatttttttaatgtgatattcaagttaaaaaatatctcttgataatttctgaaataattgcccttttttgaaacaaaggaaacaagagatttgataatttgacagttcaaacatttaaatttgaaaactgaccaatacgtctgtaatattattagaaaaaataggattgctttggacctcctgtagtctaatgtatatcnnnnnnnnnnnnnnnnnnnnnnnnnnngtattacgatcataatattatattgactaaagacaaaatgactgtacttttaatttattttcctggttatagttgtaaacgattgaatttttaagtaacatttattcactggttatttacatttgtattatgtaaattcaatctatttttttcaataaattgttatctt

SEQ ID NO: 12460 - DNA, 813 bp, Diabrotica virgifera
  misc_feature (14)..(641): n is a, c, g, or t
  misc_feature (643)..(760): n is a, c, g, or t
  misc_feature (764)..(782): n is a, c, g, or t
  misc_feature (792)..(812): n is a, c, g, or t
cactcttgtgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnccttttttannnnnnnnnnnnnnnnnnnnnc

SEQ ID NO: 12461 - DNA, 819 bp, Diabrotica virgifera
gtcatgttgttctaaggtgttacgttatttatttggtgaaaattaacattaaaaacgttgtttggtattggaataacgaggagtttgtaaaagcattgctatgaataacaaggaaaagctaccgaaactggtggatgtacatcatcagtcgaatcctcttagtaggaggcaattgccccttgttgttgacgataatttaacgcttgttatggatatcaaagggtctgggattatatgtgataatcaagttttacgtgggaaagagcttgaagagtttgcttgtaaatggagtgtcctaccaccttgtgaattacgaaatgctcttcaaatcactaaatcagaattaatgcatgttttaaatcagaatgtgccatgtgttggatgcagaagaagtgtggatagactttattttcagttattcaattatgggcatccaaccttggatccactgattgttaagcctgatggaactatcactatcagagaagataaacaggcttatccaattttgggatctatttttcatgaccattctgttcgcttggcaaaattaattgaaaatcaaccaaagagaaacaaaaagagcgttagatgtctattacattctttagattctcaacgtagcagacctctaactccggtttggagggatgtgtgggagtgcatgaagccagagtgtaagaaagatgtctgcttaatcaaagcatctagtcttcatactacattggaaacatatttgcgtaagcatagattctgtggtgaatgtagaacaaaagttcttaaagcttattctctgttggtggaagaacccgaacctac

SEQ ID NO: 12462 - DNA, 910 bp, Diabrotica virgifera
  misc_feature (556)..(585): n is a, c, g, or t
  misc_feature (628)..(645): n is a, c, g, or t
  misc_feature (847)..(869): n is a, c, g, or t
  misc_feature (889)..(890): n is a, c, g, or t
gtgatattcacgttgcacctctcattttaaaggttaattgctcagtggtttgacagccgattttgaaaaactttatatcgctggatacgtaaattggtgaatgacctttctttcaatttacagagaaatatactgggtgttccattggaaagaggcaacaacgtcttttttcggaaattcgccatttttttttcgtatttgaaagcgatatagggggttcaatcccttcagacgaagcttttactaaagtgacacatttcagcgagaaccgcatatttctgtcttgagccgtttggaagttgtaggcggttagaatttgggaaaatataagtggacacccggtacttcatgaatgacataaaaatttgggttttatcaaaaacctacaaaacatataattgggtaagatgtaaatgattcagttttcatcttagatagactcattaaagatgatcagttggtaaaggcacttaaagaagaatataagtatacttcactacaaccgaaagaagtaggtatcttagacacagatgtttataaaggaatgttcacaacnnnnnnnnnnnnnnnnnnnnnnnnnnnnnnggaaaaattttatgtaaaatgtcaagttaaaaattttagaacnnnnnnnnnnnnnnnnnnagggagcataaacctatttgcctttttaataaaattcttccacttatttcacctttttatttaattttacaaaattgtaactaagttacaaacccactacagcatgtccaaagatgctcttcgtaatagaaaactgctagtttctatattgaaaagggggtttttttggacacactgcataaatgaataagcctattttgcnnnnnnnnnnnnnnnnnnnnnnnctaaatatatgtgtaacgannacgtgattaaattcgttttt

SEQ ID NO: 12463 - DNA, 577 bp, Diabrotica virgifera
  misc_feature (474)..(492): n is a, c, g, or t
gacatgtggggtgtccagttccagatttctcgatacgaacatctaggaactggacatgtggggtgtcccatacaaaatcgtatctaacaaaataaaaagcccaataatgctttcaactttattgaaggaagacggctcgttgacagagagttgggaggaatcagatgacatattgctagatgtgttgctgccacccgatgacttataaaacaagaccgaaatacaaactcagatcagagaggctatgatacagatgtatgagacgcctggagagacatggacagaggaattcacagaaatagaaatcagagaaaacttaagaacgatgaatacaagaaaggcccctggacctgactatattctcgtctaaagattaccaactctacatgatcaattaacacccactctcatgacattatacaatgaatgagtaatgcagagaaaatttatgaacaatttcaaacaagcagatgnnnnnnnnnnnnnnnnnnngataaaaggaatatccaaaacatgcaacatcttttgcagtcttcttatttacttaactatatgttcatatctgttctaaacactg

SEQ ID NO: 12464 - DNA, 877 bp, Diabrotica virgifera
  misc_feature (32)..(57): n is a, c, g, or t
  misc_feature (481)..(502): n is a, c, g, or t
  misc_feature (633)..(650): n is a, c, g, or t
  misc_feature (709)..(729): n is a, c, g, or t
  misc_feature (737)..(759): n is a, c, g, or t
aacaacttaaggattttaaatttaaaatgtgnnnnnnnnnnnnnnnnnnnnnnnnnngttggacaagatggtgaaactatctaatgcacgtgttaattttaatccaaaattactgaaaaagcttacacagaaggaaaactctggagtggaagttcatacaacagttcaacatttagcaatatacccacatcaactaaataatttcaatgattctgttaaaggactgttgaatgcgaaaatagctaaatacaataaaacatttaacggtattttgcttggctacaaaaacattaaactactaaaagatggtggagttattcaagatgattcgtactacatccacttcgacctgcaagctgatttctatattttcaaacctgaaataggcaaaatcatggaaggtgttgtgaaaagaaaaagtaaagaccatattggagctcttgtgtatgaagcattcaatgtttcaatcccattaacaagnnnnnnnnnnnnnnnnnnnnnnggaaatacagtgaaggtgggagatacagttacttttcagataatatatatcaatcttacctcacgtttgccctatattcgtggaagacttatgtcagaaacaactgaaacagaaacaaatgaaatatcagnnnnnnnnnnnnnnnnnnggaagaataaatctaaaacggaaacaactgaaacagaaacaaacgaaacaacagaaacnnnnnnnnnnnnnnnnnnnnntaaaaccnnnnnnnnnnnnnnnnnnnnnnnggaagatgattagtatgtgttttatatacaataagaaaaataaacattttgctgtgatttactttctacactcttgcattttatttttgtatatgatcaataagaacattcttaatat

SEQ ID NO: 12465 - DNA, 673 bp, Diabrotica virgifera
aaatcatccaaccgctttcttatctcctataccccttctcattcttcacgctcccctgcctcatcgaatcaaggactacactgtttcttatcaccatgccacctatacgatcttttattcctgccatcgtggatcaaaacatgtatgtgttctattggaccaggatgttttcaagcctcgctatggccttaccttcgacatcctgcgcttacggtgaatatcggaaaattctcttgtccccccatgccattgctgttattgaccaccctgacgacatttacctttgtacgtctcttacctgtgaacgtggtgctgatcttttgctaggtgctcacactgtcccatcccctattgctggaatatttactcctggtgcttctacctgtcttaatcccactgcctccggataaccacctcttttgaatggacctgaccctggttatgatctccttcctatctctgacgcctcttacgaatgcattccatgtcttgctctgtctgataatggtcctccatcacgttatgtcgaaattgccatcctcgaaagacctgaacgctctcgcaagattgaggaactgtgtggtttgtggagctatatatgatatccctcttatcctacatcgttctatcagataccatacgatatgctcaatacatcctcttattctatgga

SEQ ID NO: 12466 - DNA, 960 bp, Diabrotica virgifera
  misc_feature (66)..(98): n is a, c, g, or t
ctttaaacagttttttgtattgtatttaaatattaaactaattttagaaagaacaaaaagaatacnnnnnnnnnnnnnnnnnnnnnnnnnnnnnnnnnctttatcaggatttgaacaggcgacctctcgatccctaggcgaatgctctaccgatcagctaccacggcttttatattcagtggatcatttctcggacataattacaatctcggtgacagatactttaaatgaaaataaacattttcaataatacttattaggagcaagacaaatccacagacataaaaattgtaataaatatatttactaaaaacactaataatatattcttttcacgcacaccttatttgcgctacataacttaaaagatgtagcgactatttaataccatactgtccgtgtgcgcatgcgccggccaatgtaaaaattcaccctcgtgcctaaagaagtataacttcaaaaacttcagtatttgtaacaaaaaatagtaaaataatgttgaaagcacttgaaagtagaacaactggatgaacttgttgtcatgctaatagcgaaaaaatacacctgactacttttaactatagcaacgtagacactgacatgcggtgtgtgaaaactttacgtcaacgtagctcaaagactaaaccatactaaaactgaagtagttggcagcaggtacaattacacaccacttgaaggttcacagacacatatggtattctacaactacactctacaactgtgaattatcataaataaaccctcctttagtattccacagcagttaacaacggtaatcctctacaagtacctacctaatactaccttttacggtcgctgccgtgaagagtggcaacgttgtcaagaaaattcctatttagtttgtttgggtctatcctcatacctatatccatgtcgcatgtttgaaatacacagtagaaatcttttataaaacacgtt

SEQ ID NO: 12467 - DNA, 908 bp, Diabrotica virgifera
  misc_feature (5)..(822): n is a, c, g, or t
  misc_feature (825)..(825): n is a, c, g, or t
  misc_feature (845)..(881): n is a, c, g, or t
atttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntanattaccttagggataacagnnnnnnnnnnnnnnnnnnnnnnnnnnnnnnnnnnnnngccgacctcgatgttggataaagttta

SEQ ID NO: 12468 - DNA, 902 bp, Diabrotica virgifera
cgtcagtttagtacgagttgaatcaaatcgctaaataccttcatcatttttatctacttacagtgttgtacatattttacatgtactaaatataaaaatcagataagtaagacagttttgttgaatgatgaatttagatatcgcgtatttgttttaattttgaaattacatagaaataatagctatagtttaaagaatatttaacagttgtaatacgtggtaaaatagataggtataagtcagtatgtcagcagaagaattggatcagtattatgaaacggctgttgctttggcaaaacgattgggggcaataatcaaagaaactgctttagtaaggaacaaatccactaccagcaaactaaacagaacagacttagtaaccgaaacagacaaacacatagagaagcttctcatcagcaccgttaataaagaatatccccaccacaaaattattggagaggagtcaacgtttgaaggagcagaatgtactctcaccgacgcaccaacctggatcgtagatccaatagacggaaccatgaactttgtccattcatttccccattcctgtatttcaatagctttgtttgtcaacaaagaacctgagattggtatcatttataatccccatttggaacaattcttctcggccaggaaaggaaaaggtgcgtttttaaatggggaacctataaacgtgtctgatacgaaaaccatggctgatgctttggtgttaacagagagtttcgctcgtgaaaattccgtcaaagaaaaagtcattttggagaactataagatgctaatgcgggaaactcatggaccgagatcactaggttcagcagctatggacatgtgcatggtagcctgcggtgcggcggacgcttactatcaatacaaactcaacattt

SEQ ID NO: 12469 - DNA, 831 bp, Diabrotica virgifera
  misc_feature (79)..(96): n is a, c, g, or t
  misc_feature (115)..(144): n is a, c, g, or t
  misc_feature (146)..(164): n is a, c, g, or t
  misc_feature (213)..(237): n is a, c, g, or t
  misc_feature (258)..(276): n is a, c, g, or t
  misc_feature (290)..(338): n is a, c, g, or t
  misc_feature (342)..(373): n is a, c, g, or t
  misc_feature (375)..(404): n is a, c, g, or t
  misc_feature (415)..(437): n is a, c, g, or t
  misc_feature (446)..(465): n is a, c, g, or t
  misc_feature (469)..(501): n is a, c, g, or t
  misc_feature (503)..(518): n is a, c, g, or t
  misc_feature (527)..(577): n is a, c, g, or t
  misc_feature (579)..(614): n is a, c, g, or t
  misc_feature (616)..(642): n is a, c, g, or t
  misc_feature (644)..(671): n is a, c, g, or t
  misc_feature (682)..(721): n is a, c, g, or t
  misc_feature (723)..(796): n is a, c, g, or t
  misc_feature (803)..(829): n is a, c, g, or t
agggatcatcgaaatatacactatttcccttttaccagcagcgaagaattctatttcctgacacttaactacgattgannnnnnnnnnnnnnnnnncataacccaccaatttacnnnnnnnnnnnnnnnnnnnnnnnnnnnnnngnnnnnnnnnnnnnnnnnnncactttcgcctttaaaagacctacaccaagtagaattcttattgtaaannnnnnnnnnnnnnnnnnnnnnnnncaatgaaacgatactccctcnnnnnnnnnnnnnnnnnnncaagaaatacattnnnnnnnnnnnnnnnnnnnnnnnnnnnnnnnnnnnnnnnnnnnnnnnnnaatnnnnnnnnnnnnnnnnnnnnnnnnnnnnnnnncnnnnnnnnnnnnnnnnnnnnnnnnnnnnnnaattaggatcnnnnnnnnnnnnnnnnnnnnnnncatgttacnnnnnnnnnnnnnnnnnnnncatnnnnnnnnnnnnnnnnnnnnnnnnnnnnnnnnncnnnnnnnnnnnnnnnnacttagccnnnnnnnnnnnnnnnnnnnnnnnnnnnnnnnnnnnnnnnnnnnnnnnnnnncnnnnnnnnnnnnnnnnnnnnnnnnnnnnnnnnnnnngnnnnnnnnnnnnnnnnnnnnnnnnnnncnnnnnnnnnnnnnnnnnnnnnnnnnnnnctttgaatgcnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnctttacnnnnnnnnnnnnnnnnnnnnnnnnnnncc

SEQ ID NO: 12470 - DNA, 440 bp, Diabrotica virgifera
  misc_feature (81)..(100): n is a, c, g, or t
tccaaatattattttttgatcatcatgctacaatatgtcgttctcttcaccatcatctggctcagctactgaaggcgacannnnnnnnnnnnnnnnnnnntctacgcaaaggctgagtatatgacacgtgcgtggctcgacaagggtcggctagtcaatacatctttatcaggtttgatcactataccaccaacgagtagaaaattttgatgactacgtaaaaggattagttcatgctaaagaaactagatatcattcgatagtggatgaaaccatagatgataaccataacataatactcatacacagaaggtagagttattatagaagattctaattatatcaatttagaatttccttgaggatgatataagatttggttttatataggatagattgtgtgaagagaactgcagaaacaaagttcagaccattttgca

SEQ ID NO: 12471 - DNA, 609 bp, Diabrotica virgifera
  misc_feature (327)..(344): n is a, c, g, or t
tcaccttctcttcttaaaaaacaaaacacttctctcagcttttttaaggttacatattgttattttcgttctcattctcaatttctcttacatactaccaatagaaattgttactcacttgaggagtgacatttctctcaaagattaagagattttttttttcaagaatacagcattttcggttttagtaagccacgcctacttttacgtcactttctcttaccatttctactccctgaaattcaagaataaagacccgtgtctgactcgacgatcgctccctcttttttgtccgacaaaggtgatttattttattttaacgtatgnnnnnnnnnnnnnnnnnncttaaattgttaaaatgtttaaaattaaaaattgtagttttgcaataacggggcatagctgcgctggagctgtaaatttgggtgttgtgcgtgcggaaactctcacctgcaccttgaaggttttcagaaggtggtatactcggtccaacgaagtagtggagaacatttagaaaacttgggtaagcattttcaaaaacggacgatgtactgtggactccctaatacttcttcattaggtattttttatgtaaagtcatacctctga

SEQ ID NO: 12472 - DNA, 956 bp, Diabrotica virgifera
  misc_feature (705)..(729): n is a, c, g, or t
  misc_feature (748)..(790): n is a, c, g, or t
  misc_feature (802)..(827): n is a, c, g, or t
  misc_feature (870)..(889): n is a, c, g, or t
gcgtagcggacctccgacattttgttttttgtttcatttcattttgttttatgtttgtgatttcgctgaattctgcatgcaggcatattctcccgaaaaaatgatctataatcaaactattaaatttatatttacatggaattgtgtcgtcgataacaatgaatagtggaccgcagcatcccaaggaactagtgtgctgtcctctaccctggtgcacacatgtggtatttagtcagttgcttgatccaaacaccggagaagccgagcgaatcaattgtgaaaagtcaactgccaacccactaaaacccccctcattccagctgcggacaaccagttaagagcagacgcagtgccatcacaatttctggatacatatacatggatttttggttattaaggagagcttacaaaacatctcatgattataaccacctcatgagtattgattttcaatctgacacaaaagttgttctgtctaagatgccatatataaattgatgttatttaaattaacgaatgatggtagtttaaattacaatatatgatagaattagtaaatatatatacagatataagcggaatgcaggtaccttttcttcatctgtgtagtggaaacatgactttgtgaataaatatcatatgtcgcctgccgactggttaagttgaatggacgcgattattttgaccgggctaaagaagcatagnnnnnnnnnnnnnnnnnnnnnnnnncaatggaggggatggacgnnnnnnnnnnnnnnnnnnnnnnnnnnnnnnnnnnnnnnnnnnnacgtaaaaacgnnnnnnnnnnnnnnnnnnnnnnnnnnccctaaaaaagtttaataaaataattaagaaggtcctttaagnnnnnnnnnnnnnnnnnnnncaagtttagctcaattggggggggagtaaaaaataaaccttcaccttctttttattccaatatttca

SEQ ID NO: 12473 - DNA, 912 bp, Diabrotica virgifera
  misc_feature (544)..(573): n is a, c, g, or t
  misc_feature (788)..(800): n is a, c, g, or t
  misc_feature (802)..(815): n is a, c, g, or t
cttaaaacagcaaccgtaaataaattggaggcctttgaaatgtggatctaccgtagaatccttaaaatttcatggacatcgcatgcctcaaacgaagaagtgctgcatagaacgagaacttttcaacatattgaaagttagaaaactgtcatagctagttcacatgctgagaaacaataagtaccaatactaatagtgaaaggaaagatcgagggaaagagaggactaggaaggaaaagactatcgtgggtaagaaacatccgacaatggacaggactaaattttgaacatctaataagaacagctgaagacagacaagaagttgcgattgtagtagccaaccttcactgaggagttgaggagagggcattttaagaaaaagtgataataacagtgtaataaaactacaattagggccatatctgaacatttaatacaagttcttttatatatcatacaaatatattaaaagaccataaaattatcacatagtttcaataaactcatcgtgtaagtaataaaaatcataaaaggaaatttagannnnnnnnnnnnnnnnnnnnnnnnnnnnnncacactcgctctataacttagtagaaattagttttcttcttaacaactatgtcagcaacgtttaaatgagcaactttttccttgcgcttcggagggtatggattgtgagcagaagcgcttaaaagcttcaagttctagttcttctgggtccatgttgtcttccaagacatctctaggtgaaaatacgctatctgtaaaattagatttttattagnnnnnnnnnnnnnannnnnnnnnnnnnngtgtaaacagtgatgagcgcgggagtagtagaaagcgaggaggacggtcacggtcgtgtctatgtggtgtcggcgataaacaactcgcaatccggga

SEQ ID NO: 12474 - DNA, 171 bp, Diabrotica virgifera
  misc_feature (2)..(66): n is a, c, g, or t
gnnnnnnnnnnnnnnnnnnnnnnnnnnnnnnnnnnnnnnnnnnnnnnnnnnnnnnnnnnnnnnnnngagaataaattaccttagggataacagcggaattttatgggagagttcaatcgataataaggattgcgacctcgatgtggattaaaagttataatggtgtaaaag

SEQ ID NO: 12475 - DNA, 821 bp, Diabrotica virgifera
gagttcaaagctgtcagacagattatacttacacgtacttttgatattccaccctccatacatactttagtcatccgaatgagtttctttggtattgagaactccgacatggcattccatacttggcttctttctacgctatcatatgcctgtcgaaagtctatgaagagattgtgtatgggtctgttatactcccatcccttttctagaaggtgtctcagcgtgaatagttgatctattgtagatctgtttgccctaaaaccggcttgatattctcctaggacattttcagcatagggggttagtctactaagagtgatgtttgagaggattttatatgccgtgtttaggagtgaaattcctctatagttcgcgcattttgttttgtcccttttttgtagatgggcactatgatgtttgccttccatcgtgctgatatcctttcttctaaccatatttgtgttattaagtggtggatttggcgacgtagtgcgtctccaccatatttcagaaattctgctggtatcgtccgtatccggcgctttgtgatttttcagtttatttaacgccttttgggtttcttcaaaagagggattttcgacgggcatgtccgctgtgatatagatctctttgtgctgttcttcctgtatgatgtttagaaggtccctgaaataccctttccattcttctgttagttctttatcgtcgattatcatatgaccttgattgtctctcagtgtatggatagcattggctctatgtcctcttttctcagtggaaattggtttctgaaccatggaatgggcctatgtctctccata

SEQ ID NO: 12476 - DNA, 935 bp, Diabrotica virgifera
  misc_feature (219)..(241): n is a, c, g, or t
  misc_feature (346)..(365): n is a, c, g, or t
  misc_feature (489)..(509): n is a, c, g, or t
agtcaacaacgtttttttcaagggtccgccatttgtcttttcgtgtttgggggcgatatagggaattcggtccattcggacaggacttttactaggatggagcatttcatcgagaacctcatatttctgtcttgagccgtttggaggttgtaggcggttggaatgggggaggatgtaagtggacacccggtattttaaatatacaacatattatatagnnnnnnnnnnnnnnnnnnnnnnngtagttaaatataaatgtacattacaactttataaaatacgcccacctataatagcaatttcctatttattacaatgatcgtaggtacaaatttgtactttttannnnnnnnnnnnnnnnnnnnggaaatgaatataacttgaattgactatttcttgttgaagtttttacaatacataattaagacagcatttgctaatagtaagcaaccaattattcagccgtgtactattggtaaacaaaattannnnnnnnnnnnnnnnnnnnnataattttaatctcgagtagttcataattatattttttcactaattaaaataaaaaaggccgtagagaaagtatagtattctactttcatgtaatggctacactacacgctcgttgaataatatactattaactggcaaaatattgtctagctagtgaaatgaggaaagtgataagtaatctgattcatgtaatcatgtaacgccagaaaataaatatctatgatgataaagattttctcacttctctgattcataagtaattattatactgtagataagaaaattccaactctgtgacacacattaaaaattaatatcaaataatagctatactggctcatacaaaagcttaagaaaagttttacacgcgatggaatttcgctggagaaaaattaaaaatacagacttggaaaaaccaaatattg

SEQ ID NO: 12477 - DNA, 167 bp, Diabrotica virgifera
  misc_feature (2)..(64): n is a, c, g, or t
  misc_feature (88)..(160): n is a, c, g, or t
tnnnnnnnnnnnnnnnnnnnnnnnnnnnnnnnnnnnnnnnnnnnnnnnnnnnnnnnnnnnnnnncttacaagacgagaaaaccctatnnnnnnnnnnnnnnnnnnnnnnnnnnnnnnnnnnnnnnnnnnnnnnnnnnnnnnnnnnnnnnnnnnnnnnnnnggattaa

SEQ ID NO: 12478 - DNA, 69 bp, Diabrotica virgifera
  misc_feature (2)..(18): n is a, c, g, or t
  misc_feature (20)..(68): n is a, c, g, or t
cnnnnnnnnnnnnnnnnncnnnnnnnnnnnnnnnnnnnnnnnnnnnnnnnnnnnnnnnnnnnnnnnnnc

SEQ ID NO: 12479 - DNA, 906 bp, Diabrotica virgifera
  misc_feature (705)..(705): n is a, c, g, or t
  misc_feature (731)..(731): n is a, c, g, or t
  misc_feature (755)..(755): n is a, c, g, or t
aaaaaacattttttatgtactttaatacataaagaataatataattagttagataattttaagttcaaagaccctcgtttgtaataaacgccaaaatgtccacaaattctagtccgacccattacacagaagatgcgtttgtccgtgatgctaattttaaagtgggaattaatcaaaagatgaaggttcccgacaggattagttttgccacagatctaaacggagagagcagaggttcatggaccagggataacttgaacatgaacgtcccagaaaggatattggtagcaggtcaacatcaacatgttggtactagagccccacctagagaaatagtattcgataatgcaatcattgctaaggacccacacccatacgatctaccacgagtagcaaccccaccacgtactttaaccctcgacaaatatccgttcccaggagtggatgaatatcaagaccacgacatagaagaccacctacctgtagtaaaagccacccccaaagttcgtatgaacgacgtaagctttcaattaggaaattcttttaacgaatcgacccaaatatattcaggtgctggagagggactgacacctgccgaagaagtgatgcatttacgacgacaaaatggcgaagttgaacaggaggatcatggcgttagaattggagaatattaatagattacaaaaagaaaaatagtgggttggntttcggtgtcgcctatttccttttanaagttataatttggatgaataggngattaatggttttgaattttgtgtatagaatagtcctgggagggtcaaagtagtcccgaaaattggtcagatcaataagtataaatggcgattttaaaagctaaactgaaacaagtgctgtattttgcatttttgacgaagtttatctgtc

SEQ ID NO: 12480 - DNA, 956 bp, Diabrotica virgifera
ccatttccgtacttattttgaacttatgttttttcaccccaaagaaggggtaaaactcgcccccgtggcaaaagcacacatcgacacactatcactttttattctttgacatattagctatgtgtatgccaaattttcggttaatccaagtggttatttagaatttggagattttgcaatattttaccgccagtgaatggactatacttcttggctttatttggttgtagtatttaattgcattaataaaccttttctttatattataagtgttctaaacattgtgggtttccttttcccaggtagctatagcttccttcgtggacgtattagttattgatctggaaaatagagcctttagacattcatcatcatcagtagcttaacaaccctttttgggtcctggcttgttctaggattttccgccattctgttctgttccttgctttgttcttccagtgggtaatctcaagtgttttcagatcttgttccacttgttccatgtatctaagtttgggtcttctctttgaccgtctccctactggcatcattatatgttttgatgtttcggtctccaacatccgttcaacatggcccatccagcgcagacgtccaatctttatgcatgttatgacgtcgggttcgttgtatgccggtggcgcccaaaatcccgacagccaaaataccgacagccaaaatcccgacggccaaaacaccgacacgccagaattctggcgtgtcgggattttggctctcgggattttgggggagaccccttgtatgctgagtatagtttcatatttaaaagttattgtcagcaattggctgcattgctactggattaatccctctcgcaagataaactgaattcctattttaacttggctggacccgtactggatggactaaccaaatggtcagcaataaggaatttaatagttggccttctatctttt

SEQ ID NO: 12481 - DNA, 810 bp, Diabrotica virgifera
  misc_feature (2)..(50): n is a, c, g, or t
  misc_feature (52)..(749): n is a, c, g, or t
  misc_feature (762)..(808): n is a, c, g, or t
cnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgagagacnnnnnnnnnnnnnnnnnnnnnnnnnnnnnnnnnnnnnnnnnnnnnnntt

SEQ ID NO: 12482 - DNA, 823 bp, Diabrotica virgifera
  misc_feature (203)..(238): n is a, c, g, or t
  misc_feature (537)..(556): n is a, c, g, or t
ggaactgccccatcaggagcctacagaaaaagtagttaagccacgcttctcaagatctgcacctgcattggtaaagaaggaaactaaagaggaaaaacccaaacctaaacaatctaccccatcaaaaccaacttcgaaatctccgcaacaatcaaaacaggcagaaaaccaacataaagaggagcaacaatcaaaatccaaannnnnnnnnnnnnnnnnnnnnnnnnnnnnnnnnnnnttaccaatagaaaagaaatctgtgaatatcgaacctgttccaatagaaaagaaacctgtggagatcgagcctcaagttaaagtaacatggtgctgaaaacttattctaggaaaaggaaaccctctgatattcacgatttcgacaccccatccccgaagcgatctgcttttgaagatcccgacgccaaccaaatttacgaaaaaggcgatccactagcactcccttcagatgtttatgtcactaaaagttccagagtcatcaaaaagaaggtcatttgggatccggatgatgaacagacnnnnnnnnnnnnnnnnnnnnaaatagttgacactaccaaagtttatggcgccaagactgagaagagtgacagaaagcaaacgggaactcccactggtgacaaaattaaatctgatcagaaaactacccccaagtcggctgagaaaaatactactgagaagaatatcgtcaagaaacctgttgccaaaccgaagacaccgcttaaatcaaagagaggtttaagtgaggtggacagattgctgatggacgaaggggcagtgaagatgctctacgatctgaagagcgacg

SEQ ID NO: 12483 - DNA, 944 bp, Diabrotica virgifera
  misc_feature (505)..(524): n is a, c, g, or t
  misc_feature (717)..(717): n is a, c, g, or t
  misc_feature (806)..(806): n is a, c, g, or t
  misc_feature (861)..(861): n is a, c, g, or t
  misc_feature (879)..(897): n is a, c, g, or t
tgttaaagtgctgctcaaaattttgcccgaactacttggtagttctgaacaaaattgcgtggacagaaagaatattaacttaaaatgcatcgacgtactgtttaaaaatgcccataataaagtagatgcaatgaaaattaaagattttcagaagaaggccgaggcagaaatacgtggtgggtttcaatgtctggcgttcaaatctctcaaaataattttattgaataccaatgaagaagaaagactccttcactaccatgacttaataaaacttttctacaacagcctaattcagaaagtactagaattgcataagttggacagcctgataacgttccaagaatacgaacacctggtaagaaatctactacctttggttacgttggaaatacttcttgaacagtaccccactaaaaaccaaatccttttcgaagaactggtggagtacttagatatgccaattgttcttagagaagacatttacgaagtgttacagaagaaactnnnnnnnnnnnnnnnnnnnnttatacggtatcacttggaagcagtatccaataaaggacttttgtctgactgtgccagcctcaacgttttaataatagaagaaaacgaaaagaaaaacttgtaagtttttcattaaatttttgccaactcaagaaacaattgttcagaaatttataactgccctggctttcaaaaaagaagttttattctatnggaaaatttgtgcctctattaaaagaacttggtgagacaaatttagagtttattccagaaagttacttgaattagagatgatttgattngtattaagtgacattactgagctagggtattcccattccggtcaagatttccttngattatgatcatttatcnnnnnnnnnnnnnnnnnnngccccgaatccattcattctctatcattttttgaaagaaaatttgag

SEQ ID NO: 12484 - DNA, 905 bp, Diabrotica virgifera
  misc_feature (11)..(28): n is a, c, g, or t
  misc_feature (626)..(643): n is a, c, g, or t
ggcttatttannnnnnnnnnnnnnnnnncgtggatcaaaaggctacgaagaggcttatcagtttttcaattatattattataggtgaatgtaacggtattttggaatggtactgatagatttaggtcattagaaataggaagcaaattttattatgaattgaagagagcagacatggcggctactagaaaattacaaggggaaatagatcgctgcctaaaaaaagttacagaaggggtcgatacatttgaagacatctggcaaaaagttcataatgctaccaatagtaaccaaaaagagaaatatgaggctgatctcaaaaaggaaattaagaaattacaaaggctaagggatcaaattaagagttggatagcatcggctgaaattaaagataaaagtattttaatggacaacagaaaacttatagaaacgcaaatggagaggtttaaagttgtagaacgtgaaactaaaacgaaagcgtactcaaaagaaggtctaggtgctgctcagaaattagatcctgcccaaaaagaaagagatgatatacaatattggttaacatcatcgatagcaaaacttaatatcggttctgatagcttagaatctgaaatagaatagctattatcnnnnnnnnnnnnnnnnnncgacaaagacaaacaagatagaatagaagatctgaaatctaggttggataaacataaatttcacatacggaaattagaaacgctattaaggatgctagataacatgtcagtggaagttcaacagattaaaaatattagagacaatgtcgaatattatatagactttaacacggagccagatttcgaagacaatgaatttatctatgatgacattattggtatggacgaagttgaattatctggcgtcccattaccttcttct

SEQ ID NO: 12485 - DNA, 86 bp, Diabrotica virgifera
  misc_feature (2)..(59): n is a, c, g, or t
  misc_feature (61)..(81): n is a, c, g, or t
gnnnnnnnnnnnnnnnnnnnnnnnnnnnnnnnnnnnnnnnnnnnnnnnnnnnnnnnnnngnnnnnnnnnnnnnnnnnnnnnacgag

SEQ ID NO: 12486 - DNA, 491 bp, Diabrotica virgifera
  misc_feature (5)..(71): n is a, c, g, or t
  misc_feature (80)..(104): n is a, c, g, or t
  misc_feature (107)..(121): n is a, c, g, or t
  misc_feature (126)..(139): n is a, c, g, or t
  misc_feature (141)..(399): n is a, c, g, or t
  misc_feature (407)..(471): n is a, c, g, or t
atatnnnnnnnnnnnnnnnnnnnnnnnnnnnnnnnnnnnnnnnnnnnnnnnnnnnnnnnnnnnnnnnnnnngtagattannnnnnnnnnnnnnnnnnnnnnnnntcnnnnnnnnnnnnnnngaatnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcgagnnnnnnnnnnnnnnnnnnnnnnnnnnnnnnnnnnnnnnnnnnnnnnnnnnnnnnnnnnnnnnnnnggggggggacaacaaacaaa

SEQ ID NO: 12487 - DNA, 151 bp, Diabrotica virgifera
  misc_feature (62)..(84): n is a, c, g, or t
  misc_feature (114)..(145): n is a, c, g, or t
agttcaaacgtcgaacagacttaataatatagctgctacaccaattataaagtctgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12488 - DNA, 953 bp, Diabrotica virgifera
  misc_feature (367)..(385): n is a, c, g, or t
  misc_feature (607)..(625): n is a, c, g, or t
gcttcatagatttttttccagaatttttttcatgcttttactttgtttgattgtttgttgtatctgctctttattgtggtgtcttatgtcattcatgctacctctgaacaggggacaaatcaagacagatacgagctactccaatgcattttgcaaggtaaaattgaaggaaaaagggccccaggacggagaagaatatcctggcttgctaaactgagagcatgctatagaaaacctcaacacaactattccgtatagcaaccaacaaaatcatcatagccagaatgatgatgatggccaacgtttggaacggacaggcaccctaaaaagaagataacaaaacgcaaaatgagcgatggactaaaannnnnnnnnnnnnnnnnnnctcgtaaagaatgaagaattacgactagagtataattaggtagagcttgcacaaaagaggcacaggaagtttacacaatttcctggaggcttttatcaagaagtattcctaataaacaaaaataaattcttttgtgaaatctctacgaaattagtaactactgataaaaatatatctttcattgataagtacttatcagtgattactaagatttataagtgnnnnnnnnnnnnnnnnnnncaattgatacatacatcattaatattactacgtttagaataatattcccaataaaaatgaatcttaagtcttacgttattttgtttagcatattagtgttttgtgtcaacaaatcgacaggtaaatgaatcattacattactttcagcatattttaagataactgtacctgcttatagagaaaacatagacaaaagggacttacgaataataacaacccttattggaatcaaaaacaccaattggaataaataaccaaccccgcccaaaaattgaaaatcaggagaggagttagggaagggaagattatggcctccttaactatttaa

SEQ ID NO: 12489 - DNA, 809 bp, Diabrotica virgifera
  misc_feature (249)..(262): n is a, c, g, or t
  misc_feature (264)..(288): n is a, c, g, or t
  misc_feature (314)..(338): n is a, c, g, or t
  misc_feature (371)..(388): n is a, c, g, or t
  misc_feature (506)..(526): n is a, c, g, or t
  misc_feature (559)..(577): n is a, c, g, or t
  misc_feature (649)..(687): n is a, c, g, or t
  misc_feature (689)..(711): n is a, c, g, or t
  misc_feature (750)..(803): n is a, c, g, or t
ctagttctagagtctattattattaaatttgttttgtttatagcttttatctgcaactgttcattccataaaaggtattatttgtgttggttcggtatattttatgtttgtttgttatattggtgagcaactctcagaatatctagcacataaatagctagaaacaacaaatggttattttgtcgcccatataccttctatagccgcagaaatgtattgaatacattttttgaaaggataggttattcnnnnnnnnnnnnnncnnnnnnnnnnnnnnnnnnnnnnnnnctattcataaagaagataatgataannnnnnnnnnnnnnnnnnnnnnnnncaggaattgttaggagggagcttataatataannnnnnnnnnnnnnnnnncatttttatatgcacagcatgatcaagaaattctctattattataggatgtgattatgttatatttatatatagtaatatttatattctataaaaattttatcacaatatagatatgnnnnnnnnnnnnnnnnnnnnngaggataatattaatattagaaaatatgaatannnnnnnnnnnnnnnnnnnggttaataaaggaaattggtaacattttttttcaccgtatattaaaaacatgtcttattgaattaaatattnnnnnnnnnnnnnnnnnnnnnnnnnnnnnnnnnnnnnnnannnnnnnnnnnnnnnnnnnnnnnaaatcattagcttttttatggaacggtggaaggaaggtnnnnnnnnnnnnnnnnnnnnnnnnnnnnnnnnnnnnnnnnnnnnnnnnnnnnnnaggcaa

SEQ ID NO: 12490 - DNA, 651 bp, Diabrotica virgifera
  misc_feature (48)..(67): n is a, c, g, or t
  misc_feature (529)..(550): n is a, c, g, or t
  misc_feature (552)..(564): n is a, c, g, or t
caccgtgtgtatcagacactcaatacataatacatacatgttttctannnnnnnnnnnnnnnnnnnngaaatcaaatttttacaggaaaaaatgcattgaacacatgtttgtcagagagagatgtgtatccccatttcatatatctagtttttctagaaatagattacatcgattgtttaagaagatatagataagaagatatatatgtatgattgttaaccggaattgtaaggaggatgcatctaatataataggtatcttgtatttgcttttttatgatgtacccacctcacgaggagaatctctatctttatagtgatgggagatcttagatatatatattgtaatttgaataatctactacaaatttgtatcacaatatagcgtttacattatattaacttagaaataagagataccttgaacattacaacatctgatgagttagtaaaagaatagttggatgctgccacgggaatttcgtagcccttttttcccccagcatgttaaaaatcatgccttattgcnnnnnnnnnnnnnnnnnnnnnntnnnnnnnnnnnnncgaatgcccgcgcaattttggccgggctaacgtaacttaatcctttgcttttctaatgggaagcggagagaaggggcttgtatgaaa

SEQ ID NO: 12491 - DNA, 995 bp, Diabrotica virgifera
  misc_feature (19)..(45): n is a, c, g, or t
  misc_feature (658)..(756): n is a, c, g, or t
  misc_feature (758)..(782): n is a, c, g, or t
  misc_feature (784)..(845): n is a, c, g, or t
  misc_feature (848)..(884): n is a, c, g, or t
  misc_feature (894)..(949): n is a, c, g, or t
cccacgcgtccgctagttnnnnnnnnnnnnnnnnnnnnnnnnnnnggttcatcattatatatagatatacaataaaaattaatattacctaatactagatatgatacccctccaccacaagaaaaatggggagttggcactatctttacctttttgaataccctataccatgaacataatgggttttctattatttttacttatattgtgtcttcctatcactgcccaagagagtagaggtgaagtgattatcttttaccttgatttttagttgttgaagatatccggaaccatatcatataaggttaattttgaaaatatgaaatttctactatatcatgatgaatttattccctcattagagctctcaagtagattaatattattttgtatcttctctattgagctatgaaagtgatagatgataattatgtcttagttttagaatagtgtgattatgatatgttttcatatattcaatatgtgttattgttttagtaaattttatctattagaaatataaatgttaaatctattgtatatattaacaatgtaagatacgtattatatatataaaaaagttgtatatttagctaaaaatatatcaggtttaataaatggaattctggcaacatattttttcaccctgtttattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnngnnnnnnnnnnnnnnnnnnnnnnnnnnnnnnnnnnnnnnnnnnnnnnnnnnnnnnnnnnnnnntcnnnnnnnnnnnnnnnnnnnnnnnnnnnnnnnnnnnnnctatagaggnnnnnnnnnnnnnnnnnnnnnnnnnnnnnnnnnnnnnnnnnnnnnnnnnnnnnnnntcattttatttggggtgattacaaaaaaaaccaaactttctttaaa

SEQ ID NO: 12492 - DNA, 928 bp, Diabrotica virgifera
  misc_feature (911)..(911): n is a, c, g, or t
gttattcgaaatatattttagtaagtaaaaaatcattattaaaataaaaggggccagtaagtatattttatgatctgttgaacatattttattagtttttggatttagtatacattttaggttccaaaagttatttgagtggttcataacagattctttttgtgcctcgtcttgaccatctttttaaattatacaaaatatgggtcagtaagcatctttttatggtctgctgaacatctttttattagtgtttggatacattttaacacataaataatttggtccatacagacatcttttttttttggcttttcctgaccatcttttttaaattatgcaaaatatgggtcagtaagcacctttttatggtctgctgaacatcttttattagtgtttggatacattttaacacataaataatttggtccatacagacatctttttttttggcttttcctgaccatcttttttaaattatgcaaaatatgggtcagtaagcatctttttatggtctgctgaacatcttttattagtgtttggatacattttaacacataaataatttggtccatacagacatctttttttggcttttcctgaccatcttttttaaattatgcaaaatattgggtcagtaagcatctttttatggtctgttgaacatcttttattagattttcgatatattttgaaacataaataatttggtccatacagacatctttttaaggcttgttctgaccatctttttttaaattatacaaaatatgggtcagtaagcatctttttatggtctgttgaacatcttttattagattttcgatatattttgaaacataaataatttggtccatacagacatcttttttaaggcttgttctgatcatcttttttaattatacaaatattgngtcagtaagcatctttt

SEQ ID NO: 12493 - DNA, 969 bp, Diabrotica virgifera
  misc_feature (932)..(932): n is a, c, g, or t
  misc_feature (938)..(938): n is a, c, g, or t
gattactaacaaacatatcttcagtagctccagaaggtgccatttctcttgaattgatagagtatactatataacaaattcggaggtggagttccatggagtgccttagtagaacctacgattaaaatctgcgaagaaggaattgaaatgaacgaacttacatacaataacgtaagagatcaaatcgatgttgtgagggctgaccctggattaagagaaatttttattaatccagctacaaaccaagtttacaagaaaggagaaacatataaaagagtgaaattggctcaaacattgagagtaattgcaagagaaggtggaaatgccctgcataatggatctcttactaagaaatttgtcgcagatatcaaagctaatggtggcattattaccgcaaaagatttagctgatttcaaagtggaattccttacgccagttaatacaacaatcagcggaaaacaaatatattctgttcccttacctggtgcaggtatcataatgacatatattttaaatatactcgaaaactatttacctcgcaatgatcatctttcagtgaaaacttaccaaagaatagtcgaagccctgaagtacggttatgctatgagaagcagcctcggagaccaagattttgttcctggactggatgatttgattaccaagctctcttccaaacgttatgctgcagatacaagaaagaaaatcactgatttaaaaacattcaatgaggccacacactatggtgctacattccaatctattcaagatcatggtacagctaacctctgtgtctggggtccaaatggtgacggaatatctcttacaagcagtattaattatatcttgggagcaggattcgtatcggaaagcactggcatcatactcaatgatttctatggatgatttctcgacaccgggattagtcaatgaantacggntatcctccatctccatcaaatttcattcgtc

SEQ ID NO: 12494 - DNA, 85 bp, Diabrotica virgifera
  misc_feature (13)..(84): n is a, c, g, or t
aagacgagaaacnnnnnnnnnnnnnnnnnnnnnnnnnnnnnnnnnnnnnnnnnnnnnnnnnnnnnnnnnnnnnnnnnnnnnnnng

SEQ ID NO: 12495 - DNA, 873 bp, Diabrotica virgifera
  misc_feature (661)..(684): n is a, c, g, or t
  misc_feature (717)..(754): n is a, c, g, or t
  misc_feature (773)..(795): n is a, c, g, or t
caggaagaccacaagaggaagcctctccgtaagaagaggaagttcgaattgagagatccagactgatttacgtgactgcttgatttaactttatattataccctcgtaatgtttggagatcgtgtaatagagccacataggtgatgattacatagttagtcacataggaatccacaagtgcttggtctcgctaaactaaatgcgcgtcatctttttattctattgtttgttttgtagcagaaatgatggaagatactacctatatgcgtactcttgaaaaaacagagatgcattgtccattaggtatagattttgaggtagaagatgaaatattattaacctcacatgtatagagggtggtacatataactgggcatcttctttgaatattatctatgatgtcttacgtataagagtgaaaattatatgattttgtagtaacgaaatcatgtatttgtatatcagtaatatcactaatcttcataaattctataacaagatagcgacttcaccctaattaagtaaaagaaaagatgacactagtaggattcaacattaggatatttaggaaatagtatatcagggatgtcattggaattaggtagcatttttttcacctgatgattaatacatgccttatagtatcaaatataaagactcnnnnnnnnnnnnnnnnnnnnnnnncggccgcggaattttgaccgtgctaacggaagnnnnnnnnnnnnnnnnnnnnnnnnnnnnnnnnnnnnnnctggatgaaaaaacattgnnnnnnnnnnnnnnnnnnnnnnncttcctttagccccaaggttcactttttttataagaacgcaaacccccccgagcccatcattcttcactccgcccttt

SEQ ID NO: 12496 - DNA, 260 bp, Diabrotica virgifera
  misc_feature (2)..(168): n is a, c, g, or t
  misc_feature (172)..(257): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtnnnnnnnnnnnnnnnnnnnnnnnnnnnnnnnnnnnnnnnnnnnnnnnnnnnnnnnnnnnnnnnnnnnnnnnnnnnnnnnnnnnnnngac

SEQ ID NO: 12497 - DNA, 849 bp, Diabrotica virgifera
  misc_feature (77)..(77): n is a, c, g, or t
  misc_feature (271)..(289): n is a, c, g, or t
  misc_feature (306)..(336): n is a, c, g, or t
  misc_feature (668)..(693): n is a, c, g, or t
  misc_feature (702)..(742): n is a, c, g, or t
  misc_feature (747)..(767): n is a, c, g, or t
cgcacattctgtagagttagaacttccaataatgtacatcccaacatcaggaacgctatgcagactaaactcatgangaaagagatttgtaaacttagcaaactgaactactttgcctgaaagttaaagggaacatatgattcccaactccaaacttaccattatataaacccttaaacactccctggcggggacgttccggaaaagggaaaactccccctctctctgttaattgccccccgccccaaaataaaatacccacttttttgtnnnnnnnnnnnnnnnnnnnggttaacaaaaaatctnnnnnnnnnnnnnnnnnnnnnnnnnnnnnnnaatcccccagcaaaaaaaaagatgacccatattgggacttttgtggaggggagaaatgatatctatatatcatcggcgtgattattcatacctctcccattcacatataaattgaaaatatctgaatgtagtaatgatgacgaaagaagcattaaggaatcgtatattgattacttatatgtaggagaaatagaggaataaggcgggatttttttcacctgtgtattagcaagatgatcatcttgaagtatggctacagtcgcgtctgcgcactgtttattgtcaatgagcgcgggattttgtccgtgctatgggagcaaagctcttgttgnnnnnnnnnnnnnnnnnnnnnnnnnnggtacgagnnnnnnnnnnnnnnnnnnnnnnnnnnnnnnnnnnnnnnnnnggttnnnnnnnnnnnnnnnnnnnnnaggaaaacccctataaagcatataaatatttcccacggcttttaaaataaattttctattaaaaatcaaaccatcggcggcg

SEQ ID NO: 12498 - DNA, 573 bp, Diabrotica virgifera
cgtaatattagataatggtgtggaaccatagtagaaaaattatttttcgcagcagccgatagagaagggtttcagaaacttgtaaacataatgacggccaagctcttaatacgaagaataaggacacggtacctaaataaaaagaaggtataaatacacacgaaattttattagtataatatcatccagttactactgattcttatgtgctagaacatgtcagaagtcaggcattttaatttattttgttatgattttgttctgtttgtttcattttgatattttagtctacaaataataatccatttactaacggtttatgctgtgaattttaacgaaccgcttgtattgacatgaaatttggcatgcacatagttaacatgtcaatgaaaaaaaaaaagtgatattgtgtcgatgtgtgctttttccctcggggtgagtttcacccctaattatacacaaccaaatgactaattcacacaatagggtctggatcccgcatatgaaaaggaggttgattggtgggaagttgaaaatttgatgatagattggtcgggttgggactggcgaact

SEQ ID NO: 12499 - DNA, 743 bp, Diabrotica virgifera
  misc_feature (4)..(40): n is a, c, g, or t
  misc_feature (42)..(544): n is a, c, g, or t
  misc_feature (551)..(588): n is a, c, g, or t
  misc_feature (608)..(621): n is a, c, g, or t
  misc_feature (624)..(646): n is a, c, g, or t
  misc_feature (654)..(676): n is a, c, g, or t
  misc_feature (706)..(737): n is a, c, g, or t
ctannnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12500 - DNA, 594 bp, Diabrotica virgifera
  misc_feature (473)..(490): n is a, c, g, or t
  misc_feature (499)..(516): n is a, c, g, or t
  misc_feature (578)..(593): n is a, c, g, or t
cccaaccaatggaacaacggcgccaaccagtggaacgctccaccaaacgctcaccaagcccacggtgtaggtcaaatcccagctggagttgatgcccaatcctgccccaactacccattctgttcttaagcgagctagacaatcaggctgacaacatgttgccaatatttatatagtttaattttgtatctcgacttaaaaaaaatagctgtgccgatatttgctgtgtgtataagtgatagttcggaaaacgtcttttctggtcataatcttgcaactgagtagatgtataatgtaaaatgtatagcatagttgtaaatataagtaaaatggtaacatttgccaatataatctataaatcagatacatttgcactagaatcgttaattttattattagtttctaatgagttgcattgttatgtagtcgtcgtccagaaattcgtcgtcgttaatgtaaattggttaaaaatnnnnnnnnnnnnnnnnnngctgcgttnnnnnnnnnnnnnnnnnncgtagagataccacaattttgtacctcttcagaaaatctagtacctacttttgataactgtnnnnnnnnnnnnnnnng

SEQ ID NO: 12501 - DNA, 783 bp, Diabrotica virgifera
  misc_feature (301)..(323): n is a, c, g, or t
ctcaaaggtgtcattataacaggttactttgattcagaacgagtttttgaccaaattttatagtgtggaaagggttaaaataccgttttttacatttttctccattcccaaaatgcaaattttcggccaaatcgatggtgatgtattttgggagtggagaaaaatgtaaaaaatgtgtttttatcgttttctacactataaaatttgatcaaaaccttgttttgaatcagaatatcttgtataatgacatttttgggtcccttctattaaagtgttatgtttttcattgatgctttgcgannnnnnnnnnnnnnnnnnnnnnntaaacaccaagtcacactgtgaaatcgcataaaataaaatttttacgtcccgcagaagctatataccaatttaccatggaatgtaccatataatattatgtctctctgggacgacttatccgtggtccatacagtatagcagtcactgcgaagtgtgattcgagcggacctgtaagtaaaataatagtgaatcatatatgattcgcgcggcgatcaacgtgttaatataagtatagtgttctgttgtgcaagcataatactaaatttaaacatgccacatgataacagattgagaaccttgctaatgtgcagaacttttttatgactttactaatttttagttatctgaatcacttcctcagagttgattcttgctactttagctatatgatcggggcaacgacagacattgttgctttttatgatatataatttgcttttctatctatattgggcctca

SEQ ID NO: 12502 - DNA, 188 bp, Diabrotica virgifera
  misc_feature (10)..(93): n is a, c, g, or t
  misc_feature (96)..(173): n is a, c, g, or t
  misc_feature (182)..(182): n is a, c, g, or t
gaagggttgnnnnnnnnnnnnnnnnnnnnnnnnnnnnnnnnnnnnnnnnnnnnnnnnnnnnnnnnnnnnnnnnnnnnnnnnnnnnnnnnnnnnacnnnnnnnnnnnnnnnnnnnnnnnnnnnnnnnnnnnnnnnnnnnnnnnnnnnnnnnnnnnnnnnnnnnnnnnnnnnnnnggtgattanaaaata

SEQ ID NO: 12503 - DNA, 276 bp, Diabrotica virgifera
cttcacgcgtccgcttgaagaagtatgcttatacaagtagattacattccttatggaactaaacaatgttgcaaccaacaacccatccattgttcgatgggtaactgatatcttgaatcaatacaataagacagctataccaccaggtaaccttccattaaacccgagaggaaatcctaaatactggaattatgtttggacaaattttggagattatattgatatttctatataataaattgcgtataaaagttattaataaagtatttgttacat

SEQ ID NO: 12504 - DNA, 186 bp, Diabrotica virgifera
  misc_feature (38)..(38): n is a, c, g, or t
  misc_feature (42)..(84): n is a, c, g, or t
  misc_feature (96)..(112): n is a, c, g, or t
  misc_feature (114)..(177): n is a, c, g, or t
cgttaaaaagctttacatttttttacaagacgagagancctnnnnnnnnnnnnnnnnnnnnnnnnnnnnnnnnnnnnnnnnnnncattatttatannnnnnnnnnnnnnnnngnnnnnnnnnnnnnnnnnnnnnnnnnnnnnnnnnnnnnnnnnnnnnnnnnnnnnnnnnnnnnnnnccaattttt

SEQ ID NO: 12505 - DNA, 233 bp, Diabrotica virgifera
gggaccgggccggaacccccgcctccacccgcccgcccggatgtgaggagcgattaggattgctttttcagtgaaacagtgatgataatatggactaggagtaacaaatcggtcatggagataggatattgtttgtcctattcaccaagaatcttcaaggcctcccgacttggttgaggtaaagagaaccatgcattgctggcggatggtcgggaagacgcttctatcaaagc

SEQ ID NO: 12506 - DNA, 923 bp, Diabrotica virgifera
  misc_feature (520)..(536): n is a, c, g, or t
  misc_feature (538)..(563): n is a, c, g, or t
  misc_feature (625)..(625): n is a, c, g, or t
  misc_feature (684)..(708): n is a, c, g, or t
  misc_feature (757)..(757): n is a, c, g, or t
cgttatatcaaaaagtgtagatgagttatacaaactaactatttgaataaaaactgagacatttttttatatttcaaatccagcgctgtatttttatcacttcatttacataaaagatgcttcaagtagtgaatgcaagggcatatcttacagattatgtattatttgctatgtatgtatttatgtatgtagaaacataagcagtttttgggagtgaccctaagcttattgaaattttgtttatttgaaagtgatatctgtttatatgaatctgtaacgatgggtttttatatttactttgcaatataatattttaaatgattataggttttactcgtattttgatgtattttcagaaatctaaaagtgaagtggtttagttttaatgatttgaaaaaggtggtgcaaacaattggagctatgacgatatttgtctttatttaatagtaacaagtataatcagggtgatccaacgatgttctgtacagaacaaattattcagtatctattagtttttgannnnnnnnnnnnnnnnngnnnnnnnnnnnnnnnnnnnnnnnnnncttcatggatacgtgttccaacatttttgtccttgtaggctcttaaaaaagaggatccaatnaattgtgttgtacatatcataccagtaaattagctatattaatatttctgctagttcgnnnnnnnnnnnnnnnnnnnnnnnnntcctggcccgatcctgtgtattttagtatatgtaatctttaaggcctanatttaaatgttccgttaaataatgtagagtttgcgtcaatggatcactctgtacataactaataaagccaatgcttgaaacactatagtaaaaaacttactaatgtgaatacctcagaaatagaaaactgttaataggttactttcaaatgtttgcatcgcctgaa

SEQ ID NO: 12507 - DNA, 943 bp, Diabrotica virgifera
  misc_feature (2)..(63): n is a, c, g, or t
  misc_feature (65)..(181): n is a, c, g, or t
  misc_feature (191)..(465): n is a, c, g, or t
  misc_feature (467)..(565): n is a, c, g, or t
  misc_feature (567)..(620): n is a, c, g, or t
  misc_feature (622)..(665): n is a, c, g, or t
  misc_feature (667)..(774): n is a, c, g, or t
  misc_feature (776)..(805): n is a, c, g, or t
  misc_feature (807)..(853): n is a, c, g, or t
  misc_feature (902)..(922): n is a, c, g, or t
gnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaagtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnngnnnnnnnnnnnnnnnnnnnnnnnnnnnnnnnnnnnnnnnnnnnnnnnggggagaataaaaaaactaaattaaaactttttttcaaaattaattatnnnnnnnnnnnnnnnnnnnnncccccccactcttttttcgat

SEQ ID NO: 12508 - DNA, 716 bp, Diabrotica virgifera
gatcggggcagtctctgccgctgagttcgagttcaggaaccgtgaaggcggcccagtatgggttggaatccaagggaatcctggtcatcctcatctggaaggtggagggttcaagctaggacaaggacaatcgagaacaattggagcacccgacaactgggctggacgtttctggggcagaacttggtgtgacgaaggttcaaaccattgcctaacaggtgattgtggtaatagagtacaatgtaatggagctgggggagtacctccagcttctcttgctgaaattacaatgaaaggagctggaggacttgacttctacgatatttctttcgttgatggatataacattgctattagctttgaacctgttggaggccaaggagatggcggccaatacagttgcaaaagagctcagtgccttaaacatctcaacgacggctgtcccaatgaactcaaagtccaaggcccaaatggattcgccatagcatgtaaatcagcttgtcttgccttcaatacagatcagtactgttgtagaggtgcttttggaacaccagatacttgtaagagatcaacttggccccgtaactatcctcaggacgtatttaaatctcaatgcccagatgcttacagctacgcttacgatgatcacaagagtaccttcacgtgtaaggcttcgaaatatattgtgcagtttggtgtttaggatatagagtaag

SEQ ID NO: 12509 - DNA, 502 bp, Diabrotica virgifera
  misc_feature (82)..(116): n is a, c, g, or t
cttcacacggggtccggaatattaattatagagttgttttgaccttaaagaaggaagaaagaaaggaagaaagggaagaggnnnnnnnnnnnnnnnnnnnnnnnnnnnnnnnnnnngcaagaaaagaagcaaacaacaattggaatgggagaaggaatgatatactcttgatgtttgaagagttggaaatgagaactaggttgaggttttcttagatattctcaatataaattgaggacagaggtaacctagtactgctagatatgtactaagatacgtattatccccaaaatcagttaagttctctttctgaaggaatcgattataatcaagctagtaatattctaatggttgctaacgtatggtgtaacgtgctcattcatcatcggttctataatactactattagggccatctacattgaactatgtagctttggacagtctaaaaataaaacatagttcagatgattttctataccagatagcgatactaatattta

SEQ ID NO: 12510 - DNA, 508 bp, Diabrotica virgifera
  misc_feature (381)..(413): n is a, c, g, or t
  misc_feature (415)..(433): n is a, c, g, or t
caggattgtaatctgagcaagggtatcatcaacctcccttcaccctttatcctggcttaggactggcagcacaaagtaccggcacagtataaagagggacagtagaaccactctccgaaaaattggaagtaaaatctgtagtcgcgcatggcgaccgcgcaatgttggcagccgcttttgccccactctcgcattgctattcgcatagaaacgtacggcttttaacagggaaaatccgcatccaccactggtgaattaccaattgcgtactgccggtatcacttcctgagatcaaagcgccgacagaagagtgattttactgtggaacctctatatactgtggtactggcgaatttagaggttgtttttttgctttgtttnnnnnnnnnnnnnnnnnnnnnnnnnnnnnnnnngnnnnnnnnnnnnnnnnnnnggacaatattaaaaattagatactaataatagtataaaggctgtagtaagatatggttatagtttaatgcatgct

SEQ ID NO: 12511 - DNA, 584 bp, Diabrotica virgifera
  misc_feature (73)..(94): n is a, c, g, or t
  misc_feature (140)..(161): n is a, c, g, or t
  misc_feature (399)..(431): n is a, c, g, or t
attgtgtttccgacaagaagtgcaaaacttttttaatatgatttttgaaaagactgtgattgtcgcattttgnnnnnnnnnnnnnnnnnnnnnntgcgagtgcaaatattcccctagatataatgtgatggaactaacannnnnnnnnnnnnnnnnnnnnnaacttcataatgttactacagaagatggatacatcttaaagatatttagaataaaagcaataaatgggaaggaacaagaaaaccgagaaccagtattactacagcatggcttacttggctcgagcgaacaatttctacatgccaaaaacaactccttagcccttatattatttaacaatggatttgatgtatggctaggaaatagtagaggaaatttccattctagaaagcatgtatnnnnnnnnnnnnnnnnnnnnnnnnnnnnnnnnntttacacactggatcaaatgggacaatacgatcaacctgctgttatagaccacatcttaaagacaaccggaaagcaacagatatcctatattggacattcccgaggaggtggatctttattggcaatggtttcaggacgacccgagtatagcc

SEQ ID NO: 12512 - DNA, 925 bp, Diabrotica virgifera
  misc_feature (421)..(442): n is a, c, g, or t
  misc_feature (815)..(815): n is a, c, g, or t
cggacgcgtgggtttataagcatttatataaaaatttacttattaatacaaatattttacaacaaaagaagcaacaaaaaattttaatggtacagtgagaaatttcgccccaaaagatattagtttgaggtaggtatgtacaagagaaaacattatagaaaaccaatacttatttgtacttttccgtaagtttattatttcaaatataaagatctctagtttgttctattcgaactcaaaaaattcatttctgataaatcagttataaagaaatgattttaaatattgtgcagtgaattcaacagaacaaattaatagtaatacattactaaccagtttcagtcttcctgaatacaataaggttatcgatcataaacacaatcaattctgtaccatcagactttgtatttaaaactagagnnnnnnnnnnnnnnnnnnnnnncaatgtcccaaaattcaaattacatacataatttgtatattatcaattttacaaaattttaagaaatatgtaatgatcagacttaatgtttacacaactcttcttacttcgaagaacctcttgagatagtatacctgccctacagtcattgctactaaaattactgcttcaaagaaggaccacatgactaccctagaatttgtgctttcattgatgcttctatgaattctgtctctaacctgcatatattcttggttcttgttttacaccagacaatgaaatttgtaagttctctgatcatttcctccaacttattagcatttcacccttcttgttgttctgccctttggagattccccaacagccatattanacataaccaactttaggtggtcatagttgacatcttgtttgagaaacaatatgtatatatacccagatgtgtgggctgcaaatgtgatttttttccggcagtttcccttt

SEQ ID NO: 12513 - DNA, 575 bp, Diabrotica virgifera
tgttcgacttttaaaatggaaaaaattacctgaggtgttcctaacagaatatattcctacgatttatacgtttcctagaacaatacagtatttacaaaaaggaaaagagaaaagttgtgatgttcttgctgaaagagatggtgtaatcattattgtatataatagcacaagggatgttttggtgcttgttaaacagttcagagcttcagcttatattcaaagggtatctgaggaagacagaaacaagttagtagacacccaaaaatatccggctcaattaggcataaccttagaattctgcgcagggttagtagacaagagcatcccttctgaagaaatagccaaagaagaaattttcgaagaatgtggttatgaagttaggatagatcgacttgaaaaaattggtgtcataagaaacttatccgtgactacaggagcaaatttaacattttattattgtgaagatactgatggtatgaaacgaggacatggaggaggagtttagtgaaagaacctgatggagtatgagctagagtggttatgaagtatggatacgtgataattcagggaatttt

SEQ ID NO: 12514 - DNA, 989 bp, Diabrotica virgifera
atttgttttaaattgtacaccttccagcttggatgatatagtcaaaaaattggtgtatattttaaattgtagtgtatgtataatttgtgtaaaatatattttagcttttatctcgataagtgaagttatggatcgatagatcatgctatgaatataaacgcagatgttgaaaaagtaataaatacattatcttccaagttccataagatattttgtgatagagatttcgtttgctgtgtcttggaggattttcaagtaatcctgaggaaccgaaaccgatgttgtgttgttgtgtttcctctgttgggtcggaattatttgaaagcagttcagtatcaggcagaactttttgaccttgtagtgtttaccttgggaagtgggaaaaattgttttgtagcagtatgtgacacaaaatttttaatcaaaaaagaagaaattgaggaacaaataatgccaaataatgaagaagctggaactggaaataattcgaaaaaaaagcgaccagaaagacaactttacgtacccccagctcaaaggaggttacctatatccgagttaccaaatggttcaaaaacggaccatggatcaagtccaaaagcaagaaaacaaatttctactactagtagaaagaaagaactaccagagaaggtaaaagctgtgactgaaactgagagaccaagttacaacgaagataatattagagatgccatattaaatcaatttaatgaagttagcaatttttcttacatgtggtggaagtatgaactgtctgacccacttgaaaatgaagcaaaaagtgtgtattttaagtcatttatgaaaaaaagtcgattgtgcaatttacgaattagaaatatttacaaattagaaactacgaagtctctgtatattttaagtaaaaattttgttctttggcaaccgaaaatttgatgtgctcatgaataataagaaatcctatatgaaaagccatttctcctagtagccttgat

SEQ ID NO: 12515 - DNA, 103 bp, Diabrotica virgifera
  misc_feature (14)..(66): n is a, c, g, or t
  misc_feature (91)..(91): n is a, c, g, or t
ggaatggaaggggnnnnnnnnnnnnnnnnnnnnnnnnnnnnnnnnnnnnnnnnnnnnnnnnnnnnngttaaaaagctttaaatttttttanaagacgagagac

SEQ ID NO: 12516 - DNA, 636 bp, Diabrotica virgifera
  misc_feature (2)..(364): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaaatgataaattagttaaaaaatatttagatgattataaaaatagtattaataaattgtatattgaataaatttatattggagtaagagcggacccccaccagcagatcacccagtgatgtgttaccgaggaaggattaagcaaattggatacacactgtgatgagcaggaattttatgtgataaaggtagagagatttgcggagcctaccatatgttgttcccataggcttagcggtaattacaccaaagggtcgcgcgacgagaga

SEQ ID NO: 12517 - DNA, 163 bp, Diabrotica virgifera
  misc_feature (13)..(43): n is a, c, g, or t
  misc_feature (45)..(154): n is a, c, g, or t
aagacgagagacnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttttt

SEQ ID NO: 12518 - DNA, 599 bp, Diabrotica virgifera
  misc_feature (5)..(107): n is a, c, g, or t
  misc_feature (134)..(200): n is a, c, g, or t
  misc_feature (209)..(238): n is a, c, g, or t
  misc_feature (351)..(381): n is a, c, g, or t
  misc_feature (452)..(545): n is a, c, g, or t
  misc_feature (556)..(594): n is a, c, g, or t
atgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttctttccccctctcccgctgnnnnnnnnnnnnnnnnnnnnnnnnnnnnnnnnnnnnnnnnnnnnnnnnnnnnnnnnnnnnnnnnnnnggtggtggnnnnnnnnnnnnnnnnnnnnnnnnnnnnnnattatctttctgcccgctccgcatccccccccaggtgtcggactgcccactgatcaaaaaaaatgcccgccctaccctgaccccgctaagggagaataatcaaaaaagataannnnnnnnnnnnnnnnnnnnnnnnnnnnnnngatcctcctccccgccccccatccaatttatcaaaaaaccacaaacccaaaattaaaaagctttaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatataacnnnnnnnnnnnnnnnnnnnnnnnnnnnnnnnnnnnnnnncttaa

SEQ ID NO: 12519 - DNA, 818 bp, Diabrotica virgifera
  misc_feature (2)..(382): n is a, c, g, or t
  misc_feature (390)..(439): n is a, c, g, or t
  misc_feature (745)..(780): n is a, c, g, or t
  misc_feature (782)..(796): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtgatnnnnnnnnnnnnnnnnnnnnnnnnnnnnnnnnnnnnnnnnnnnnnnnnnnttgatactatataatttgactataacatatataccaactaaattatataagggtcctgctgatgtatatactaaaatggatatacatgtatggacaagtaataatttctaggaatatcagaagataccattatcaatttttactcctgatgattataatcttgtttttccacattaatactataggctcgcctgaccactgataaagtagtatgttacgcgatattgagaccgtgctaaggaagtatagtcttacaatatttttattgaaaagtgacccgaaaggggttgaatgaaaaataaaccnnnnnnnnnnnnnnnnnnnnnnnnnnnnnnnnnnnngnnnnnnnnnnnnnnnttttcttaaagacgagaagacc

SEQ ID NO: 12520 - DNA, 70 bp, Diabrotica virgifera
  misc_feature (8)..(8): n is a, c, g, or t
  misc_feature (17)..(17): n is a, c, g, or t
  misc_feature (31)..(31): n is a, c, g, or t
  misc_feature (34)..(58): n is a, c, g, or t
  misc_feature (63)..(63): n is a, c, g, or t
aagcttanatttttttnaaagacgagagacnctnnnnnnnnnnnnnnnnnnnnnnnnntaagntttttta

SEQ ID NO: 12521 - DNA, 117 bp, Diabrotica virgifera
  misc_feature (5)..(66): n is a, c, g, or t
ggggnnnnnnnnnnnnnnnnnnnnnnnnnnnnnnnnnnnnnnnnnnnnnnnnnnnnnnnnnnnnnnttttttttgataataagaaaaaaattaccttaaggaaaaaaggggtaattt

SEQ ID NO: 12522 - DNA, 531 bp, Diabrotica virgifera
  misc_feature (17)..(41): n is a, c, g, or t
  misc_feature (45)..(81): n is a, c, g, or t
ccaatagaatttgattnnnnnnnnnnnnnnnnnnnnnnnnnaagnnnnnnnnnnnnnnnnnnnnnnnnnnnnnnnnnnnnncttgttatatattagtagtttgtgggtctgatccatcttttggttcaaactcagatttattttctttgatattaagcgtcaactggatatctccaaattccacaagtataacactcgactcaggattttcagagtctagcttttccccaaactcatcgttcactaccctgcctctggaggattcttcaacaacaagaagttctacctcttgtacatcgttagagccctccaggatctttcctccgcgaagcagattcagctagaaattttaagaatgaacgtggggctatttgaaacgaggaatagctttaatactatcaaggctatagtttgaatataacgacgaaaacatatacctataaatatctcaattgattgacccatcctatggtggtgttcgtcattatcgtgcatatttttctattttccccgattattcttatccacctc

SEQ ID NO: 12523 - DNA, 544 bp, Diabrotica virgifera
  misc_feature (180)..(234): n is a, c, g, or t
  misc_feature (248)..(265): n is a, c, g, or t
gtggtcacatcagctgacaaaaaacaataaaatgggagattacgtttgggttgacacaaggaacccttgggactttccaggtaatgctgtacgtggaggcactgacgctaatggtgatgaaatctatgttggcaaagctttacatcaaggagactggcttccagcaaaagttatcccaannnnnnnnnnnnnnnnnnnnnnnnnnnnnnnnnnnnnnnnnnnnnnnnnnnnnnnccaggttatgtgtnnnnnnnnnnnnnnnnnnacctgggtaccatgtaagggcaataatattccatcgaacgcagtagaaggaggagaaacagccgatggagaacctttatacgttggcagagttattcatagaagttcacaaacagttggaaaggtgcatccaagtcacagtgtctgctatataccatttggcggacgcgaacttaattttggtaattacgaaatattagtcaagagaaattaatttctttaaggttacttatatttgtctacccatatttttttgagtctgtttctaaacatctttttt

SEQ ID NO: 12524 - DNA, 55 bp, Diabrotica virgifera
  misc_feature (7)..(35): n is a, c, g, or t
ccctggnnnnnnnnnnnnnnnnnnnnnnnnnnnnngtataaagtatcgcctgccc

SEQ ID NO: 12525 - DNA, 795 bp, Diabrotica virgifera
atagcctaagattgaatcgagccaaacgtgtcaagagcaagttttctaaacaaacggatcagatgcgtccctgtatatttttggggaattcttaacctgtttcatagaataagacttattttattggcaaagtattacgattagggaatatactcacacgttgctactttccaatattttttctgatgctgtttcacaggagcgcgactgagacgttctcagatgagtaaccgtaactgccagctctagaggtgggcgcgtcgtctctttgatagctttcgctagagtctgactctgttttaagtttaagaggaaggagccgtaaagagtctctttgcggtcctaaaggttttcaaatgatctccgaagttagaatagcccggttgacgcagaaagctaggacgttgatgccagatcatgccccgtctacctagagatctgtaaaatacagatcaggaccagtctttacataaacattaatatggtctatgctttactttctaataacatttacattctaacgaagaataggcaacgaaaacgttcaattttaaatcaaattcttagttaaaatataacgatatcttctataacatttaaatgaacgtactaaccatattctttcaacactttattgaattttctttccctgttctttgattaagacctcttcgtgattttgtgttaatttgcaaagatgttagagcgacttgccctgacttaatgcatgttatatagcttttaatattttatactgtaaatgtaggttgtatggatataaatgctgatatatta

SEQ ID NO: 12526 - DNA, 416 bp, Diabrotica virgifera
  misc_feature (107)..(141): n is a, c, g, or t
tcaacatgactttttgcattgaagatatagccccgcctgcccatctgactattgtgcatggtagaggcatttggatcgttcctcggtgaaccaatccatctaaaatnnnnnnnnnnnnnnnnnnnnnnnnnnnnnnnnnnnttttatgatagccagagtatagctgaaattatgctaaccttatacctacaactatcccctttgagtgatctcccaatggggtgtccacctcacccgaattgctctcctctccctccttattctatccaccttgcttggagatttttctcggggttaacgggttggacgactctattctttggcccaaaaccggatgaccctctaattaatttcccttaatttcggttatactttgtgcaatttttctttcccttattgttctgtctaacatttct

SEQ ID NO: 12527 - DNA, 618 bp, Diabrotica virgifera
cccttcacgcgtccgcgcaacttaacagttgagctacaatgccttagtgtggttgcactgatccatagatactacggaccttattggggtagcgagagaagatgatatttgtatcgttttatttttgatattcgcgtgccgtgtgaggggagcctgaagaaataataaacagacatttagaatttatgaaattttttttgtgtaagagatggaaataaagatggtgaatacacagaagaaataacgcaatacagcgcagaagaattttctgaattgagaggatgagctttggtggaaaagagtgtgaatataattactcttctgtcaattgccatgagggtttataggcgaaggatatgatgttacagacgagtgtcggctacccttgttgtgagggtttaatccaacagaaaatcttcgatagtaattcatacatacgactattgcatcaattcacctaccaaaccttgaaaatctttctgcttattctggttctgaatccatcgtttggttatacagttagatgccttctcgctggtaagaaacgataagcgggtaaatctaaattccacaaggacaaccatcgattcccgactcaccgagcccagcttttcccta

SEQ ID NO: 12528 - DNA, 839 bp, Diabrotica virgifera
  misc_feature (40)..(58): n is a, c, g, or t
  misc_feature (800)..(800): n is a, c, g, or t
aaataattttccgttttccgaagtttttcctatcctaacnnnnnnnnnnnnnnnnnnnccaaacaaagaagaccgaacccttttttaatgtccactaaatatttaataacgttaaatggagaaaatgttcaaaagaagtaaaaaacaacaatgacgtttaacctcattgtccaagcttcagttgataattacaatacaaacaataagtatcaaagtttgaagtggtaatgactgtgcatatcatttctacaagatgaattactttttgctatacatatttctatttattttacaccaagttaactcactggaaaaagaaattactgtttatgtggaggccggtacagaatcgtgtttctaccaacccattaaaaagggggaaattgtagacctggattatcaagtcattgatggaggccatggagatttagatataaatttcaatttagttcatccgaatggtagaattcttttaactgatttcaaaaagtctgaaaatacccaccgtcttgatgctgaagtagaaggagactacaggttttgcttcgataactctttcagttcatacaacacaaagactgtattttttgaattaatagtagaaggagatgataatggagaatggagtagtgaaaacatgaagttcaacacagaagatgaagattttgaagctcaaataagcgacgtacaaaaaatagtaagtactgtgaggatacatctgactaaaattaggtacttacaagaattaattaaatccagtgaagccagagacagaaacattgctgaggataatttctttnaagttaattcatactccatgggtacagttgtccctgatg

SEQ ID NO: 12529 - DNA, 132 bp, Diabrotica virgifera
  misc_feature (7)..(44): n is a, c, g, or t
  misc_feature (64)..(77): n is a, c, g, or t
  misc_feature (80)..(102): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgacttttaaaattttacttgatctg

SEQ ID NO: 12530 - DNA, 532 bp, Diabrotica virgifera
agtcagccaggtgtcggtatagaagtcagtcctcacccgtcggcgatcgagtagctgagtgatgaatacattcatgtaatatgatgaaacgatggagattcatcgagcagacatggcgatgttccccagacgaggcgccacatgaggatgaagtaaaattcgtgtagtagcacttatcttacttttgtgttgttactgatgagtccctatgtgtggtgtataccagactatcaaaaacattaaactgagtatatccgacgacatcttatcgcctctaatgactacaattactatgtatgtgacaggaggattttgtgaagttattgagggaattacattgatgtatatgccacaacctaaatgtgcaaataaccaatggtggaaagtatgttgaggcgatgcagttaacgagtaggatcatgagagcatagaacttgcttgatagtgataagacatatcatctactgattcttcctccctagaagctgtgaaatgcttacgcaatagctgtatacacctactggtttgctta

SEQ ID NO: 12531 - DNA, 937 bp, Diabrotica virgifera
  misc_feature (276)..(333): n is a, c, g, or t
  misc_feature (846)..(846): n is a, c, g, or t
ctcttccttaattttgcaaaaattccgcttttcacattgttttttatctgtgttaatatatttgaagtgttgaattttattcctactattaaagatggctgatgtcgtagtagacgctgagagcaaaaattcaaaagaattatacggccaaggtgtacgagccttcattctaagagacttctcgacggctgtctcggctttaggtaaagccagccaacttctggcagatgaacatggagacgatttgcacgaatcgctcggtgaagtatatctatnnnnnnnnnnnnnnnnnnnnnnnnnnnnnnnnnnnnnnnnnnnnnnnnnnnnnnnnnncgtgcctagaaatgaagaatcgtcagaagaagataacgctgatgaaactgaagagaacgacgaggaaggtgaaaatagtaccgaaccacaagagaataatgaaaatgaggctaaagaagctgagaagtccgatgatgctaaaaaaacagatgatgctaaacaatcagatggcgaaaaacaaaatggtacaacagtcgcaaacggttccggcgaaggtacatcaaacggaatcacgaaagaagatggagctgatgaagacaccgcagctgaaactgaggacgaaccaacagatcttcaagtcgcctgggaggttcttgagctggccaagaaaatcttccaaaaacagggtaccgccgccaaaaagaaccttgccgaaacactgatagttttaggcgaagtttcattggaaagcgaaaatttcgaatcggccgtcaacgacatcacggaaggtttaaaaatacaaaaagacatattcgcaaaagattccagaacggtagcagaaacgtattacanagttaggagtagcttactctacgaacacccaaatagacgaaagcctataacagtttcacagttccttagaatacctttacacagaatcgcc

SEQ ID NO: 12532 - DNA, 77 bp, Diabrotica virgifera
  misc_feature (4)..(67): n is a, c, g, or t
attnnnnnnnnnnnnnnnnnnnnnnnnnnnnnnnnnnnnnnnnnnnnnnnnnnnnnnnnnnnnnnnnaattatttat

SEQ ID NO: 12533 - DNA, 423 bp, Diabrotica virgifera
accaaatatccgatgaagaaaaagcccagaaaagcatggaaggccaaactttattggttgaagctaaacgtgaaaatgtagctcttcagagtatgcactgatgaggcgttctctgtaactggcctctaactgaagtcaagaaacggttggactaccaagtagagaagcaaaacatcgagcgcagaattacccagaagaatcttgttgactatgttgtagctaaagtacgatcctcaattacagctgatcaagaaaaacaaaatattaacaagtgtatcagcgatttagcaggattggctaaagcataagattacatttaataaatgtttaagtatgtatgtacagtctataagtaagcccaaagtgtagacgaacatttttaatttcttttctttttattcttacacagtacattatacgttg

SEQ ID NO: 12534 - DNA, 923 bp, Diabrotica virgifera
  misc_feature (628)..(661): n is a, c, g, or t
aatttgttaagtattatttgttgctgtttcggagaaataacgggaaaattctgtgaatagttcgtattaaagaaatgtccatatttggacctttgatgggagatatggaagacgatcctttctttgggtgtcatatgcgacacatgcgtcaaatgagcaacatgatgaattcactattttctgatcccttctcaatgttgagaccaccaatgttgggatatgatgattatgaaaaccgggctctgactagtcgccacaacatgcacaattcactaatgtccccattttctatgccaattatgccaaattttaacagactgctcagtggatccttagactctatggccaatactggaaactaccacagctccaatactggaaactaccacagctccagtacagtgataagcatgacatctggacctgatggtcgtcaacaagtgtacaaagcaacttctagtacaagagtagcacctggaggtgtcaaagaaacccagaagacagttacagactcaatgacaggcactaagaaaatgtccataggccaccatattggtgaaagagctcatattatagaaaaggaacagaatattcatacaggtgaaagagtcgaaagtgaggacttgannnnnnnnnnnnnnnnnnnnnnnnnnnnnnnnnncaatgagtgggaaagtaaaacacggagatctgaaattcccagaataacagcaggttcatctagaaatcgtcatggttcatacatccattcatccataccagccataacagcaggatcaagtgctgctggtaggcacccttatagttcccccaatcaaccacaacaaccgaagaaatcaaatcattgaaaacttatgaagaaatccttcacaccccaggctgacaatagatttattctatcatcgttagattatagtattact

SEQ ID NO: 12535 - DNA, 954 bp, Diabrotica virgifera
  misc_feature (149)..(173): n is a, c, g, or t
  misc_feature (278)..(304): n is a, c, g, or t
  misc_feature (846)..(846): n is a, c, g, or t
aaattatgagataatatattacctaattttttctaacggtagtttctgtgagggttaaaatgccttatgttatagagataaatataaatttcggcctagtttttatctacaataaatggttcattgtataaaacattgtccattgttgnnnnnnnnnnnnnnnnnnnnnnnnntctctgcttgctttttgtttcttgagtgatgttggtaaattttatgtataaaagacaaaaatgtaataatattcaaaagttcagaagatatttgtgcgtatttcnnnnnnnnnnnnnnnnnnnnnnnnnnntaaaattcagtgaatctatttaagctaatacattagtgtttttaagacaaacaatatgttcaaatagtagatgtcagaaatttttttgatgttttgatggttacaatctgagtcgtgtggtcctgaaacttatttcttgtgaatttttatatcaactactgtattttgtttccaatttgtttgaaattgttcccaaaataccaatcaaacaaatcattattactcgaaaatagaaaaaaaatccttatagtttaattttatggtttaactcatccagttttcttcatgccattattttgttccatattttactaaaatgaagataaaggaacaatagtcctgctgtagatctgtttagttttataattattgtatacctaacttgcaatacctgacaaaaaaggtacacctgtacctccatctaccagtgagaagacaaaagattccttcgttcaagaaaacaatcacccctcatacctccatctttcaaggaattaagtgcatcagattaattacaaaaattttcgagtaaatatctactncacaatatattttttcagtattgtagaatttttatcaagacttcttgactttctgtcaattcaacacatgccttttacctctattgtgtttatttatacagggaaaaa

SEQ ID NO: 12536 - DNA, 957 bp, Diabrotica virgifera
  misc_feature (10)..(30): n is a, c, g, or t
  misc_feature (779)..(779): n is a, c, g, or t
  misc_feature (848)..(848): n is a, c, g, or t
  misc_feature (892)..(892): n is a, c, g, or t
  misc_feature (912)..(912): n is a, c, g, or t
ggaacttgcnnnnnnnnnnnnnnnnnnnnnaaatgttataaatcacaacagatcataatttaaaacatctatcaaagataaaaaaagttttgtttgtctttcgtttggctcctaaagacgattaaaaattcaaaaattataccagccagcccaaaacgcgtcgtgacgtcatccggttatatgtttacattcggcaccaacaaagtaaacaaaattgtacctatataattttaaattaaacattataaacgtcagtagaaaatacagttatgtgacgtcacaagtgtttttgatcgtttgaactattcatagaaaatttgtacttttacaaaatggttttattttctatagtaaattttctttcctatcatttgtgtgtcaaatgatagtgtcgtcagtgaaaaagaaatattctttcaaactttacatcaagagatatcgaaaattggtgacactagagaaataattatattaggagacatcaatagtcgaacgggaaaaatggaaaacaacaacataataggaccttttggtgaagaaatagtcaacgacaatggcgaaagacttatagacttatgcgaccaacttcagttaagaattaacaacggctattttaaccacaaagaggtacataagtatacatggacacagccgacaagaaatttaagatcaataattgactacgcaatactaaaacaacaaaccttattgaaagttgaagatatacgagtatgcagaggaatatgtaacatatcagatcatcatttcctaagagctanaatattcttcccgataagacacacaataacgaagacgaaaacaatcccggatgcagacaaaaatacttncaatataacagacgagaaatataactttagagagctattacatngaaagtgtaatatctctatncaacgagactcgacaatgacatactaagcccgaatatctaacaac

SEQ ID NO: 12537 - DNA, 543 bp, Diabrotica virgifera
aatgaacggacatgtatctcaagggaatcagtttagattatttaaagttttggtgccgttaggatgtttgatatatagtgatatgaccagatgtaaagtcaatacaattgaacaaatgcttagagatattaactgagaggaacaaatatatgggacgaaaaatctatttaagaataagagaaagaataatgatgtcaccaatgatcatgagcgtgagcgatttctccagcgtgtgttactggattttctcgccgtaaatgctctggatgatgaagcttacaaatatgcagaggtacttgtatatagctcagtggtacaaggaggacgtgtctgataaggctctactgaatatgggcgcatggaaaaatataagttttagagaacataaccaccggtcgaataggtgatgatatgtttagaatgagtctgaagaattaacacctaaggtgtatttgagatcaatgtgagtgatatggatatgacgttgctcgaatacacgactaaaggaatttcctataatggccaatagggccgctccaaaag

SEQ ID NO: 12538 - DNA, 885 bp, Diabrotica virgifera
  misc_feature (296)..(313): n is a, c, g, or t
  misc_feature (482)..(499): n is a, c, g, or t
  misc_feature (505)..(524): n is a, c, g, or t
  misc_feature (566)..(583): n is a, c, g, or t
  misc_feature (734)..(751): n is a, c, g, or t
  misc_feature (756)..(778): n is a, c, g, or t
  misc_feature (818)..(835): n is a, c, g, or t
  misc_feature (837)..(858): n is a, c, g, or t
aaaaaaacatttagagagtgcacacagaaaaacatttgagagtgcacactgaagacagtccttacaagtgtgaattttgttttaaacagttcggtgaagcacggggtttgaaaagacatttaatactacatagtggagaaaaacctcacgaatgtgaaatttgttctatgcaattttatagactatttgatgtgaaaaaacatatgcgatcgcacacgggagaaaaaccgcataagtgtgaaacgtgcttaaaacagtttattacttcaagtaatcggtcaagacacttgaaagtnnnnnnnnnnnnnnnnnngcacgagtgtgaaacttgttttaagcagtttattacgatgagtgagttgaaaaaacatttaagagtgcacacaggtgaaaaaccgcacacaggtgaaaaaccgcacaagtgtgagacttgtttaaagcagtttactacgaaaagagacttgaaaagacatttgagagtnnnnnnnnnnnnnnnnnngtaccnnnnnnnnnnnnnnnnnnnnccattttcttggagtggtgatttgaaagttcacttgagaatnnnnnnnnnnnnnnnnnnacacaagtgtgacacttgtttaaaacagttttttacgataagtcatttaaatgcacatttgggaacacacagtctagaaaaatctaacaaatgtaaaatttgttttaagcaatttagtacgacaagtgttttgtacagacacttaagaatnnnnnnnnnnnnnnnnnngtatnnnnnnnnnnnnnnnnnnnnnnnatttgctcaaacaagtgaactgaaaaaacacttgagagtnnnnnnnnnnnnnnnnnnannnnnnnnnnnnnnnnnnnnnngacagtttgctgatgatagtagtttga

SEQ ID NO: 12539 - DNA, 957 bp, Diabrotica virgifera
  misc_feature (754)..(754): n is a, c, g, or t
  misc_feature (805)..(805): n is a, c, g, or t
  misc_feature (848)..(849): n is a, c, g, or t
  misc_feature (886)..(886): n is a, c, g, or t
  misc_feature (911)..(911): n is a, c, g, or t
gaatagataaaatagcagaagcaagtttacatttgcgactacaggatggcaatatttatgttttaccaggagaaaaaggaggtattcaaactactatatctaaatacgcttggaaaatagctggtttaaatgtggaaattttggaaccgctcagaaaacttagaataacttttaatgggcttctcaagaatcagtcgtgcacagattttgaaaaagttgaacatattcagtttaactttatttatactgccatttgttcacctcatttctttccacaagatatcgatactgcattatttgctaaagccgttgccagtgatcattggcgggatggatcatggagaaataatatgattcatcaatatggctatgaacaacttggaaccataaaaggatttgtaaaaggcgattcatatccagtagagaacattttaaatttacctggaaacaggtctagaactaaaggaatcagtgaccgctttcttttaaaacgagcattaaggttaatcgttatagatgaatatggaagtatatttaatataattttaaaagttctacctgaaggaaattttcaattaaattatggatttgcacttttgagtaatgaaagaagatatcccatcaccgatatagaccttcaaatgcgccacgttggagagcacaaaacttttccagattgtataaaatctcgtgtaaaagttaatggtaagacttacaaaattgtagtctatctgaacaaacagaagataatcanatccagcagttacactgaatacggttacgaatattacactatacctgctanatgccatgtagatctatacagtggtaatggcttggtagaattnntggatgctataaggggcgagaaagtatttattcctanaccccaaatgtttaaaaattaattngatagtataccagaaaacttatacagctataaaagatgaagatctc

SEQ ID NO: 12540 - DNA, 857 bp, Diabrotica virgifera
gtgtcagactcctctacagctactttcaataatagctttccaggtctgaaatcgaaatggacattaagcaattctcaacctgtagaaactgactcaatgagccaaatgtcaggtcagagctatgcaagtgctatgggaactagaagacagttttctagtgcaatgggaaatagaggatctcaaagagagtcctctaacaattccaacaatggtgacactagtgattcgaataccgattattttaacagtcaatcatttccggctcttggaaggggaagaggtatggccagaaatcgaagaaattgatcatttttgactgcaatgggtcttgttccacttcatgagattgttaaatgagtatgtaactgattacattaggcgacaatattttttttagtgtcagattatttgatgtaattgtccttttgacaattctttaatcattgatgttttcttctattgtggtgtttttagatgtcatatttttatgtatgtaaattggtttttatctaagtatagaatattacattttagtttaataagataccagtaaagtatattggtttaccagtcgcctaatgtaaactagtatatacatacctatattatttttctttaatagttttaagtcaattttgatacagatcacgagacagatattttttccgtctagtccgaattgcgttacgtttcttgggccttgtcgaattgtgtcccaaatattttgattacctggccaccgataacgtctaatctgaattggattttatttcttaattagacaacccaattgccgtctaaacataatgaaatagaattaattaaaccagaaacccccctaggcggattatttcact

SEQ ID NO: 12541 - DNA, 534 bp, Diabrotica virgifera
  misc_feature (13)..(71): n is a, c, g, or t
  misc_feature (73)..(118): n is a, c, g, or t
  misc_feature (122)..(239): n is a, c, g, or t
  misc_feature (292)..(311): n is a, c, g, or t
ctgatgagggccnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttggggggttttgtggggttttccgtagggggagttgttgtttggtgtnnnnnnnnnnnnnnnnnnnnggtgtttttggggtgggaattttgtttgggtggtggttttgtttttatagggtatatgtggttgagttgggggggggtggttggaaagggggggtttggttggagtgtggggtgatgttgtttagtggagtgtgaggtattcgtggttgggaggatggggggtatgtgtataggtttgaaaggttggctgttgggaagtgtggtggagttatggggggggagt

SEQ ID NO: 12542 - DNA, 100 bp, Diabrotica virgifera
  misc_feature (2)..(33): n is a, c, g, or t
  misc_feature (35)..(54): n is a, c, g, or t
  misc_feature (62)..(97): n is a, c, g, or t
cnnnnnnnnnnnnnnnnnnnnnnnnnnnnnnnngnnnnnnnnnnnnnnnnnnnngaggtaannnnnnnnnnnnnnnnnnnnnnnnnnnnnnnnnnnnagg

SEQ ID NO: 12543 - DNA, 300 bp, Diabrotica virgifera
  misc_feature (2)..(101): n is a, c, g, or t
  misc_feature (108)..(145): n is a, c, g, or t
  misc_feature (165)..(178): n is a, c, g, or t
  misc_feature (181)..(203): n is a, c, g, or t
  misc_feature (211)..(233): n is a, c, g, or t
  misc_feature (263)..(294): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12544 - DNA, 947 bp, Diabrotica virgifera
gatactagtttttaattgatcgtatcagtaaaattaactatatgttacttaaagggtgtaactttttatgaagtttcgtaataaaatcaaccagacttttccgcaattaagcaacgaattgcgtactatatgactacaggtgtacaaaggattaacgctatgatcgacaacccaaaatctacttatatccatatacctctcatttatcatatgaacaacgacgacttagataaggacttgccacctctatggaaatacttacttaaagttaataaggacaaaccaggtctacatatagacgataataaagtgcacgaatgattgtctcctgaattcattaaagattgaactggtttaccagatgaagtgaaaacgtcgttagaagaagtacatattactgaagatgatcttaaaacaaagcatgtagaattaacttatgacaatttttctgcggaagatttacttaaagctgtccttccgactgagaaagatggtttatcaagtttttcccagatgggccacatagtacacataaacctcatagaacatcttttcccattcaaaagtataattgctgacattctttacgacaaaattcccggatgtaagtcagtagtaaacaaaataaatgtaatagacaacacatacaggaattttagtatggaagtattaaaaggagacaataatatgattactacagtcaaagaaaatacgtgtagcttcaaatttgatttttctaaagtctactggaattctcgactatgtactgaacatgaaaggactgtttaaaaattaacagcagcgatgtacttttttgacggtttttgctggcataaggtcctttttctataacctggcgcataaaaaaaaatgctacgatttatgcccacgattttgaatccccaaatccttttaaattggctaaaaattaaaattccaaaagcaaa

SEQ ID NO: 12545 - DNA, 895 bp, Diabrotica virgifera
  misc_feature (176)..(198): n is a, c, g, or t
catttcatccttattttataccttgaagatcgtcattttttgttgatttttttagttttaaattgttgatacataactcgaaaacgattaactttatagaaaaattactaaagaccgcttttgttccgaatgatgcaagaagactaaaataatatctgcccggcccgacaagttgnnnnnnnnnnnnnnnnnnnnnnncattgttggaatgaaggtagcggtaactttaaaattatggtgttctgatatagagaacttttcttcttttggtgcctattcgtttcgaatattggcgatcattctggctataattattttattatctgatgctgtaaatagattatttgttgttgtggagaaccatttcctcagattctttaaccatgatattctttttctcccaatttcctcgctttgtgaatacttgccttgaaggattcccttcagcaatctgcatttattgctgttgctcattatgaggccgagatattatttctccttttaatggtgtacttcacctctctttctttccccattcttcgtaatactgtcgcgttggtgattatgtctgccgatgatatccttatgattcgcctgcatagcctcatctcgaaggcttcaagttgtttctccatcgcttcgtatagagaacaatacatgatcaataatgaggatttcttgtggacttctaaacgccgaaaatatagggtaggagggggcaaaagtactgacggcggaaaggaacgcccttatgtattttcagcacttctactatgttgttgacattttctggggtataaaaagagacgactcctcatacgtggataacaaggtgaggttggtattcttttatctaattttgtctccattgttgaatggctccaatatgcagaaa

SEQ ID NO: 12546 - DNA, 216 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcct

SEQ ID NO: 12547 - DNA, 952 bp, Diabrotica virgifera
  misc_feature (748)..(748): n is a, c, g, or t
  misc_feature (907)..(925): n is a, c, g, or t
gttttagtaatttaactgttggctaattaaagatgtctcttactacaaacgtgcctgagttaacagaaaaaataggatttataggaggaggaaagatggccaaagcaatttgtgaaggaattgtcaataaaggactagtttcatatcagcaagtgtatgtatctagtaccgttcttgaaaacttatcttggtggaaagaaaaaggttgctacgtatttcaagaaattcgttttgtgacgccgaatgtagatgtaattttcatttgtgtgaaaccagagtttgaatttgttttgaaccaaatatacaatatacctgcttgtcgtgaactatttgcaccgaagttatatctttcatttatggctggtatctctttaaactggttggataacaagcttaatacgtcaaaacgtgagagaattgttagaattatgacaaatacacccatgacagtgggggaaggttgttctttatttagtggaaaaggcgccaccaaagatgatatgaaacttgtcaataaactcctgtctgctacaggaacttgtaaacaagtaccagagtatatcttaaatgctgctgaagctttaattgccagtggaccagcctttatatacatggccatagaagctttggctgatggagctgtaaaaatgggagttcctatggatctagctactgaattagcagctcagatgactttgggggctgcaaaaattgcacgggattccgggaagcacacaggacaacttanaggtgaggtgtgttttccaggagggacgactatacaaggagtacatgctttaacaaggggaggtatgagggcagcttttatagatgctgtaaaatgtgcttctaaaccagctgatcatttaagggataataagtcattcttttaaaggactagcacccnnnnnnnnnnnnnnnnnnntccttttttttcaggagtttttttctc

SEQ ID NO: 12548 - DNA, 532 bp, Diabrotica virgifera
  misc_feature (385)..(419): n is a, c, g, or t
taggatccgagagactgagatgtctattaataatataataggaaagtcctaatagccaagcagtaaaaactttgaccggagaataagatacccttcagtactgtatgagaatataccatgcaagaactcgttaacaatagtacacgctaatagatgccagctatactctacagcaagggaaatcattgtatagaatgatgtgacagctcgattgtccccttctctatctttcatggaaaaatatgctgctgatgccgagctactccgcagatccgcatctaccgcttaggaattcgacgatatcgagagagcctgaatccatcaattacgggaacttatggatcaacacattataataatctttcgtaggtatccaatactttgnnnnnnnnnnnnnnnnnnnnnnnnnnnnnnnnnnntcatgctataaatcactacaggatatattataaaacgtgtattggagataaaacattttgtgtgtcaattacgtaggcccgcacagaagatgccgaaaaccaaattataccca

SEQ ID NO: 12549 - DNA, 531 bp, Diabrotica virgifera
  misc_feature (116)..(153): n is a, c, g, or t
  misc_feature (335)..(354): n is a, c, g, or t
cggacgcgtgggatattgtaatatactatattatttatctatagtcagtgcattcgttgaacttgaatttatcagtggccagtgcattcgcatttcaaaatgacaatgcgttttgnnnnnnnnnnnnnnnnnnnnnnnnnnnnnnnnnnnnnncataaactaagttacgtgcacaacgtaggagaagaaccactaagaccactgactctcggacgattactagaacgcacaagtgccgagtttggtccaacaccagcagatacatcgtgccaccaggatagaacaattacattcaaagaattgcttcactaagctgacagactacctgcgtcatnnnnnnnnnnnnnnnnnnnnaaccgagataattacttattttagaatgatactagacttttcggagcctacaagagtccaggtgaatcacaccaggaaaataagaattataacattaaaaaaatctttcgtaaaaataaagtccagttgattacagttgcttgatgaaattataacgtgtgactctatgcttttact

SEQ ID NO: 12550 - DNA, 164 bp, Diabrotica virgifera
  misc_feature (2)..(162): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnct

SEQ ID NO: 12551 - DNA, 938 bp, Diabrotica virgifera
  misc_feature (7)..(42): n is a, c, g, or t
  misc_feature (44)..(795): n is a, c, g, or t
  misc_feature (804)..(935): n is a, c, g, or t
ccttctnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggt

SEQ ID NO: 12552 - DNA, 306 bp, Diabrotica virgifera
  misc_feature (69)..(91): n is a, c, g, or t
cctttacgcgcccgcccaatatgcagcgaaaaaggaaaagcccttttatatatttcggtcctttcatannnnnnnnnnnnnnnnnnnnnnngatagaaaccaacctggctcacaccgctgtaaactcacatcatgtaaaattttaaaagtcgaactgtacttaataatatagatgatacaccaagtataagactttaatccaacatagaggatgctagggtaaggatccgattgacctatcagagaagggagaaatgtaatccacgtaaggaaatcttgtctgaagctacacgtgggggactgaga

SEQ ID NO: 12553 - DNA, 143 bp, Diabrotica virgifera
agacgacttaaggctgaacagaaagccaaagaaaaggtgaaaaagctgcccacgcctgctcaccccaaaactaagaacaaacccgtgaaaaaagtagtccaatgatattttaacttaatacagctgtaatactaagggtatag

SEQ ID NO: 12554 - DNA, 285 bp, Diabrotica virgifera
gaagaagcaactagtaatattgaagaaaatacaactgaaagagatacataatgctctccacgtttttcggttgaaaatcgttataaaatgacaactggcaaaacctgaagataagtatttagacagtaccttatatatcagtttatctgtacctaatactcgtaggtaatattttttattgatcgttttagaattcctattttattaattttgagaatattgtaattataatttagtcttgtacctcaacatattttatatggaaataaaatatttattaatgtt

SEQ ID NO: 12555 - DNA, 865 bp, Diabrotica virgifera
ggtgtttttgaagagtttgaatgcagaatgaaagattacattctgaccaagggctgaaagtccctgaaatcttctataatgtttatttgataagttacaggggtgaaaaactaagagaaaatttagtgtgatttttaatttcaaatatcgaggggttcgtgcgagggcccgatggctggaagtagcattgtttcgatataatctcgattgaagattttgggcaggttgaagaaggtttcaagtcgtcatagaaagtttaatggcgatttgattaaacttcctatgacgatttgaaatcttcttcgaacttcctaaaatctttaatcacgattatctcgaagcagtgttatttttggttgtcgggttttcgcacgagcccctcgatatctcattcaaaaaaactttttattcattctaagggactttcggccctcggtaatcttacacctatctataaatctggaaatcgtgagtgtgtaaatacttatagaggtataactattcaatcagcaatcccaaaacttctagataaattggtatcgataaatcttacctgggcttgccgaaacataattattgatgagcaacatggtttttctaacggaaagtcaactgtaacaaaccttgtcaactaccagcaatacttgttgggtggatttgagaataagattcaggtggacagcatttatactgatttctcaaaggcatttgacagggttaatcataacctgttggttcataaacttcatgcgtctggctttggtgacccattgttaattggattaaaagctttttgatgggacatacagaacaagttcgtatcaacaattatgttttctaagaatttcattgttgttctggtgtc

SEQ ID NO: 12556 - DNA, 632 bp, Diabrotica virgifera
  misc_feature (3)..(69): n is a, c, g, or t
  misc_feature (89)..(111): n is a, c, g, or t
  misc_feature (113)..(135): n is a, c, g, or t
  misc_feature (164)..(190): n is a, c, g, or t
  misc_feature (193)..(238): n is a, c, g, or t
  misc_feature (248)..(266): n is a, c, g, or t
  misc_feature (271)..(338): n is a, c, g, or t
  misc_feature (386)..(407): n is a, c, g, or t
  misc_feature (414)..(427): n is a, c, g, or t
  misc_feature (429)..(441): n is a, c, g, or t
  misc_feature (476)..(534): n is a, c, g, or t
ggnnnnnnnnnnnnnnnnnnnnnnnnnnnnnnnnnnnnnnnnnnnnnnnnnnnnnnnnnnnnnnnnnnncccaaaccccctttttgggnnnnnnnnnnnnnnnnnnnnnnntnnnnnnnnnnnnnnnnnnnnnnntttttggcccggttaggaacccctttttnnnnnnnnnnnnnnnnnnnnnnnnnnnccnnnnnnnnnnnnnnnnnnnnnnnnnnnnnnnnnnnnnnnnnnnnnnaaaaaggggnnnnnnnnnnnnnnnnnnnttttnnnnnnnnnnnnnnnnnnnnnnnnnnnnnnnnnnnnnnnnnnnnnnnnnnnnnnnnnnnnnnnnnnnnccaaaccaaaaatttgggggaaaaccccccccttcccccttaaaagannnnnnnnnnnnnnnnnnnnnnctttttnnnnnnnnnnnnnntnnnnnnnnnnnnnggtggcccctttgggggacaaattaaaaaacggtnnnnnnnnnnnnnnnnnnnnnnnnnnnnnnnnnnnnnnnnnnnnnnnnnnnnnnnnnnngttacaaaaaaaagggtgggttttaaaatttccccggggaaatttttttttcccttttccccgggaaaattttttccccccccaaaattttttcccga

SEQ ID NO: 12557 - DNA, 867 bp, Diabrotica virgifera
  misc_feature (19)..(43): n is a, c, g, or t
  misc_feature (45)..(64): n is a, c, g, or t
  misc_feature (92)..(113): n is a, c, g, or t
  misc_feature (757)..(757): n is a, c, g, or t
gacgggcctaaaattctgnnnnnnnnnnnnnnnnnnnnnnnnngnnnnnnnnnnnnnnnnnnnntgtgagtatttaataatatacatgaacnnnnnnnnnnnnnnnnnnnnnnataatagcagtaaattaagtttgcctgttttaaaaaatcctatctgcatgtgattttttggtaccccttcaccatgagactttttacaaatttatctaacattaaaaccgaaacctcgatatggacaaaactcataaactattttaatcgaaccccttcaaacaggcagccaaatgaaattgatttatctacatcacaagctttgggtagcagattatttagtagtgaagttaaaaaatgtacacttattcctggtgatgggattggtcctgaaatttcagcggctgtgcagaaaatcttccaaactgccagcgtgcctattgaatgggaaagtgtagatgtgacacccgttaggggcccagatggaaagtttggtattcctcagctgctattgactcagtcaacaaaaacaaaatcggtctgaaaggtcctctcatgacccccgttggaaaaggacacagatctttaaatcttgctctcaggaaagaattcaatctttatgccaacgttaggccctgcagaagtttagagggatataaaactttgtacgatcatgtagatgttgtgaccattcgtgaaaacactgaaggtgaatattctggtattgaacacgaaattgttgacggagttgtacagagtattanattgataacagaggacgcatccaggagcgtagctgaattcgcttttcaatatgccaaaaagaacaatagaaagaagttactgcagtacacaaagctaacattatgcgcat

SEQ ID NO: 12558 - DNA, 821 bp, Diabrotica virgifera
  misc_feature (2)..(19): n is a, c, g, or t
  misc_feature (139)..(170): n is a, c, g, or t
  misc_feature (254)..(731): n is a, c, g, or t
  misc_feature (733)..(754): n is a, c, g, or t
  misc_feature (756)..(773): n is a, c, g, or t
  misc_feature (775)..(812): n is a, c, g, or t
annnnnnnnnnnnnnnnnngatcttattttatgagaaggatatcccgattgtatccagtgttctataattattgttgtgagagaagattgttattcttatatccccccccttgatgttctggaccttgtgaatcggggnnnnnnnnnnnnnnnnnnnnnnnnnnnnnnnngcaaatttactggagctactaaatcctcctttttattgaacgataactattgtacctagtttttttgtaatggaatgttattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnncnnnnnnnnnnnnnnnnnncnnnnnnnnnnnnnnnnnnnnnnnnnnnnnnnnnnnnnntaatttttt

SEQ ID NO: 12559 - DNA, 529 bp, Diabrotica virgifera
  misc_feature (273)..(290): n is a, c, g, or t
  misc_feature (332)..(351): n is a, c, g, or t
cccacgcgtccgggaaaatgacttacttaaaatcatgggaagagttcgaaaaggctgccgaaaaattatatctccaatcaccatcaaaagttagatatacaatgaaatatgcccattcaaaaaaccatctaatacttaaaatgactgatgatgtagtttgcctgcagttcaagacggaaatcgctcaagatgtcagaaaagtagataagtttgtaaataacttgctaaggcatatggtatccaaggaacattagtctaaagcttatgattagnnnnnnnnnnnnnnnnnnggttcatacaaaatgtatatattcactgtctgtgaaatcgcnnnnnnnnnnnnnnnnnnnngggttgttttaggtttttacaagaatcactaaaattttatttttggttatcaaaaatgttcaaaacgaagtgttctactttgcccttcactttgtgtagttatgtgatttcaatttaaacagttcatatattgtgacaatgtgttaatattaagattgttcccatgtataacacatga

SEQ ID NO: 12560 - DNA, 960 bp, Diabrotica virgifera
  misc_feature (271)..(300): n is a, c, g, or t
  misc_feature (524)..(550): n is a, c, g, or t
gtagtgagggttttgttaaaagaaggaatgtaacaagggaaaatagtgagggtttaaacaaagaagaacaaaataatgataagaaatcgagccgcgacgaagatatcgacgatggtgattctaaagaaacaaggttgacgttgatggaagaggtcttgctccttggtctcaaagataaagagggttacacgtctttttggaacgactgcatttccagtggcttaagaggatgtattctaatcgaattggggcttcgagggcgggtcgaacnnnnnnnnnnnnnnnnnnnnnnnnnnnnnnttcttgcgaggaaactaattattaaaagtgacacccccattggagacgtacttctggacgaggctttaaaacatcttaaggagacggaaccaccagaaacagttcaaagttggattgaatacttaagtggagaaacctggaatccattgaaactgcgatatcagttaaagaatgttagagaacgtttggcaaaaaatttagttgaaaaaggtgtgcttaccacnnnnnnnnnnnnnnnnnnnnnnnnnnntatgaccacacatcccctaacagacaatgtcacaaaaagtcgattaatcaagaaaattcaagatgccgttctctccaaatgggtaaataatcctcaacagatggataaacggatgctagctctgatattcctagcacacgcaagtgatgtactcgagaatgcttttgcacctctcaacgatgatgattatgaattagcaactaaacgagtaagaaactcctagatttgaatttcgaagaagaagccaacaaacaaacatctgatggggtttgtggctgttttcgctgctttactaaataaaaagtgtaacaagtatgggttattttttgccaaatgaccaatacctcaaaatcgaacttaattttagatcttttgaggtatagaatttaaaccttattagtttatttgat

SEQ ID NO: 12561 - DNA, 435 bp, Diabrotica virgifera
ccccctcccctctcccgtatctattttatagtaaaaaaattattcctaaaattaatagtaatgattacattttcatatgattagtacaatttgactgtaaaaatattctattatctatatgatttctgacgcctgaactaccatattattcctgtcgtcctacttctaagaactctttataacatatatctatataagttgaatgatattctgttcctatatagaagaaaatgggtctgtggtgctagtggatccgacgttacggaggcgggaatgtggcatgtttttgcgtcaatagtgacaattaaagtaaatttattggatacctctatacatagatcaatgataggtaataccatgggggtacctatctgatgccgccttgcagcagtccctctttcaccagttgggcgaaaagccaagacgacggcaacg

SEQ ID NO: 12562 - DNA, 583 bp, Diabrotica virgifera
  misc_feature (36)..(36): n is a, c, g, or t
  misc_feature (220)..(239): n is a, c, g, or t
  misc_feature (241)..(287): n is a, c, g, or t
  misc_feature (316)..(348): n is a, c, g, or t
  misc_feature (485)..(506): n is a, c, g, or t
  misc_feature (567)..(582): n is a, c, g, or t
tttttcaaataggcccgtttttatttttatttctanttttcttcctttgaaggggaagaggagaaatatgatagtgaaaaattaattagaaaggagagtattatattatattaatctcccaaaaggatctataaaatttggatttttgggaatattatagacttttagagatgaaagtatattatttacataagatataatatatccttgtatatctaannnnnnnnnnnnnnnnnnnncnnnnnnnnnnnnnnnnnnnnnnnnnnnnnnnnnnnnnnnnnnnnnnngtgtttataaaattgatagtaaaatttannnnnnnnnnnnnnnnnnnnnnnnnnnnnnnnngaaatgaatgtatatagaatttatagtgtgttgattagatccatctgattgagagttaatagatatagtaatttgatgatagatttatgattaattgtgacttgttgatagtaattttaatattgataatgatatgnnnnnnnnnnnnnnnnnnnnnngaaaaatatgattgaagtttatgagtgaatatgttaatgtcattgaatttatgtttatagnnnnnnnnnnnnnnnnc

SEQ ID NO: 12563 - DNA, 649 bp, Diabrotica virgifera
  misc_feature (600)..(624): n is a, c, g, or t
acaggtccgacggttggacagcctatatgcaaggaatctttaatttacttcaccaaacaggaattacagaagataggatacgcaagactatagaggcgcttacagaagttcaaggaatgtgtaggcttataagagaacttagtgaggacttaaattatgacgtcattattgtaagtgattcaaactcttatttcatagagacctggttggcagttaataaactacaagataatgtgttaaaagtttttagtaatccagccaagtttgacaagaacgggctattagtcatcagtatgtaccatttacaagaaacttgtaaattaagtactaaaaatatgtgcaaaggccaaattatgcaagattttattacaaaaatgaagaagcaaggtactaattacgaaaaagtggtatactgtggtgatggaatgaacgatttttgtccaatgttacgcttaaatgagactgatttagcttgtgtaagaaaaggtttcaaatgcgaggatataataagaaaatctaaagaagggacttataaggacgcattaggaataactcgggttgtgaattgtgaagtattatattggaataatggtgatgatnnnnnnnnnnnnnnnnnnnnnnnnnaaaatcttacccacgcgtccggcga

SEQ ID NO: 12564 - DNA, 259 bp, Diabrotica virgifera
  misc_feature (170)..(195): n is a, c, g, or t
tcgcatatgtgtacccagcttaagaaatgcgagcggaactgtgtgcgaagtgcttgcgtacagttccgctcgcatatgtgtacccagcttaagaaatgccaaatataattgaatttcaatgtgactaaatgtacttagttgtaaaaaaaataatctccttgtaaattccnnnnnnnnnnnnnnnnnnnnnnnnnnggtttggtatgacataccacattgtggcatgtacaaattttcagaaaataaattttgtataagt

SEQ ID NO: 12565 - DNA, 968 bp, Diabrotica virgifera
  misc_feature (4)..(769): n is a, c, g, or t
  misc_feature (776)..(812): n is a, c, g, or t
  misc_feature (848)..(870): n is a, c, g, or t
  misc_feature (933)..(957): n is a, c, g, or t
tgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnntgcgacctcgatgttggattaaagcttataattggnnnnnnnnnnnnnnnnnnnnnnntgttcgacttttaaatttttcatgatctgagtttaaaccggggggagcccggttgggttctannnnnnnnnnnnnnnnnnnnnnnnnaacaaaaggac

SEQ ID NO: 12566 - DNA, 928 bp, Diabrotica virgifera
aaagattgttgttattgtttatttgatattaaaatacataaactattctttttatgtgatgatatgttataagttataatagttaagtttcattaggattactatttaagcttgaaaaggaataaagaatggatcaaattaagcagacaaataataaaactgatgaacttcaaggtgctgaacccggtagtttgtccagtatagcttgtaaagaatccgaggaaaacacaggtattaatacagagagagatgcagaaaatcctttacaagagacagctgttgaaaatcaagacttctcaccagaacttaatgcatctaaatgtgatgaaaaagatacaacaacaggtccgagtgaaataaatagtacagctgatactttagatatcagaacagatccaaatgaaataaatagtacatccaatactttagacatggatatatcaaaaagtaaggatgaattgttgagtacaacatcagaggagatctcgaccacaaaccagttagatatcgtgaaaaaagcagagcctgttgtgccagtacacatgagatcatcattacagcatattttacagtataatagtgatgattctgaggatgaagacattcaaacacctttaaaaccagctctggcatccagttcatcatccagtgatagtgagtcagatatacaggaggttgacaatgcagaagaggatgaagatgttgatgagtttgtactctccaatgacagaaggaaaacaaaagtaacatcaaatccagattgtgaattacttgatccatcattgttagtaaatttaacaaatctaaaaattgattatgagaaagaagaatttacacatataggaaatattgccaattttattgacactacagtaacagtcgaagcctatagagaagtcagaatcatacgatatggaatacagttttg

SEQ ID NO: 12567 - DNA, 177 bp, Diabrotica virgifera
  misc_feature (7)..(93): n is a, c, g, or t
  misc_feature (102)..(176): n is a, c, g, or t
ggaatgnnnnnnnnnnnnnnnnnnnnnnnnnnnnnnnnnnnnnnnnnnnnnnnnnnnnnnnnnnnnnnnnnnnnnnnnnnnnnnnnnnnnnnncgagagacnnnnnnnnnnnnnnnnnnnnnnnnnnnnnnnnnnnnnnnnnnnnnnnnnnnnnnnnnnnnnnnnnnnnnnnnnnng

SEQ ID NO: 12568 - DNA, 767 bp, Diabrotica virgifera
  misc_feature (406)..(421): n is a, c, g, or t
  misc_feature (424)..(436): n is a, c, g, or t
  misc_feature (460)..(479): n is a, c, g, or t
atcatttcttaagatcccaaaattgatactctatgaccacctacactcttaatggatacatgactataattaataacacataatcttattgaatgaggaaagctcacaatgttgccattctagggactcatatctaattgaaaactaaacgacatagtatattagtctcccaaatgctattaagatcttagatatcatactataaattattgtttcatattgattttacaatagcttttatctatatcaccgcaatacttttcatttatattacatgtccatgaacaaatgaatagaaatcttcaatcgcgatatatgaatttattgagaatactttactctatttattcaatacagagtatttaggaactacaatgtagatgcaaatcaagagttatgtgaccannnnnnnnnnnnnnnnggnnnnnnnnnnnnngactctacgaaggacattatactnnnnnnnnnnnnnnnnnnnncatgattttacaacaattaatcgatgggctgaaaagatcgaaagataacatagaaaaaattattattagataaaatttgattatattattcaatatatataataccttctaagggcgattacaatgattatagcgtcacctacgacttttcaataccatttttataatacaatttgtctttatcctcagccctctgaataacctcttcgttcatgctatattgctcgccatcgagcattctcttgatgacactgaacatgggaaactggctgagagccatatctgaag

SEQ ID NO: 12569 - DNA, 715 bp, Diabrotica virgifera
aaaatcgtagtgcaatataatataaaagatttaataattccatgttctaaaaatatgaaatatatacaacaacgatatgttttgggttttatgggttttcttgcatctgtaatagcatacacactaagagtgtgccttaatattgccataacgaagatggttctatatagagaaaatgcacatatcgatccagatgcttgtccagatgaagattctaatcatcaaatattaactgaagaagtcccaacaaatttatatcattgggatgaaacgacaaaaggtatcatccttagctctttcttttggggatatgcagttagccatattccaggaggtttgctagctcaaaaatttggaggaaaaaattctctcggactgagtatactctgttcgtctgttttaacattgatgacaccatgggttatagtaaccaccaatggaaactggataatactggtagtatggagaagtataataggattagcacagggagtaatgcatcccgcacttaataatttattgtcaaaatggattccgctttcagaaagagctaaaattggtactttagtttttgctggaggacaaattggaacgatatctagcaaccttataaatgaaaccttagttaatgctacaggaacttggacttctgttgtttacttattaggagcaggggcaattatatgtgatatatttagggtaatattttgttact

SEQ ID NO: 12570 - DNA, 265 bp, Diabrotica virgifera
  misc_feature (2)..(169): n is a, c, g, or t
  misc_feature (172)..(234): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnncccaatctttttttgattaaaaagaaataaa

SEQ ID NO: 12571 - DNA, 368 bp, Diabrotica virgifera
  misc_feature (45)..(62): n is a, c, g, or t
  misc_feature (155)..(179): n is a, c, g, or t
  misc_feature (268)..(285): n is a, c, g, or t
  misc_feature (287)..(367): n is a, c, g, or t
atcccttttgaaatcttgactatttttcagaactcgtaaagaacnnnnnnnnnnnnnnnnnnaaacttagcattagtgacagaatattttatatgttatccaaaagaaatttattttccgcccctctgggtatcacggatgattatttactaatnnnnnnnnnnnnnnnnnnnnnnnnncaagacctaactcactacaacttttattggaaaacaagtattttaaataacttgtttgccctgaactgtgattctattgtacacatagnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12572 - DNA, 311 bp, Diabrotica virgifera
  misc_feature (64)..(83): n is a, c, g, or t
  misc_feature (85)..(116): n is a, c, g, or t
  misc_feature (165)..(201): n is a, c, g, or t
  misc_feature (228)..(245): n is a, c, g, or t
ctttacgcgccccgagacatattttatttttacaaaagcccccctttattccttgaaccttggnnnnnnnnnnnnnnnnnnnngnnnnnnnnnnnnnnnnnnnnnnnnnnnnnnnncgactacaaaattaaaactgttattgtagatgaagtattttaactaggnnnnnnnnnnnnnnnnnnnnnnnnnnnnnnnnnnnnnatgcctttttaagatatagagtaaagnnnnnnnnnnnnnnnnnncttctaagtacatagttttatcctattaataccagatatattgagggatgggcacagaaagaccat

SEQ ID NO: 12573 - DNA, 326 bp, Diabrotica virgifera
  misc_feature (14)..(18): n is a, c, g, or t
  misc_feature (23)..(23): n is a, c, g, or t
  misc_feature (26)..(27): n is a, c, g, or t
  misc_feature (30)..(30): n is a, c, g, or t
  misc_feature (32)..(36): n is a, c, g, or t
  misc_feature (38)..(39): n is a, c, g, or t
  misc_feature (41)..(58): n is a, c, g, or t
  misc_feature (62)..(62): n is a, c, g, or t
  misc_feature (229)..(229): n is a, c, g, or t
  misc_feature (252)..(252): n is a, c, g, or t
cataaaggggccgnnnnnacagnaannccnannnnnanncnnnnnnnnnnnnnnnnnnaccnagagaagaaaccgcaagagaagggcaaaaagaaaaagcaacgaaaaaaaccgcaaacacaaacgcaaagagcaacggggagacaaaagaagcacagcgcacgaagagacacaagcacaggggaacaggcggaccgaaaaaggaaaagacgaggcgcaccagcaaacngcaaagaagggcagagagggganagacgagcgacaagcgcggagcggcagaggagaagaggaagacgacacggacgacccgcgacggggacagatac

SEQ ID NO: 12574 - DNA, 87 bp, Diabrotica virgifera
  misc_feature (2)..(15): n is a, c, g, or t
cnnnnnnnnnnnnnnctaagttataaaagcttacacttttctcaaacgccgacgaacaaccctataaagcttttatataatttttta

SEQ ID NO: 12575 - DNA, 100 bp, Diabrotica virgifera
  misc_feature (2)..(98): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 12576 - DNA, 841 bp, Diabrotica virgifera
  misc_feature (2)..(747): n is a, c, g, or t
  misc_feature (754)..(791): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatctnnnnnnnnnnnnnnnnnnnnnnnnnnnnnnnnnnnnnncttttcccaaacgcaccagtaagcccctacagagtcttttattttctttc

SEQ ID NO: 12577 - DNA, 178 bp, Diabrotica virgifera
  misc_feature (39)..(39): n is a, c, g, or t
tcactatagaggaaagctgggtacgccgtgcaggtaccnggaccgtgaattcccgtttttttctttgctgcggccggtgaagagagactgatcaggatcctttttctcaggcgagtagtaggtgaggtggtggatatattgctaggtataagggaaagtgaggaagattaattaacct

SEQ ID NO: 12578 - DNA, 778 bp, Diabrotica virgifera
  misc_feature (2)..(36): n is a, c, g, or t
  misc_feature (55)..(97): n is a, c, g, or t
  misc_feature (107)..(147): n is a, c, g, or t
  misc_feature (154)..(213): n is a, c, g, or t
  misc_feature (224)..(501): n is a, c, g, or t
  misc_feature (503)..(550): n is a, c, g, or t
  misc_feature (552)..(581): n is a, c, g, or t
  misc_feature (621)..(670): n is a, c, g, or t
  misc_feature (680)..(722): n is a, c, g, or t
  misc_feature (757)..(776): n is a, c, g, or t
cnnnnnnnnnnnnnnnnnnnnnnnnnnnnnnnnnnngtagttaattaatattggnnnnnnnnnnnnnnnnnnnnnnnnnnnnnnnnnnnnnnnnnnnaccttggggnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnngnnnnnnnnnnnnnnnnnnnnnnnnnnnnnnccctggttattaaaaacatggctttttggattaaatatgnnnnnnnnnnnnnnnnnnnnnnnnnnnnnnnnnnnnnnnnnnnnnnnnnnggctaagggnnnnnnnnnnnnnnnnnnnnnnnnnnnnnnnnnnnnnnnnnnngtggatggaaaaaaaactggctttatttaaattannnnnnnnnnnnnnnnnnnngt

SEQ ID NO: 12579 - DNA, 663 bp, Diabrotica virgifera
  misc_feature (25)..(25): n is a, c, g, or t
  misc_feature (30)..(31): n is a, c, g, or t
  misc_feature (33)..(33): n is a, c, g, or t
  misc_feature (39)..(39): n is a, c, g, or t
  misc_feature (55)..(57): n is a, c, g, or t
  misc_feature (60)..(60): n is a, c, g, or t
  misc_feature (63)..(63): n is a, c, g, or t
  misc_feature (66)..(67): n is a, c, g, or t
  misc_feature (70)..(70): n is a, c, g, or t
  misc_feature (72)..(72): n is a, c, g, or t
  misc_feature (74)..(74): n is a, c, g, or t
  misc_feature (97)..(97): n is a, c, g, or t
  misc_feature (100)..(100): n is a, c, g, or t
  misc_feature (130)..(131): n is a, c, g, or t
  misc_feature (134)..(134): n is a, c, g, or t
  misc_feature (177)..(177): n is a, c, g, or t
  misc_feature (192)..(192): n is a, c, g, or t
  misc_feature (195)..(195): n is a, c, g, or t
  misc_feature (206)..(207): n is a, c, g, or t
  misc_feature (217)..(217): n is a, c, g, or t
  misc_feature (225)..(226): n is a, c, g, or t
  misc_feature (237)..(238): n is a, c, g, or t
  misc_feature (252)..(253): n is a, c, g, or t
  misc_feature (255)..(255): n is a, c, g, or t
  misc_feature (265)..(265): n is a, c, g, or t
  misc_feature (267)..(267): n is a, c, g, or t
  misc_feature (283)..(283): n is a, c, g, or t
  misc_feature (285)..(285): n is a, c, g, or t
  misc_feature (297)..(298): n is a, c, g, or t
  misc_feature (312)..(312): n is a, c, g, or t
  misc_feature (345)..(347): n is a, c, g, or t
  misc_feature (357)..(358): n is a, c, g, or t
  misc_feature (372)..(372): n is a, c, g, or t
  misc_feature (375)..(375): n is a, c, g, or t
  misc_feature (385)..(385): n is a, c, g, or t
  misc_feature (391)..(391): n is a, c, g, or t
  misc_feature (400)..(400): n is a, c, g, or t
  misc_feature (404)..(405): n is a, c, g, or t
  misc_feature (407)..(407): n is a, c, g, or t
  misc_feature (409)..(409): n is a, c, g, or t
  misc_feature (413)..(413): n is a, c, g, or t
  misc_feature (417)..(417): n is a, c, g, or t
  misc_feature (424)..(424): n is a, c, g, or t
  misc_feature (432)..(433): n is a, c, g, or t
  misc_feature (435)..(435): n is a, c, g, or t
  misc_feature (445)..(445): n is a, c, g, or t
  misc_feature (457)..(457): n is a, c, g, or t
  misc_feature (464)..(465): n is a, c, g, or t
  misc_feature (468)..(468): n is a, c, g, or t
  misc_feature (472)..(472): n is a, c, g, or t
  misc_feature (488)..(488): n is a, c, g, or t
  misc_feature (490)..(490): n is a, c, g, or t
  misc_feature (492)..(492): n is a, c, g, or t
  misc_feature (505)..(505): n is a, c, g, or t
  misc_feature (513)..(516): n is a, c, g, or t
  misc_feature (525)..(525): n is a, c, g, or t
  misc_feature (533)..(533): n is a, c, g, or t
  misc_feature (539)..(540): n is a, c, g, or t
  misc_feature (544)..(544): n is a, c, g, or t
  misc_feature (550)..(550): n is a, c, g, or t
  misc_feature (552)..(552): n is a, c, g, or t
  misc_feature (572)..(572): n is a, c, g, or t
  misc_feature (583)..(583): n is a, c, g, or t
  misc_feature (601)..(601): n is a, c, g, or t
cccatcaggggtccggactaccatngcccnnanaacgangaactctttcacccannnacnccnagnnggngncngcgccagccaggggccggcagcnccnaccgaggaaaaaaaagaccccgccaccggnncgncggaaagagcagcggcacgcgccgaagcaagggccaagagaancgaagagagcggagncancgacaaagcannagcgggggcncaagcagnnggcaagaaaanngaagaaacgggagnnancgacagagcncnagcgggagcagaggcncnggccaaaagagnngaacaaacgggaancagggacaaggccaagcaaacagccggacaacnnnacaagcaagnngaagacacgggaancancggaaaagcncaagcngaagccggnaggnnananaaancaancgacganaccggggnncnaaaccaggcnaaagagcaagcnaaggcannaancaanagcccacccgccgaancnangagacaaagaacncaccaagnnnnggagaaagnaggagagncaaaannaggngaaacncncgccgccagggcagagcccnacaagcaagcnggggccaaaccgggaggngccccagccaaacccgcaaaccaagaaggacagaagcccccaccgaccaccaccgcccccaa

SEQ ID NO: 12580 - DNA, 136 bp, Diabrotica virgifera
  misc_feature (15)..(42): n is a, c, g, or t
  misc_feature (51)..(113): n is a, c, g, or t
  misc_feature (115)..(135): n is a, c, g, or t
ctcctcgcgcccgannnnnnnnnnnnnnnnnnnnnnnnnnnncttacaagnnnnnnnnnnnnnnnnnnnnnnnnnnnnnnnnnnnnnnnnnnnnnnnnnnnnnnnnnnnnnnngnnnnnnnnnnnnnnnnnnnnnc

SEQ ID NO: 12581 - DNA, 415 bp, Diabrotica virgifera
  misc_feature (2)..(413): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngg

SEQ ID NO: 12582 - DNA, 541 bp, Diabrotica virgifera
  misc_feature (29)..(30): n is a, c, g, or t
  misc_feature (41)..(41): n is a, c, g, or t
  misc_feature (45)..(336): n is a, c, g, or t
  misc_feature (343)..(380): n is a, c, g, or t
  misc_feature (400)..(413): n is a, c, g, or t
  misc_feature (416)..(438): n is a, c, g, or t
  misc_feature (446)..(468): n is a, c, g, or t
  misc_feature (498)..(515): n is a, c, g, or t
gtcactcaagcgccgccgaaatgctaccnnagcacgggcanaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccgcggtgagccaggttggtannnnnnnnnnnnnnnnnnctacatcctaggacgaaaggacccca

SEQ ID NO: 12583 - DNA, 939 bp, Diabrotica virgifera
  misc_feature (25)..(26): n is a, c, g, or t
  misc_feature (29)..(29): n is a, c, g, or t
  misc_feature (50)..(68): n is a, c, g, or t
  misc_feature (294)..(317): n is a, c, g, or t
  misc_feature (487)..(505): n is a, c, g, or t
  misc_feature (689)..(710): n is a, c, g, or t
  misc_feature (784)..(805): n is a, c, g, or t
cctcccgcgcccgggctgcttccgnnatngaagagcccaccctcacatannnnnnnnnnnnnnnnnnnatagaagtgaccatccgccacagcgtcaacgtaaacctaaaccaaataagccaaaaactcaaataatacactcggaagggtttataagccaagagcaaatccaaactagcacacttaagcttgaacacacctcaactattgatactactagctctgctttcattgaatcagaaaaagcagacaacgaaatacatcaaatagatgtagatcatcccatagagaagtnnnnnnnnnnnnnnnnnnnnnnnnaacctcagcttccagaaaacacgacactagaaccagttacaaagcaagaaccaattattgagcctcaacagacctcaaatattaacatcagtacgtcagcgttaattgaatcagaaaaagcaaccagcgaaacacaaaaattaaaagtagatcaacccatagagaagtcnnnnnnnnnnnnnnnnnnnaacaaaacacctgcaaaagtaccagaacatagggtaaacatgcatataaatgccatgttcattacagaagaaataaacaattcattactgccagaaattacaaaaacaactgatgaacaagatgtgccagataaaattgaaataccagtggaactgcccaaaatggaccacaaagagaagtctnnnnnnnnnnnnnnnnnnnnnnttaaacctgtgcccgaagaaacatttactgaaacaattagtgaaaaatcagtgcccaaagatgagcctaaatcnnnnnnnnnnnnnnnnnnnnnncagactaaacacgaagatgtagtatccacagaaatatctaaaaatgaagccattggagaaaaaacacctcaggccattacacaagaagtaaaacagtaactgaaactgttatatcaacagatatatctaataaa

SEQ ID NO: 12584 - DNA, 541 bp, Diabrotica virgifera
  misc_feature (15)..(15): n is a, c, g, or t
  misc_feature (19)..(22): n is a, c, g, or t
  misc_feature (24)..(30): n is a, c, g, or t
  misc_feature (32)..(32): n is a, c, g, or t
  misc_feature (35)..(35): n is a, c, g, or t
  misc_feature (39)..(39): n is a, c, g, or t
  misc_feature (55)..(55): n is a, c, g, or t
  misc_feature (58)..(58): n is a, c, g, or t
  misc_feature (69)..(69): n is a, c, g, or t
  misc_feature (71)..(71): n is a, c, g, or t
  misc_feature (74)..(74): n is a, c, g, or t
  misc_feature (76)..(76): n is a, c, g, or t
  misc_feature (81)..(81): n is a, c, g, or t
  misc_feature (98)..(98): n is a, c, g, or t
  misc_feature (105)..(106): n is a, c, g, or t
  misc_feature (111)..(112): n is a, c, g, or t
  misc_feature (127)..(127): n is a, c, g, or t
  misc_feature (129)..(130): n is a, c, g, or t
  misc_feature (135)..(135): n is a, c, g, or t
  misc_feature (140)..(140): n is a, c, g, or t
  misc_feature (144)..(144): n is a, c, g, or t
  misc_feature (148)..(148): n is a, c, g, or t
  misc_feature (151)..(151): n is a, c, g, or t
  misc_feature (155)..(155): n is a, c, g, or t
  misc_feature (175)..(176): n is a, c, g, or t
  misc_feature (181)..(181): n is a, c, g, or t
  misc_feature (190)..(190): n is a, c, g, or t
  misc_feature (209)..(209): n is a, c, g, or t
  misc_feature (223)..(223): n is a, c, g, or t
  misc_feature (226)..(226): n is a, c, g, or t
  misc_feature (235)..(236): n is a, c, g, or t
  misc_feature (247)..(247): n is a, c, g, or t
  misc_feature (257)..(258): n is a, c, g, or t
  misc_feature (261)..(262): n is a, c, g, or t
  misc_feature (264)..(266): n is a, c, g, or t
  misc_feature (269)..(271): n is a, c, g, or t
  misc_feature (273)..(274): n is a, c, g, or t
  misc_feature (278)..(278): n is a, c, g, or t
  misc_feature (289)..(290): n is a, c, g, or t
  misc_feature (302)..(302): n is a, c, g, or t
  misc_feature (316)..(316): n is a, c, g, or t
  misc_feature (320)..(320): n is a, c, g, or t
  misc_feature (327)..(328): n is a, c, g, or t
  misc_feature (335)..(337): n is a, c, g, or t
  misc_feature (340)..(341): n is a, c, g, or t
  misc_feature (350)..(352): n is a, c, g, or t
  misc_feature (358)..(358): n is a, c, g, or t
  misc_feature (365)..(366): n is a, c, g, or t
  misc_feature (368)..(369): n is a, c, g, or t
  misc_feature (382)..(382): n is a, c, g, or t
  misc_feature (385)..(385): n is a, c, g, or t
  misc_feature (397)..(398): n is a, c, g, or t
  misc_feature (400)..(400): n is a, c, g, or t
  misc_feature (402)..(403): n is a, c, g, or t
  misc_feature (405)..(406): n is a, c, g, or t
  misc_feature (422)..(422): n is a, c, g, or t
  misc_feature (434)..(434): n is a, c, g, or t
  misc_feature (437)..(476): n is a, c, g, or t
  misc_feature (483)..(483): n is a, c, g, or t
  misc_feature (491)..(491): n is a, c, g, or t
  misc_feature (499)..(500): n is a, c, g, or t
  misc_feature (503)..(503): n is a, c, g, or t
  misc_feature (511)..(512): n is a, c, g, or t
  misc_feature (530)..(531): n is a, c, g, or t
  misc_feature (533)..(533): n is a, c, g, or t
ctcacgaggggccgngagnnnnannnnnnnanaangaanacctttcaaagaccgngcncacaaaggaananganangaaangcgcaccagaagaagangacccanncagcnncgaaggccccgaaananncaagngcgcnggcngcanaanaaangggaacaagggcaaaaacgnnaccgncaaaaccgncaagaagaaacagaagcanaagagcagaggcgnganacgcacaannaccaaaacggnccaaaagganncgnncnnnaannncnncagnccgccaacaannccagaagacgcnaaagaagaagacgnagangaagaannaaggaannngcnnaccaccgannncgaaancggccannannacagagaaagaancgncccacgagcggnncncnncnncaccggagaagcgggngaagacgaggangannnnnnnnnnnnnnnnnnnnnnnnnnnnnnnnnnnnnnnnggggacncagaaganaaagaggnngcnacaaaagnnaacaaagaacagcagaanngnaaacagca

SEQ ID NO: 12585 - DNA, 726 bp, Diabrotica virgifera
tcttctacgggtccggatagacttaacaacaaatttttttacccttattagcagagttgcatgacctttaggagagacagcataacccaaaaatggcgaaggagtatacctatcgggatttagagaaatacgctcaagcgcttcagaaagctatcaacagtaacgaaacgccagtaaaacagaagcatgttcgctcagcaatcatcggtactttccacacacaaagtgccaaaatattttggtcctatgctcttcgtcttcctgccatggatgacaggatcgtagcgtggaagctctgtcacgtggttcacaaagtgttaagagaaggacatccactttgcttggtggatagtcaaaggcatagaaatgatctggatgagattggaaagttgtggggtcatttaaaagagggatacggaaagatgatccgattgtatacgtctttgttattatacaagttggaatttcacatgagaaatcccaggtttcctggaaatttaggagttactgctgaagagctggagtccatcgctggaaatgatattaataattatttcgagatgactgtagaaatgtttgattatttggatcatatactcgaacttcaggaagcagtttttggctcgctgaatatgggtagatcgaactctatgctcaagcgccgggtaaggcccgtcttcgttccgttgctaccttgcatactgccacggcctccccccctatacc

SEQ ID NO: 12586 - DNA, 927 bp, Diabrotica virgifera
  misc_feature (25)..(122): n is a, c, g, or t
  misc_feature (124)..(154): n is a, c, g, or t
  misc_feature (166)..(202): n is a, c, g, or t
  misc_feature (204)..(216): n is a, c, g, or t
  misc_feature (218)..(388): n is a, c, g, or t
  misc_feature (391)..(627): n is a, c, g, or t
  misc_feature (629)..(680): n is a, c, g, or t
  misc_feature (746)..(764): n is a, c, g, or t
  misc_feature (772)..(835): n is a, c, g, or t
ttttactgggggggggggaaatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnagttgtgtattnnnnnnnnnnnnnnnnnnnnnnnnnnnnnnnnnnnnngnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnngtcgactgggaattgattaatttgaatggacggggtattttgatagtgttaagggaggataatttnnnnnnnnnnnnnnnnnnnttggaagnnnnnnnnnnnnnnnnnnnnnnnnnnnnnnnnnnnnnnnnnnnnnnnnnnnnnnnnnnnnnnnnggttaaaaagtttaatagtgtttttatggagtggatgggtaacggataaaggggggtggggtagagaggtagaaggagaggtattttttatg

SEQ ID NO: 12587 - DNA, 894 bp, Diabrotica virgifera
gttttcccctcaatttttttggttctcattttcgtaaaacttaatgaacttcaaaaattgattttgctaaagctggttgtaacttccgacgagcacaatacagatttttttgcacaatgtaaatcatttgttgtcaaattcgttaaattattgtctttattatttagtttttttctaattaatttggaaggtttttcaaataagtcattttcagcctttcgttttatcccgtgacttaagacttttctttctaataggttttctgattctggatcatgattatgattatggtttatactagttgtaattcgattcttattttctccaattgtttttatgaaagctttgcaattatcctttacacatctccactttgtttcacctgaagctaattttcatttttgttctttaaatttataacgttcacacactaataacaattttcctctttgactaaacatttcacttatactttcgctttaaagatgtcattatactctattttgtctggatactgaattagcaattaattgaaagataaattgattccactacgaggtgtcgagcgagtaacatcgttctgtattttgtcgtgctttgtaaaatatagtgcaaaaacagtgacattagcgtaccttcaactatgttaaatccaaacatctaaccaagctttatcctatgtatcaggccacggccaacatttccaaccaaggggaaactgtttcttaaattcgcaaagaacccaaaatttctgtaattccaagataaaattattagtatacctactataaggagtaataatacctacctgttaatcttcgagccgaaccctgggggttttaaaatgtatcaggggtatcataaagggctaaaggattatagtgagccgagatg

SEQ ID NO: 12588 - DNA, 897 bp, Diabrotica virgifera
gagtgatatacataattttccaaaaatgacactggccgcattttttatgttaattgcttatgctgtggctgataaacttcaaaacaattacttaccaccgtcaaactcaggagcttcagatggaggtgaatttcttactgcgccttctagagtagccaacgtttttgcaggattcaggtccagtcgacctacgtcggcctcctataacgtgtaccattcatcacaatttggaaaatctgcacctttggttgaccgacccaatgtagcattcagaaactctgaattctcatcttctggtccccaaattcctattttaagactcactagtgaaaataatggagaaggcagctacagatttgcatacgaaaccgataatagcatatcgcacgaagaagaaggccatcaagaaaccattggagcagaacaaggcaccgtagtgcatggcagctacacttaccaatcccccgaaggtcaaacatttactgttcactacatcgctgacgagaatggtttccgcgctactggagaccatctgccagtcgcacctccagtgccagaagctatccagagatccctcaaccataacttaatcactaaacagagtcttgtggatgttagcagaacgaacaacgaagaccacatcggagctaacagtgataattcagaagctcacgatttaaattctgttgaagttggtagaaatgatggtggtaatgttaacagacagtacttgggaccattcaagaataacaataatggatataggtattagtttttacaccacaagtctaatttgttatcagatattgttgtacagggtttgtaaaataatttatcaaatattatttggagttttaataacgatgaaagcataaataaacgaagaaaaacctaaaa

SEQ ID NO: 12589 - DNA, 937 bp, Diabrotica virgifera
  misc_feature (55)..(81): n is a, c, g, or t
  misc_feature (431)..(445): n is a, c, g, or t
  misc_feature (447)..(459): n is a, c, g, or t
cccggcgtccatattgctattataaacgtcaaagtcttggaatgccttattttgnnnnnnnnnnnnnnnnnnnnnnnnnnnctttttactagtctaataaagatggcttaaaataagtacaacaaaaaatacaatgtttaattctagtatctgtgagaaaaataatgtttttttggtacctgaagatattgaaaactcttgtcgtttatgtctcaacaaaaatgctttggtagatatatttaagactaaatatcaagaaactacttttgctgatatttttacaatggtttccatattggagattaatcccacagattatttgccaaagaagatatgtactgtctgtgaaaacttagtaattgaattttataaattcagtgaaaaagtgaaagacacacaaataattttacgtaattctctcatgctaattnnnnnnnnnnnnnnncnnnnnnnnnnnnntacagaaactttagaaactgataaatttgattatatttcagatgatggtactaatcaagagtgtagccatattgtgcttaagactcttgaaaaaaccataacatgctcattttgcaacagtcaatttgaaacatattctgcatatattgcacacagaaaaatggaagctgactcaagaagaaaaaaacaacattgcagtgtttgtaaaaaatttattagcacatataaacttaaagatcatatgaactcacatacaaaagaaaaacctcatcaatgtcagatttgtggtgaaaaatttaggttcttatctagtctatctagacataaattcagacatagggacaaaaagccccacgtatgtcacatttgtggcaaaggttttattcaagctccatctctaaatgatcatattagaacacatagtggagaaaaatcctgtatgtgtaatgcctgtggaataacttttattacaaagcat

SEQ ID NO: 12590 - DNA, 928 bp, Diabrotica virgifera
  misc_feature (721)..(742): n is a, c, g, or t
ctcgaataatcatcgtcatagttgtcaactcattctcaccttatatcgcgacagaaattttagataaaattatattacctccttgttggtgtttatttttatcagccagcagttgcactggagtcttcgcaaggatttctctcgataccaaagtgcgtaaatgtaaacgaaaatgaaatttttagtgaaagtgatggacctcatcatcctccagttcttatggattggttatgtcatttacaggagtgtttgcccggagaaaaagctgtaccactctatccaagatgaccgcagtttatcacaagacgaaaccaaaaacaaacgccacttcattcacctgtatacaacgacctcgatgaacggaaaacctgtgtgttacatggacgtctaccagatatactcagcttcagatgaagaacatctaagaagcgtttgctccaaaggcgtccctaacaaaacgtactacaggcacaaggaacgacttaccaaagagaggtcctacattccagacgaatggaaagattactctataatggctgtttgattcatttttgattcacatggaatttaaatctgcgatattaccgagtagttttctcgaacgaaagaattgatgcagatcatcaaatgtaggagaagtcggttttaaatatcatcatttacgtcctctgctggacttaagtctcccttaattgtttccacacttcatggttttatgctnnnnnnnnnnnnnnnnnnnnnntctgcctgaaatcatctgtccatcgtgtaggaggttttatatatcctccggaatacctgttctttttttagatcttcatttcttattttatccccaagggttaccaccggttcggatctggccattcgcccttggagcaaccctcattttctacccttgtgcctaagctagaggcagggcccctgt

SEQ ID NO: 12591 - DNA, 538 bp, Diabrotica virgifera
cgtaagtatgatcgaaatatgaaggcgcctttttactagatattatcgtgtctatattggattgtacttgcttatggcctgtgtggcggtgtgttattatgatcggctactattacacgtggatgggggccccgggaaaataggattgcaatagcaggggcatgtattaataagcttgtgagcgttaccattttctgatatgccgggggaccagaatgacgagtagactaattggctggtggacccgatccagttgtcccatttctcagaagtgtagatatatgtgagacttgtcagattaatcaattagctgcacttgatgtccatagatgcgaagatatgagaagacatgagatcactttaggttccgctgacgtataaaattgtgtacacttgacactcttcaggtttatctacgtttatgactcatgagatataaatgtcttcgatgttgataccttatacagtatgataaaaattgttacttgcacatttctcacaaaaatgtatcaaattattcatatgcttagatggatca

SEQ ID NO: 12592 - DNA, 271 bp, Diabrotica virgifera
accaattatattttcatatcatcttattcatctaaatgtattaacttcggcaaagataatttaaatgtagtaagaactccgtaattatgacatttaggtataaggagcattggatgaaaaataatgagtatttcttaatgacttcaaaaggaaaaataaatatagggtataccatttaaaatacgaaagttccttagatttccagaaaatctgaagatcttacaacaatgtaaataccactataatgtcggtcgcattacaagccgcttac

SEQ ID NO: 12593 - DNA, 608 bp, Diabrotica virgifera
  misc_feature (176)..(200): n is a, c, g, or t
  misc_feature (347)..(362): n is a, c, g, or t
gtcagtggtcttataaacatgttgttgctattatgtgtagttgagttgtctcttattgtattttgcatcactagtggctaattgtatgtaaggtaaacaaacagacttccccgccgatgccttcaatgcctggtgatgatgaggactagcatgcagacggacatgcaagtttaagnnnnnnnnnnnnnnnnnnnnnnnnntgtagcgggtcacgacagtgtcgaccagcgttccgtgattcgaggagacggtcaagatgttccatatgtaataagagtagatcataggtgaatcaaggattaggtgaatgagataccctgacttaatgtcgatagctgatgagaatnnnnnnnnnnnnnnnncacgtgaggatactactagatatattaaatgaatatatgatgttcttgaaggtatatatctcccgtgattgcccaaatgtgggatatggctacacaatggatgcaccttttcgctcatgatacagggccctgcttcaccgatcaatctcttcaacgtataccactaagcctgcgttctataggaccatcgaccaatgaacaaatacgacggattatctgaacatggaggcatgagagctgtagaat

SEQ ID NO: 12594 - DNA, 108 bp, Diabrotica virgifera
  misc_feature (63)..(76): n is a, c, g, or t
  misc_feature (79)..(101): n is a, c, g, or t
taacagcgtaattttattggagagtcaaatcgataataaagattgcgacctcgatgttggatnnnnnnnnnnnnnnggnnnnnnnnnnnnnnnnnnnnnnntgttcga

SEQ ID NO: 12595 - DNA, 846 bp, Diabrotica virgifera
  misc_feature (62)..(79): n is a, c, g, or t
  misc_feature (279)..(296): n is a, c, g, or t
  misc_feature (838)..(839): n is a, c, g, or t
  misc_feature (841)..(841): n is a, c, g, or t
  misc_feature (843)..(844): n is a, c, g, or t
atatcaagcatatttatatcaagtgcgctaaagtggctaaatgctaagcgagaagtaaatgnnnnnnnnnnnnnnnnnngtgtttaatggatattttataatcttattttgtaccttagccttagtgtattcagaaagtccagaggaagagcagggtgtaaaatacgcaaataaatgcgaagtgtgcaaaatactggctatcgaattggaatcaagactggaagaaacaggtaaaacgagcgaggttctcgaaacaggatattccgtagatgatgtgannnnnnnnnnnnnnnnnncatataaaaagtcagagctcaggcttgtagaatcattggaaggtgtttgtgatagaattttagagtataacattcataaagaaagggaagacagtacgagatttgcaaaaggtcagagccaaactttccaaacgttacatggattggtggataaaggtgtgaaagttgagcttggtataccgtatgagctgtgggataagcccagtgcggaaattacaaaacttaagactcagtgtgaaactttattagaagaaaatgaagctgctatagaagactggtacttcaatcatcaaggaaaattaaccttgaaaaaatacctttgtgaagatagggcactgaaaaatcaggaagccaaatgcttatatgaacaattaaagggcgaaactggagcaagaaagagtccaaagaagaagcaagagttgtagtttttctattgttttttaataaaaatatgtacaaaagttttatgagatcattttaaaatgtttttcattaaaataacaaaccagcaataattcatcaacgaatacaaactttactannanannaa

SEQ ID NO: 12596 - DNA, 92 bp, Diabrotica virgifera
  misc_feature (3)..(84): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnngttaggga

SEQ ID NO: 12597 - DNA, 875 bp, Diabrotica virgifera
  misc_feature (394)..(414): n is a, c, g, or t
cgcctgcagggacccggtccggcacttcccgccctcctcccacgcgtccggtctaatttacattgcattatttggcgccacctttaaagggctgtagcttccttgggaggaatttttggacaagctgatttatatgtaaaagacctaaaatgaatccatcaatttgtagttttctattctatggtaagtttctagacaacctggtaaataaatagtttcagaatcttaaatcaacagttattccgttggctcttcacacaaacatattcatataataattaggaaatatcaatttatacgttatacaatattacatattgttagcttataaatatacatttacttgaataatttaaacactaaggcaatagttaattgttaaaacaactctttnnnnnnnnnnnnnnnnnnnnnctttgtatatattgtgctaaaataagctgttaattccatggttttaagttttgtggccaataaagagacagtataaaacatacttggccaataatttccaaagttccaacggatagactatatccagatcaataacaatatcctgctgatttatttttagttcttaagcaaatcaaacaatcgtttcaatcattttgttatttatacctctaaacgatacatattttaggaacgaaaaatgttttgtttaagcacaaataattaaaaatgtaatggaatctatctggcaaataagtttgtatttctcgtttcataacgtgacaaccctgtagctatataaaatttatatttcgctaaagttatcgaattttgattgataagagagacatctaccgtttatatttctcgtttcatgatacaacgtggcaaccctgtagctatagaaattttgtatttagcta

SEQ ID NO: 12598 - DNA, 841 bp, Diabrotica virgifera
  misc_feature (543)..(560): n is a, c, g, or t
cctttggtgcattgatttcacacaagtgaaaatattgttgtgttaatttgaaaaactttttagtgaatttccttagcagtgactaagaaatacacacagtccaatttaccatggagaaaaaacagaaggcccccaaggagaaacgaaggaataacgaaaaacgaaaagaaaaatctcgaaatgctgctagatgacgacgatctaaagaaaccgaactttatctcgaccttgctagttccctcccgttctcaagcgagcagattagccaattggataaggattcatttatgcgacttgccatttcctatcttaaaatcagaaatatgatgacagctgttaccgactttataacatcgaacgaaactaaaagtcaggaatactgcatggtgtttctgaagagtctaaatatatatgagatgattttatctgatgaaggagatttcgtctatttaacagataacgcaatcaaatatcttataattaatctgattgagttgatgagccaaaatatattcgaatataagcatccatgttatcacgaannnnnnnnnnnnnnnnnnttcgggaacacaagaggtgacttaaatccaaaaaaatctcttttcgttagaatgaaatgtgctctgactaagaaaggaagatctgtaacattatagtcacccgccaataaagcaattcattgtactgaacacgtaagcaaaaaaaaagacctcgccaacaagacaacgaaaaatcaacccgaatgaagaattgattagtatctggtaatcaaaccaatcccccttccggccaaatatagaagtaatcctctttccaaagccaaacgttttttaaccaaact

SEQ ID NO: 12599 - DNA, 972 bp, Diabrotica virgifera
  misc_feature (344)..(367): n is a, c, g, or t
aatttttacgttgttgttgttaatagtgtagtgaattctgaataaaagcttatttttcagatccgatgtatactcacataggtcgataaatgcaatggcgtcaagatgctcgtaccgtgacgctgacgaaaacttttctttacattttccagataatatttttgttcactcggattagcgatttgtgcgttagcagcatggaaatttatgattacgttccatttcttacgagtcctggatagtcacatcgtactcaacggcattttacttatttctagctacgggttgtctagtcattttagtattccttttgggatgctgtgcgataccaaaacgttggaccnnnnnnnnnnnnnnnnnnnnnnnnctcttagtactactatttttattcgaaattttaattggtgtgctagccttcatcttccaggataatatcgaagaagatctgaatcttaattttaacaaaacgataataagcacttaccaattcgacgatagtaaaacgatatccatcgattatattcaggaaaagctacattgttggtggagctgtcaattatatagattggcgacaaaatgagtggatcaaaagtggatctgttttaaacagagttcccgattcctgctgtaagactgtgtctgaacactgtggatacagggatcatccttcgaatattcatgaagagggatgcatcagctacgttgcagaaaaaattaaaacaaatttctggataatatttatagccgcactaggacttagtgcctttcacgctattggcattattctaggaataattttgtttataaaagtggagtctggaaaacatgatggggaatacagtaccaaaaatggaggtaccgaggcactactttccgatgatcgacaacttcatttctgaattttatagttcagcaacatattctagtaaattttgtacttttgttatatcatctagcactacagctttaaac

SEQ ID NO: 12600 - DNA, 562 bp, Diabrotica virgifera
cttcacgcgtccggaaacagaaagatagaacggaagagcgtttattttgaaatgatttcttttacaaggatagttataattaccttcggagggaacgtggtcggttgtgcgactcaaaaacgtgatttttctactatttttaaatggacccgactagaatttgattatccatcagcatatgaaatagacaaatagattgtaagaggtatgtttttgtctgaataagcagcttttatcgatgttgagggttagtatgatgcacgaagagtgttatggattattatttgtgaaggagtgtctagatatagagcatggagactgtgggacgctgtgtgattttgtataggttggggcttattattattgttaggatgtagtgatgtagtatggtgtatttattagtagtcgatatcggcgtggtaaaaaagattttatttcatgataatggataatacgtgaaagtatgcttaatggtgtgggtaatatgcacttgccaattctaggatagattagaaaaattactagatagagtgctggatgtatgctatgcgggagttgatga

SEQ ID NO: 12601 - DNA, 717 bp, Diabrotica virgifera
  misc_feature (388)..(405): n is a, c, g, or t
  misc_feature (455)..(484): n is a, c, g, or t
  misc_feature (490)..(524): n is a, c, g, or t
cggacgcgtgagtcaacacgaaatatctgactcgaaataaggacggctacgattgtgtgatagcacacgtgacagtatgagagagtattttatttttatcaaccatgaatagatcttccggtaccttgggtatccgcgataataagtctacatttacatatatagaatctccgagttctaaaaatgtaaaatattaacatattgattagtgaaatcaatatcttaaacaaggctttttgcgatggacggacattcacacctgaatatatctaattgcttgacaaataatttaaatttatgtgttacctacatattgataccttaatatttttataataaggtacctgcatatttgtaccaatcaactgaaaaatatccctttagttgnnnnnnnnnnnnnnnnnncctctttggattacaaattttcatatatgataatatgtttattatttacnnnnnnnnnnnnnnnnnnnnnnnnnnnnnngaatcnnnnnnnnnnnnnnnnnnnnnnnnnnnnnnnnnnnatgagatgattatgatctataccatggtgtattgaatatgatagtagcagtatatatagtggatataggaatccggcatacacttctgtcccctgataattgaaccatgtgctttatgtattaagtctcgactgcccactgaccacttcgaaaagtccgaaggccgctgacccgtggtacggtactaagatac

SEQ ID NO: 12602 - DNA, 788 bp, Diabrotica virgifera
  misc_feature (2)..(44): n is a, c, g, or t
  misc_feature (52)..(164): n is a, c, g, or t
  misc_feature (174)..(490): n is a, c, g, or t
  misc_feature (492)..(667): n is a, c, g, or t
  misc_feature (672)..(782): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaaatcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattatt

SEQ ID NO: 12603 - DNA, 715 bp, Diabrotica virgifera
  misc_feature (313)..(330): n is a, c, g, or t
  misc_feature (339)..(358): n is a, c, g, or t
gcaatgaaggtcaccacatctattttccttttggtagctgtcctaggcttctgtcaggctggaatttggggaagttatggtggattagtaagggataccccgaggcttggtgattctgagtaacgtagataagaaaaatagattgacaaacatataatgaattaatactaaaattataacggatttacatttttatagtattttaagaactttattggaggccttaaggattagacgggggttcacatgcgaatgtatatataaatggtaaatcaataatgatagtacaagtattaacagaatgatggaagcnnnnnnnnnnnnnnnnnngagactagnnnnnnnnnnnnnnnnnnnngatgaggaaattgattatagatataaatagtggataatgtttgctagtcacattttaaataaatgataatgtattattatttaaagtagtcatccaataaggaatattaaagctcacaagttatagtataaaatagatgtatctcatttggaagtagttgttgaattatttcgatgtatctatttaaaatgctgaatcattatataaaagtggctataactaactctgttatcctatgatcatctagaaatgtcataagcggatgactgaaataaatgtaactgcacactgaactgttccaaatttataaccttggagttgtgtgatatggaacttatttaaatttcgaagtgaaaa

SEQ ID NO: 12604 - DNA, 949 bp, Diabrotica virgifera
  misc_feature (295)..(409): n is a, c, g, or t
  misc_feature (668)..(687): n is a, c, g, or t
  misc_feature (832)..(851): n is a, c, g, or t
ctctttatatattaccaacataaagagtgctactatagtagcactctttatgttggtaatatatacttcatactatagtagcactctttatatattaccaacataaagagtgctactatagtatgaagtataccgtctcgtttctactatagtagcactctttatgttggtaatatataaatttcacaatatatcaaggtctaattttttttagttacctagattaggtaatttatagtaatataatataatcaattgttaaaagtaaatgagtaagaaatgttacagtgttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttaaagggtccaagtttaaataccggggggtgggaccccaaaacttttttaaaggggcccccaaatttaattcccgggcccgctttttaaaacggcggggaggggaaaacccggggggtcccccaattaatccccttggaaaaactccccctttcccccgttggggaaaaaagaaaaaggcccccccccatcccccttcccaaaagttggccaccctgaaggggaaaggggccccccccctaaagcgccctttaaannnnnnnnnnnnnnnnnnnngcgcaagtgggacccggtaaattttgccggcccccaagcccccgttctttttttttttccttctttttcccccaaggtcggcgggttttcccggaaagtttaaaaagggggggtcccttttagggttccaattaagggtttaagnnnnnnnnnnnnnnnnnnnntttatagggggggggtccccggaggggccactccccctgaaaaaggtttttccccccttttagggtggaaaacccattttttaatacggaaatttttt

SEQ ID NO: 12605 - DNA, 923 bp, Diabrotica virgifera
  misc_feature (700)..(700): n is a, c, g, or t
  misc_feature (767)..(767): n is a, c, g, or t
  misc_feature (776)..(776): n is a, c, g, or t
  misc_feature (799)..(799): n is a, c, g, or t
  misc_feature (817)..(817): n is a, c, g, or t
gttttgattatgccatgtgttgatttttaaatgtaagtaaatggacaaatgatttataattttcataaacaagttcttaattgtataaaaaatcgttcatctttgcttagtactcagttttattcgacacaattacaatctgctatggaaaacatactaaaacctcctaatgtccgaggcatgcaggtattgaataaagacctaataaaaaaagatatagaagtaccttatttatcattgaagaaagacaacttaaataaagtcttgccagctctaacgaaatacttacttaaaattaaaaagtttaaaccagttcaacatattgaggagaataaagtggatgtatgtttgtctcctgaattcattaaagattggactggtttaccagatgaagtgaaaacgtcgttagaagaagtacatattactgaagatgatcttaaaacaaagcatgtagaattaacttatgacaatttttctgcggaagatttacttaaagctgtccttccgactgagaaagatggtttatcaagtttttcccagatgggccacatagtacacataaacctcagagaacatcttttcccattcaaaagtataattgctgacattctttacgacaaaattcccggatgtaagtcagtagtaaacaaaataaatgtaatagacaacacatacaggaatttaggtatggaagtattanaaggagacaataatatgattactacagtcaaagaaaatacgtgtagcttcaaatttgatttttctanagtctactnggattctcgactatgtactgaancatgaaaggattgttaanaaaattaacagcagcgatgtacttttttgacgttttttgctggttataggtccttttttcataccctgcagctaaaaagaaatgctacgtttatgccaacgatttg

SEQ ID NO: 12606 - DNA, 937 bp, Diabrotica virgifera
  misc_feature (2)..(44): n is a, c, g, or t
  misc_feature (52)..(760): n is a, c, g, or t
  misc_feature (775)..(850): n is a, c, g, or t
  misc_feature (856)..(926): n is a, c, g, or t
cnnnnnnnnnnnnnnnnnnnnnnnnnnnnnnnnnnnnnnnnnnngtacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaccctaatagagnnnnnnnnnnnnnnnnnnnnnnnnnnnnnnnnnnnnnnnnnnnnnnnnnnnnnnnnnnnnnnnnnnnnnnnnnnnngggggnnnnnnnnnnnnnnnnnnnnnnnnnnnnnnnnnnnnnnnnnnnnnnnnnnnnnnnnnnnnnnnnnnnnnnncaaattttttt

SEQ ID NO: 12607 - DNA, 915 bp, Diabrotica virgifera
  misc_feature (795)..(795): n is a, c, g, or t
  misc_feature (817)..(817): n is a, c, g, or t
gtgaatatttagtgggagttaaataacaaaaccaagaaaaaatggaatcgtttgttacgttaatagttaaagctccaaatcaacaaattgaagatcagacaatacagtgcgaaccttcatggacaattcacaaattaaagcaacatctatcggaagtgtatcccagtaaaccccctaaacacgaacagaaactaatatattcaggtcagttactaaacgatactgtaacgttaaaagaaatattacgacagtatgagggacaagaagcacacacagtacatttggtctgttcctccaagtatatgcaaaatgttcctgaaaccaaaccagtatctcagactagtacaccaaataatacccaaaatacaactaattcgacgacatcgagtccaaccacaaacgataacgcctctggaggacaaaacacagctggttttcctccaaatatgccatattttaacatgaacagcggccaagttgatccaaaccagtatgctatgcagttggcgtggatgcagcaggcttatttccagtatatgagtcaatatatgcaactggcagcaaattcatatggaacagcaggtcaggcgataccaaataatggagatccagttcccaaccaaccagaacaacctccagcagctcctgcagaagctcccgccgttgccagagatcccgataaccccgaaagagactggctagaagtattttatatgttaaccagagccactgttctattcattgttatatatttctattccagtcctattaggtttttatttgttcttctcttgngtttcagtttatacttatatcnaataggcttctttagaaatatgaaacacaacaataataacatcaatggccctcccgaacagccccagtagaagagccgcttccgtcgaggttcatgat

SEQ ID NO: 12608 - DNA, 682 bp, Diabrotica virgifera
  misc_feature (135)..(155): n is a, c, g, or t
  misc_feature (285)..(311): n is a, c, g, or t
gtctattttttctgtaatagaatggaataattaatatttcattatatgccattgcattatgttttaatgaaaatacaacttacctttcgtaccttctggctcagtaaaatctaatggtaatgaaatatttcttcnnnnnnnnnnnnnnnnnnnnngtattattgaaattatgattgcaaaacgagtatagtaactatagaaatattgtaaagaaaggcgcgtcgatgtaaaaataatctcattatttaagaattaaattatcctgtatttatcaacattatatannnnnnnnnnnnnnnnnnnnnnnnnnngcacagatattttccaattatgcacttaaattccacatttaattgaaacttaatctttctaaatacgtctaaggaagtacaaactttcatcttttttgatatgaaattatcatatttttatcatgtatagcgttcttatttcgatctcaaactatttaagcatatgtcacgtatagtagactgctgcaagcttatttctcatgtatatcagccgttatatgtaactggcatctataactatgtaacagcaggacaagcgacagcctctaacgtggaccccggtccctgtctaacttacccagatccagtagatcctgcagacgttcccgccgttgtcaaatctccccgataccctcgaaagaggtgtgcta

SEQ ID NO: 12609 - DNA, 88 bp, Diabrotica virgifera
aggattaattattgatcaagaattttgatagtttagaatatgttataatttattatcatatactattaggataattttgaccaaatta

SEQ ID NO: 12610 - DNA, 841 bp, Diabrotica virgifera
  misc_feature (3)..(566): n is a, c, g, or t
  misc_feature (573)..(610): n is a, c, g, or t
  misc_feature (630)..(643): n is a, c, g, or t
  misc_feature (646)..(668): n is a, c, g, or t
  misc_feature (677)..(700): n is a, c, g, or t
  misc_feature (730)..(758): n is a, c, g, or t
  misc_feature (771)..(834): n is a, c, g, or t
acnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcggannnnnnnnnnnnnnnnnnnnnnnnagtttaaaccggtgtgagccaggttgggtnnnnnnnnnnnnnnnnnnnnnnnnnnnnnaacgaaaggaccnnnnnnnnnnnnnnnnnnnnnnnnnnnnnnnnnnnnnnnnnnnnnnnnnnnnnnnnnnnnnnnngctctta

SEQ ID NO: 12611 - DNA, 854 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(796): n is a, c, g, or t
  misc_feature (798)..(848): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattacacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnncttccc

SEQ ID NO: 12612 - DNA, 278 bp, Diabrotica virgifera
cctttacgcgcccgcttagattgaattacctaatatttttcccttttatcagtgggtatgttgagaggtctcgtagagtgttcggatcatgagcgggggagcgaaatattgcgagaatgatatgatgaaactataggtgtacttgctcgtgatgtaccgcggggatcaaggatgagacaccgttatatagttatatctttggtatgctagatgtgatgacgatcgagtgccgactttagataggagtgtagattttaggaaagctgcgggatacgaaa

SEQ ID NO: 12613 - DNA, 786 bp, Diabrotica virgifera
  misc_feature (649)..(666): n is a, c, g, or t
  misc_feature (678)..(717): n is a, c, g, or t
gtgttacttatttcaaaataactcacatatactcttttacgaggagataccgaattgtcttatttagtgctcggtcattattattagatgataaaatgattgtctatttttatcacagaaaaattaatgttctttgtaccttgagtaatcatgccttagtaattctcaactattcatttcttcttttctaccttactctacccattccataagaattttgactggatactaataattgtattgacttttcttgaaatgatgtgatatgcgatactaagactatctattttgttccaacatgccctaaatatttaccattagcgatacatctacagttatctatcttttctattcttaggactcaacacttatgtctatcagctcccaaatactatgttattagaaccttatctctcttagataacaactaagaatacctatgttcttattacaaaatctgtaattatccctctttaaccatccttatatttatttgccagcaagttttgataacgatacaagaatagatacactgttgaatcttaatactgctgatatactcattgttagatatgtacttgttcccgcttgattgatccagagctacgtatttcacattcccccacataccttactactgtgtagtagnnnnnnnnnnnnnnnnnnctacatattatnnnnnnnnnnnnnnnnnnnnnnnnnnnnnnnnnnnnnnnncttgaccgtgctacggtactataatcattactttttttagtgaaacctggaatgaccgtgcgaatgaat

SEQ ID NO: 12614 - DNA, 322 bp, Diabrotica virgifera
ctataaatcatttatttaataaaagtagataaatacacttattaacacagtttctcttaaataatactgtacgcttcttggtttcgagaaaattcgaaatgagattatgaaacaatgagagtatttcttacattaacaacagcgcataacaaggatgtggcaactttgtagttttagtcagcaacaattttgttcgtaaacactaaccagaaccaaaaatacatcaaccaattgactaaattattcctagagaagagaagaacactttctggcccatgtatttaacagctctgtgtttttcgtatcaaaattgttggttact

SEQ ID NO: 12615 - DNA, 833 bp, Diabrotica virgifera
  misc_feature (16)..(714): n is a, c, g, or t
  misc_feature (716)..(756): n is a, c, g, or t
  misc_feature (761)..(830): n is a, c, g, or t
ccctgatacacaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnaaggnnnnnnnnnnnnnnnnnnnnnnnnnnnnnnnnnnnnnnnnnnnnnnnnnnnnnnnnnnnnnnnnnnnnnngtt

SEQ ID NO: 12616 - DNA, 766 bp, Diabrotica virgifera
  misc_feature (17)..(43): n is a, c, g, or t
  misc_feature (51)..(187): n is a, c, g, or t
  misc_feature (189)..(287): n is a, c, g, or t
  misc_feature (289)..(424): n is a, c, g, or t
  misc_feature (426)..(541): n is a, c, g, or t
  misc_feature (543)..(555): n is a, c, g, or t
  misc_feature (557)..(683): n is a, c, g, or t
ccctctctcgcggccgnnnnnnnnnnnnnnnnnnnnnnnnnnnctcccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggccgcgctattttgatcgtgctaagggagcatactcattcagttttttacttgaagccggaaacgaacgcccggtgcag

SEQ ID NO: 12617 - DNA, 509 bp, Diabrotica virgifera
  misc_feature (249)..(301): n is a, c, g, or t
gatggctcgaggacctaaaaagaatttgaagcgacttaagcgcacccttagcgtgatatcgctgacaccctgttgtggagcgtgctatttgacccacccgtgcacaatctcgcccggacctcttcagcatgagtgaatctttatcattaatatttttcttaaaatatgtactcatatctgacctccccaagcctggaaacacaaagatctgttatattttgattatgttatacgttcatatcctctccnnnnnnnnnnnnnnnnnnnnnnnnnnnnnnnnnnnnnnnnnnnnnnnnnnnnntatggttgaggtactacctacatatctattttccacatcgagtaccacaaatgctgcttctatttgccgaaatctcggcttgctccctctgcccagattaaagatctcacgctgctatcttttaaatgtccattcttggtgccacattatcacctcaccatgagataacccgaccctctctactctatgatagacatcgcatcgaatg

SEQ ID NO: 12618 - DNA, 901 bp, Diabrotica virgifera
  misc_feature (707)..(707): n is a, c, g, or t
  misc_feature (781)..(801): n is a, c, g, or t
  misc_feature (833)..(854): n is a, c, g, or t
cggacgcgtgggctaatagcattgtgttatccatttttagcttctagtgtcaatgagtacattccattgattattaaaaatctagatgaacatactgatggggtctgtaataatgctgcttgggtgattggaaagttgtgtgctgtgatgggcaatgcaatccaacctttccttccagaaatccttaatgcctttgttcatatattaagaacaccagctgtagctcgtaccatgcacaaaactgtagctatttccttatgcatcgtattctatgtgtgccccgatgtgactattccagaaatggatgtgattgttaagaattgctgtatgttagtgagaaatgttagggattcagatgagaaggatcttgcttttcgaggcttgtgtgaggtgattataaggcatccagaattcaacaagaactacttcatcttcttttgtgatgctgcagcttcctggatcaatatccgtgtagatttgaagcagacaattcgcaatgttctattggcatttaaacaacaatgtggtgaggataactggcgccaattttattgtcagtttcctgaagctcttaaacttaaacttcaagagttatatggggtatgaaataaacaatctacaaaaaacggggaattcgacatatgggtgggaaagcttgagtgcacctgccttgagtttatcgcgtaatagtatttaaatatcgtccngtgagggaggggcgtcttgccggtatcttagagtcacgcgttaataaaaaaatcgagaaggatttttttagacnnnnnnnnnnnnnnnnnnnnngggtagtttcttagtaaatcaactaaataatnnnnnnnnnnnnnnnnnnnnnngaattttataacaaatatggtaatttatattgtggaagtgtttttat

SEQ ID NO: 12619 - DNA, 886 bp, Diabrotica virgifera
ccttctacgcgtccgccagactcaagtttttcaagtagaacccacctcttttgtatttagatacattattttcaaagaagatgtaaaagaatatgaaatccatgaacgatttttggagttttccgactgcaatgaaaaactggagaagacatcgcaaatctaatcaaagaagttcttaaaaaatatgacatatccttagatgactgtagaggacagggattcgataacggcagtaatatgagtggcaagtataagggtgttcaggctcatattttaaaatcaaaccctctggctgtgtactcaccatgtggatgccacagtttgaacttatgtggagtatgcgctactgagaattgtactgaagcacagactttctttggtgttgttcagaatctgtacaatttattcagttgcagcccgaaaagatgggagcttctgaaagagatagtgggatcttcactgcactcattgtctgatacgaggtggagtgctagagtagaatgtgtgaaaccaatagcggcacacataggcaaaatcattgaggcagtttcatcattgttgaatcttaacgtaactgttgaaacgagagccacaatcaatggggttttagaatatcttaacaccttcaagtgcatcctcatggcgtcaatttgggtgaaagtgttggtacccatcaactacagaagtcaactacttcaaactatggacgctacttaggatgttgagagtagtaatatagagagcctaattgatgatttaagtgccttaagaaataaatgggacaagatattgtctgaatgcaacatgttgcaaatgcttatggtatcgaaccggaactctccactccccgtgcgagaaagaggaagactttttctcgatgaaacag

SEQ ID NO: 12620 - DNA, 675 bp, Diabrotica virgifera
  misc_feature (162)..(179): n is a, c, g, or t
  misc_feature (381)..(415): n is a, c, g, or t
  misc_feature (417)..(431): n is a, c, g, or t
ccctttctcgcgcccgcgcacccgtgggatttttatttattttcccttaataaaagattttttagtaaaagtatagaaccattttatttaatgatagggaattagtattgagagaatatgtcatttttataaaagaacaatttattgtgtgtaccttgtggnnnnnnnnnnnnnnnnnnctacctacatacttatgcatcttcgagtttatctcagctccgatattagaaatttttattgtagaatcaatattttacataatttttttgcaatgaactgttattcctttttcactatatctactttttgaagaaataagttcactttatttattatcaatatatttataactagatcctcttatattgttagtattagtgnnnnnnnnnnnnnnnnnnnnnnnnnnnnnnnnnnngnnnnnnnnnnnnnnngataaacattaggattaaaaagtttcatatcttaaaatatgttattatgtatttttatgtattattattcttattttgtacagatcttctattaaaatataaattcagattatttgaatttactaatgatgatgatatcactgttacgaagttggatatttagaaaggatatttaggatgtatacaggaattcggcaaccattttttctcacctgttttttagaaccttgtctttttgtattaa

SEQ ID NO: 12621 - DNA, 801 bp, Diabrotica virgifera
ctctataacgaggcatatttggttataacaaggaaaaatgaaatctaaaaatatgtttctttacctgttttagcgcagtaatggctataaataaatccccaactgcctttatatagaaatgcctaacatctgtgttattatcgaggtcagtgctgtaataaactccaccgcctgcaataaacttctttttgtttatctatcgaccgatattgaatattgtaagaaatttacaatttacgatgatacgaagtctcattgttcaggtcgaccatcgacacctaataaactacgtaagagacatcaaaacacttcaatattattgttgtctgatataacgagatccgcttataacgaggtaattagtccgccatttcagttctagttatagagggagtctactgtagttgtttatagatttgattcgcatgtggtcagctgtctcactggctctttattatcgtttttgtaacaatgtgccattataatattctcttttagtatccagttatgctgaattttggtcggctggtagcagactggcaaacgaacgtgactgggtctggatgtcaacaggaagaccaattaatgtgtttgactggggaacaggagaaccaaataacgacggtgacgaaaaatgtatctctttatattacaaaaattattcccatggctggtggaatgatgaaaattgtaataatgaactagcagttatttgtgaaacaagagattgttaataagttattattattcatattacatgtttccaaagtttttgttaacggtgttataatttattttgat

SEQ ID NO: 12622 - DNA, 234 bp, Diabrotica virgifera
  misc_feature (15)..(35): n is a, c, g, or t
  misc_feature (42)..(79): n is a, c, g, or t
  misc_feature (99)..(112): n is a, c, g, or t
  misc_feature (115)..(137): n is a, c, g, or t
  misc_feature (145)..(167): n is a, c, g, or t
  misc_feature (197)..(228): n is a, c, g, or t
gagagttcaaatcgnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12623 - DNA, 754 bp, Diabrotica virgifera
  misc_feature (688)..(688): n is a, c, g, or t
ggtatagtgaattatttttgaattaaaatgaagatactcttggcattagctttcgtcaaaatcgtagcatgcactcaattgcatcagaactatctacctcctcaacgaagctcttcgttttcatcatccggatcgtttggtggcagccatgctagtgcttattctggagcaagctcctactctgggtcttattctggctcaggacaacaaattcccattgtaagactggataatgttaacgaaggagatggatcatatcactttaactacgaaacaggtaatggtatctcagcccaagaacaaggtgaagctagaggagacggcaccagagctaatggtggcttctcttacacatctccagaaggtcagcagatccatattagctacactgccgacgaaaatggtttccaccctgaaggaaacgccatccccactcccccaccaattcctgaagctatcttaaaatccatccaacaaaatctggccgatgaagctagaggcgtgtctgatgacggttcgtacagaagtgacaactctggacaatacaacgctggaggagctggaggatttaggcaatctgcacactttggtggaggcggtgctgcatttaacagaggaggcagtgctgcatataacagaggaggtggataccaatattaatgtaaagtgtaaagcaatgtatatgatnttaggttgtgttcaactacgtgatatttaatgtgtttatttaataaagtgcaatttttatttttgt

SEQ ID NO: 12624 - DNA, 533 bp, Diabrotica virgifera
  misc_feature (3)..(21): n is a, c, g, or t
ggnnnnnnnnnnnnnnnnnnngatagtgtacttgaagaaaggggaagtaaaatgaaaataaacagaaaatagcttctcgctggagaggctgaagtaataaaaatactactttgcaggagtactgaagaaagggggaataataaaaggtgcagatgtgaatgtatactcgaagcacatgggtcttgatttttagtgtttttagtagtcggaccagatatgactgaagattaaggaagtccaactaacatatgtgttggtctttacatagctcgagctcaagagcaagatctagaaggattttgtagcatattgtgatactaatgattacaagacttagcaagtttcactatcttgtgagtgagaagggacgacccatactcttgaattaagtgcaaattatgctgcacgtagtagatgtgcaaatcggacctgccaatgtttggataagaacatatctatgtgttatactagcaagataacaaaacattcttcacgtcttgcactgaataaagatttggcttttattagcggtg

SEQ ID NO: 12625 - DNA, 890 bp, Diabrotica virgifera
gttcagtggtcatgtaccatgtgtcagtgtgccagatgaaaactgtcaagtttgttttgatgttaatttgtaatatttatcaataaattaaatcaaatgtaggatatatttaggtgtatgaataagtataccatttattagcagcagcagctaaactagcaaagtttgtctgtaacaagaaattctcatggcaaccgaaaaagatcttatagtaaaagaaacaatatatgcaggaaccaaatcagttccttttaaagatggtacaaagatccattttcatttccaaactcggcagtgtaacagtgagaaaattttactagatgactccagaaaactgggaactggaaagccctttgagttggtgctggggaaaaagttcaagcttgaagtatgggaagctatagtacaaaaaatggccctaaatgaagttgcaaaatttactgtggataaaagtctggtgattcaatatccttttgtttctaaaacgcttagagatattaataaacctcatggggaaagaaatcaccatgtgtgtgcaatgacccttcaaactacaggaattggatacgacgacctgaacagttttcttaagaatcctaccgatttggagtttataatagaaataaccaatatagaacaacctgagtcctacgaaaaggaaacttggcaaatggaggaaggggagaaaattgagctaataccaaaattaaaagaacaaggcaatgaagagtacaaaaataagaattataaaaaggcatctgaattgtatgccaaagctataggcatactggaacaacttatgttaaaagaaaagccccatgatattgaatggaaatgaatgaataaacaaaaagtgcctatacttcttaattatgctcagtgtaaattac

SEQ ID NO: 12626 - DNA, 133 bp, Diabrotica virgifera
ggcaccgatatcttttaaggagcgtgtgtgggatagtgagataaagatgcaagatatataagaccgatagagtataggccaatgagagacattctacagaggttttaaatgtttgctctgtatcgaacatggt

SEQ ID NO: 12627 - DNA, 884 bp, Diabrotica virgifera
  misc_feature (73)..(96): n is a, c, g, or t
  misc_feature (551)..(567): n is a, c, g, or t
gtaaaaatttgccaccgttggcttatttttcagtatttttccttgacattttttttaattgtacttaatatgnnnnnnnnnnnnnnnnnnnnnnnngttgtaccatagtttaaaaaaaaatcacaaaactgtgcttgaaatgttgatttcaaaccatacctccccttaaacatgcatcattgtactactgtcatttattctttattgttctttagcttcggctttagcttcagttatagctggagtggttttgttgtctctccaaatgcagtagtttagcgctgtggccaaacctaaccagatgcaatatggtacgataaggtagccagctgtagggttgatcttgtggaaaaggtataccatacccaaggcagtgccgtttattagctgaatctcaataagagccagctgtagatccttctttccaaagaaaattggagtccatgcccaattagctgcgagattaaccccgtagacaattaatggtaatttggcgggtccctgaaatccgcccccgtctctgtacacaagatatgaagcataccccattnnnnnnnnnnnnnnnnnccaaacagggccaaatgcccaatttggtggtctgcattttggtttcttcagattttcgtaccatggattaatactcttcctggttataaagccaccagcaattcctcccaagttgggcaaaattgtgaaaccaagagcaggccaatttaactgaatcatttttatacttagtagttccagaagattcgcttaaaacattcaataaatcttacctttagtgctcaggtgattgaatgcaatcttatctttattagtggatgacgttattttatgcactattaggtgtaaagtcaaattccgttaatttatacctgcct

SEQ ID NO: 12628 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12629 - DNA, 820 bp, Diabrotica virgifera
ctccgttggaaaatagaaaagattaacgatgaagttcaaacatggatcaacttttattctaatattcgcattaatagtcttaacaggcgccgaagatgataatgaacaaagaattaaaagatcgcccaaaccagattgggaagtgaatccaggagctaaccgtgatgatgatggtaataccaatgcaggcgtccaagtgaaaaatcatggaaatgaccacgattttgaagcaggatggagcaaagtagttagtggacccgatagagctaaaccaacatggcatgtaggtggtacctggagattcaaacgatcgccgagaccagattgggaagtgaatccaggagctaaccgtgatgatgatggtaatactaatgctggcgtccaagtaaaaaatcatggaaatgaccacgattttgaagcaggatggagcaaagtagttagtggacccgatagagctaaaccaacatggcatgtaggtggtacctggagattcaagagatcgcctagaccagattgggaagtaaaccctggagctaacggggatggaaatggtaacactaatgctggtgtagaagtaagaaataaaggtaaagatcatgactttgaggctggatggaacaaggttgttcatggacccaacagggctaaaccaacatggcatgtaggtggtacctggagattcaagagatcacctaaaccagattgggaagtgaatccaggagctaaccgtgatgatgatggtaatactaatgctggcgtccaagtaaaacatcatggaaatgaccacgattttgaagcaggatggagcaaagtagttagt

SEQ ID NO: 12630 - DNA, 607 bp, Diabrotica virgifera
cttgtttagagtattagaggtcggaatattcatatcacggcgctggggtatccgcgctgtacaacacggtaagccatcataattgtgatacgaatcaacgctgaacaaagctagtttgatacgtgccgaatctgtatgatgtgtatcattgtgtgctgactgaggagaacacgtcaacaacattcccttactctgcccatatcatatggctacatggtgaggtagcagcaaatgactgaaaggagataaaaatgatatgcgcatgtaacccagttattataaatattatgatacctggctacacaatcggctggtgctgacaattagactgaaatagacatgattaatgatctttatgcggattagctatgaattcggtgaacatcgctacgtttaaaggatatttactgttacagcggtagtggacgagtctcagtagtaggtgataatagaggtgaagccaaagcagtgtcctcattggattagactgatggtgggaatagtagatctgattcatagagtgtgattgttgtgattagaccgcttagagccactatcaaatacgtgacgcgaatggaatgcaatctacagtgaaagcgagaaatac

SEQ ID NO: 12631 - DNA, 461 bp, Diabrotica virgifera
  misc_feature (233)..(251): n is a, c, g, or t
gctaaggcacttgttatcgagatatggcttctttttcaatatatttacgtaaaaattttttgggggttttgttcctttaaaccccccaaatgtttgtgtacgctccagtcaaaccattatcgcggcaccatcagttaaacacactggttttaaaacttctgcctcttagttttttttaataagttaccttttatcgagatgtagcttctttttcaaaatatacctaaaaatgnnnnnnnnnnnnnnnnnnncagattattaacaggtctctatattcgtacttaaccatatacaattatggggtgaattcgacaaatattcaaaatatctttaataaaaagtgacttatcaaaaaagtactaagatggaatttggttatatagtgattgagttcaggtacaggagtatctgtttactagatgatgtaaagtgaggatggaaatgaggatagaattacgcta

SEQ ID NO: 12632 - DNA, 752 bp, Diabrotica virgifera
  misc_feature (154)..(213): n is a, c, g, or t
  misc_feature (456)..(473): n is a, c, g, or t
aaaagatcaatctgtctgtggatcgtgttggtcatttggtacagttggagctattgaaggagcatactttttgaaaaatggtggaaatctagtgaggttatcgcaacaagctttgattgattgttcatggggatatggaaacaatggttgcgannnnnnnnnnnnnnnnnnnnnnnnnnnnnnnnnnnnnnnnnnnnnnnnnnnnnnnnnnnnagaagattatggtccatatttgggacaagatggctactgtcactcaaacaccgttccgaaggtagctcacattacaggatgggtgaatgtgacgagtggtgatgaaaatgctttaagaatggctttggttcgtcatggacccatcagtgttgctatagatgccagtcacaaaacgtttagtttctattccaatggagtttattatgaccctcaatgtggaaataaggaggaggatttagatcnnnnnnnnnnnnnnnnnngatatggaattataaatggaaataaatactggttagtcaaaaatagttggtcaacttattggggaaacgacggatacgttctaatgtcatccaaaaataataattgcggagtaatgaccactccaacatacgttaccatgtaaacatatttaatttttaccatgaattcttctcttttttagtatttcgaatagaatatgatagtgaataacaattagaatcatacttatgccttataattctcagttcgaaatattttttgatattattaatcttatt

SEQ ID NO: 12633 - DNA, 957 bp, Diabrotica virgifera
  misc_feature (246)..(264): n is a, c, g, or t
  misc_feature (501)..(520): n is a, c, g, or t
  misc_feature (670)..(701): n is a, c, g, or t
  misc_feature (865)..(882): n is a, c, g, or t
  misc_feature (896)..(920): n is a, c, g, or t
  misc_feature (928)..(948): n is a, c, g, or t
catatactcgtctggtggtgaatttgttttaatctaattatataaagttttgaaaactatgtctaaaagaaaaaacattataatggctttggctaaggaaaataaagtagtttgtgttcaggaagtgggtgatcttgaaaagcggtatagtgaacttgcgtcctttggtcaagattgtttgaaatcgatacaagatactgtaaaagacgattatttggttgataacctgatgatggacggcttacnnnnnnnnnnnnnnnnnnntaacccctctactaatgaaaaccatttttatgatattcaaccaatatgtttagtaagagatattaggaaggaagaaaacacaaaagtttataccgaattaaaaccgctaccattaattgatggaacaaaggatggtagtcaaaatgatacggatgttaataatgaatgtcacaaagaaaaatcggttgatgttatagacgtttgtcagcataataaagatgacacagttgacgatgnnnnnnnnnnnnnnnnnnnntatgacccacaagaatctgaagaaataagttatgagacaaagaaaaaaaggagaatagcaaaattttttcaaactgaaaatgaaaaaagtgtagttggcactgttatggaaaatgaaggtttagtagataaacaattgaaagatatagannnnnnnnnnnnnnnnnnnnnnnnnnnnnnnnattttgtgtttcacatgaattaactaatatctacgttttttatagaagcacaatccgtgataaaaccgatgaaggatacgagaaaaacagaaaaaaaagagcaagaacagcgaaaaaccaaattgagaggcatctaaaaaaatatcagttattaaaccctggtnnnnnnnnnnnnnnnnnngaaaatttttatcnnnnnnnnnnnnnnnnnnnnnnnnncccggccnnnnnnnnnnnnnnnnnnnnngggcaaaaa

SEQ ID NO: 12634 - DNA, 957 bp, Diabrotica virgifera
  misc_feature (206)..(225): n is a, c, g, or t
  misc_feature (723)..(741): n is a, c, g, or t
  misc_feature (792)..(812): n is a, c, g, or t
gtttattgctaagtactaataaacatgtcaatatacaataagctttatgcaaatttagtttgtttactattatgcaaattacaccgttatcttcttgggtggcgaaatccttcaggtagatgacacccccgaggtattaattagcctttagtactactccggagtgaaaatacgtgctaaaccgaattttacttgaacgcgctgannnnnnnnnnnnnnnnnnnncaactccacaagaagttatttccaacggaattagctttcttctctctatgtatggagcgcctaaaaaactacgtgcttagataagttttggtatgcatgtttcttaaaaaatactcgaaataaaaaacaagtgcaattatcttttcttcctccaacctcagcggctgctcatcgacatttttttcgggtatattaccgagttcaagtctggcttgtttatcagctagatccaaaatactggggatggaaattagtcgacagttcattagaaccaattcaaactttattcccacctgcgccgcaaaaacttttgaacacaattttttgcaactgtaaaaagggatgtagcgctaaatgtggttgcaaaaaagttggtcactaattgtcaaaagcggtcgtgctccaatgttgaatcaccaacaattgaggattcatctcattctatcgaggagccatgcgatttgtcattattggggcaatttacttgcacccaggatnnnnnnnnnnnnnnnnnnngagaagaggaagcagaagtattagaaaattatgaaccagtttgataaattnnnnnnnnnnnnnnnnnnnnnccgctttttatagcttttgtcatttttaacccttgccaatatcaattattcaatagatttaaataaacataatcacaacagatcccgtgaaataggcctactggggaaaacacgataaaaaacgcgctaagtacactaccctcaa

SEQ ID NO: 12635 - DNA, 818 bp, Diabrotica virgifera
  misc_feature (20)..(40): n is a, c, g, or t
  misc_feature (79)..(103): n is a, c, g, or t
ataaaaatgaattctgaatnnnnnnnnnnnnnnnnnnnnncagatgccaattccataatggaggaggaatctgaagccnnnnnnnnnnnnnnnnnnnnnnnnnttatagtgtctggtctcgtcatacattttcttctccttctcgctgtgttcgatgtgtattttgccagtcccctggacaatggaatgtcaccaattagaagtacctctaatccgccagctaagagactagtgttgtttgttgcagatggattgagagcagaagctatttttggtgaaggaaaagaagaactgattccttttttggcagataagttaaaaaatgtagggagttggggtgttgcacatacaagggttccaacggagtccagaccaggtcatgtggctatgttagctggaatatacgaagatcctagtgcaattttaaagggttggaaatctaatcctgttaattttgattctgtaattaaccaaagcactaatgcttgggcttggggaagtccagatataggtaaaatattcaataaagacaatttatctaaaatacacatatcttcttatgatgcacaaatcgaagattttggcaatcaagatacaggtatattagatacttgggtattccaacaagtccataaatttctgacaaacgaagtaaaaagttgcacaacaaactgtgatcagtattttaagattggtaaaacatttttcttgcatttactgcgaattgatagtgcatgacacgactacgagccaacttccaaagaatattaagaaaacattaaaaccaccggaaacaattttgcactgataccaaattt

SEQ ID NO: 12636 - DNA, 73 bp, Diabrotica virgifera
  misc_feature (13)..(30): n is a, c, g, or t
  misc_feature (32)..(49): n is a, c, g, or t
caagtgtatatgnnnnnnnnnnnnnnnnnngnnnnnnnnnnnnnnnnnntgattttttgtccctgctaatgac

SEQ ID NO: 12637 - DNA, 914 bp, Diabrotica virgifera
  misc_feature (564)..(581): n is a, c, g, or t
ataagttctttgaagttagggttaagatctactaacattattgaaaagtttgtaatacatttgtgacttccagtgtacctgccgtaaaataaaagttatacacgctgtgccaatttccttggaatatctttctacagtttcatagtaagttgacataatggaaattccagcaccagaaactttgaagaaacctttagtagtacccaataaactactgatgggagctggacctgcaaatttgtctcccagagttctgcatgcaatgagtcacggtgttttgggtcacatgcatgaagaaacatttaaaattatggacgaaataaaagagggtattaaatacgtttttcaaactaaaaacgagacatctttggcaatcagtgccagtggacacactggcatggaggctattttgtgcaatattttggaacctggagatagagttttaattgccgtcaatggtctttggggtttaagagctgcagacatggctgaaagatatggtgctgtgccaattaaaatgtctaccttaccaggtgacaatttcagtttcactgaaatcgaacnnnnnnnnnnnnnnnnnngtcctaaattacttttcatagtccagggagaaacgtctactggagttcaccaaccaatagaaggacttggtgatctttgtcacaaaatgcacatatgcgaggaacactccaatcaaagtttattactgggatatgaaagttctaggccaacagtggaactgctacaataatgttcgaccataccaccatacaaccagctccagtcttctatgtagtctacgtgaaaagttatctataatagccgaagaaggattgacagagtggcagaggaaacatgatgaatgctaccaaagactgaaaaagggaattgaaaatctaggattaaaatttttt

SEQ ID NO: 12638 - DNA, 917 bp, Diabrotica virgifera
  misc_feature (123)..(146): n is a, c, g, or t
  misc_feature (159)..(176): n is a, c, g, or t
  misc_feature (210)..(232): n is a, c, g, or t
  misc_feature (458)..(478): n is a, c, g, or t
  misc_feature (557)..(576): n is a, c, g, or t
  misc_feature (641)..(689): n is a, c, g, or t
  misc_feature (829)..(849): n is a, c, g, or t
tacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnaaaagttttttcttttcaacgaaaaagattaaaacctttaagaataacttctttcattggatgactac

SEQ ID NO: 12639 - DNA, 576 bp, Diabrotica virgifera
  misc_feature (23)..(322): n is a, c, g, or t
  misc_feature (329)..(366): n is a, c, g, or t
  misc_feature (386)..(399): n is a, c, g, or t
  misc_feature (402)..(424): n is a, c, g, or t
  misc_feature (432)..(454): n is a, c, g, or t
  misc_feature (496)..(515): n is a, c, g, or t
tgattatgctaccttagcacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttgggttctatctttaagnnnnnnnnnnnnnnnnnnnngaaaggaccagatatataacataatttttatatttacatcaatattaaaatgaagaaagaa

SEQ ID NO: 12640 - DNA, 105 bp, Diabrotica virgifera
  misc_feature (2)..(73): n is a, c, g, or t
  misc_feature (75)..(91): n is a, c, g, or t
cnnnnnnnnnnnnnnnnnnnnnnnnnnnnnnnnnnnnnnnnnnnnnnnnnnnnnnnnnnnnnnnnnnnnnnnnannnnnnnnnnnnnnnnnagactataatcatt

SEQ ID NO: 12641 - DNA, 735 bp, Diabrotica virgifera
attctatacaatggatgcggtgttacttattacactactactacccattgctgtatatatgccaggctgctcggactcatcatgcactcgcacttcataaacaacatcattaaaaagcttttactatgggaagttggagatgacttggtctaaaaccgtccaatgctggagatgatgaatgactatgacatgtaacaaggaatttagatggagactattaatatatcgcacggagataatatacgagtacccaatgctttacatggaaaagatgatggtgaatatggtactgatgatatcggactcaatgataatcgaatcaattgagtaatatgttgtattcccagtccaggattggcattgagcgacagacaatatatattatcccttcgagacattctcagcatgctgtttcatttgaaaatatagttgtcttgctgcgatacctgagtatatgtacgattggggggatatccaaacttgccatgggagctatctgggatcagatactcggaaattgacatatctgcgaggtcctttattggcagaattagcaggagtgtgcatctcgtattcggcttgcacgcatgttcaactatcatacgaagggtatcagagagacatgcagcactctggactatgacacaccttcttggagacatatgtgtgaccattccgcactcaattatctgtccgagttaacttttggttcacgttgtgagcgtaactcctatt

SEQ ID NO: 12642 - DNA, 966 bp, Diabrotica virgifera
  misc_feature (540)..(584): n is a, c, g, or t
cacaatacaatcgaagtacgcgttcttattcatttttcatcactattaaagttgcagtgtaaaatcatcggaatgtctatagctgagatgcttatgaataattctcaagatatggtttttgaagccctggaagatgtaaatttgtacagctgatgaaatgcaaggtgtagtattgaacgtgaagatctttcttttataagaaatgcaaggtgtagtattgaatgtgaagatctttcttttataagaatatgtaaaaggttcgtgttaattctagaagtggacagcggattcagcagattttttaaatggaacattctgatgaataaaaattatgtgaaattgggttatgcagataataaaataatggaacattctgattaaaaatcaagtgaaattgggttatgcagataataaaataatggtcttttgactttgcgggacctttcccactactctaaacttcaaatatagattggttttcggaagacctcacactttctaataggacattaataaaccaaaattggttttcggaagacnnnnnnnnnnnnnnnnnnnnnnnnnnnnnnnnnnnnnnnnnnnnngaagacctcacactttcaaataggacattaataaaccaaaattggttctcggtagacctcacacttataggacattaataaaccaaaatagaatttttaccagccacaacatttttaatggtattacacaacaaatgatgaatctggagcaatcacatagatagatatgcttattgacaatttttatacagaaagcactacatggcatgtcatacgttaaggtattacacaacaaatgatgaatctggggcaatcacatagatagcagatatgcttattgacaatttttacatagaaagcaccacatggcatggcatacgttaagattagttattgtacgagccctacaactatatattggtacaaactacaaaacaagcgt

SEQ ID NO: 12643 - DNA, 621 bp, Diabrotica virgifera
  misc_feature (274)..(290): n is a, c, g, or t
atacaaattctgtatacaaaaatatagtgctttagttaactcacaattatgatgggccgaaggtattactgtgattattgcgaaaaatgctttatagatgatctagacgctagaaagaagcacttacaaagtgccaaccacataaaacttagaaatatgcattatgaatcttgtagagatccagaaacagttttaaaggaagagcttttaaaaataccatgtagacgattttcccaaggtagctgtccttttgagggagtgtgtaggttcactnnnnnnnnnnnnnnnnngttgtgtgaacttagaaagcaagttgagaatatccaacaaatgaggagaaaacaaaaagaagaagtaccacctgtaccgcctctagaaaaatggattgaacattatgaaattaataataaagatgcaagtgataaggtgcatctattttggacttaccctgaaaatttggaaaacaggaacgatctacccccttccctcataaaatttagaccagaacatttttatgacgacaattttgaggaatggggcaaataaaatttttgtataagtatatctaagtaattttcaaaaccctgtggaatttattaggaataaatgcgacatcttatt

SEQ ID NO: 12644 - DNA, 869 bp, Diabrotica virgifera
  misc_feature (731)..(751): n is a, c, g, or t
  misc_feature (762)..(781): n is a, c, g, or t
cccacgcgtccgcttgggccttaaagcttagttaatggttcttaaatgggtaaataaaaatattgaactgtttggtggagaatgaatagtttgggatttttatcaacggaagataatgttttccctgcaaacttgggccttaaagatcagttaatggttcttaaatgggtaaataaaaatattgaactgtttggtggagatcctacaaaagtaactttgggaggtcacagtgcaggagcaatacttactggatatcacctacttagtaaaaaatcaaaaggacttttcagatcagccatagttcaaagcggtacaccgctgatgagttttggttacattgccaatccgagaaaatttgcatttatgttaggagaaaaattaagtcgagactttcattcttccatgaatacgtcacaggatctgctgaaattgttacgaagtctcccagggaaggaggtagcccaagttaatttagggaatatagaaggtttcgactacaagttagttgaattcagatcaacttgggctcctactaaagaagatccaaactatgagcatgcatttttaacagatgacacaatgcacgaaaattttaagaagggacatttcaatcaagttccagttatgattggaattacagatgaagagttcaaagactatggaaacttgactcgagctggcctgttagtggatagtaattattctttattaattgatcctgttgttccttnnnnnnnnnnnnnnnnnnnnnctatggttaannnnnnnnnnnnnnnnnnnngcaatactaatagatttgcacaaaacgcaacaggtatggccaagattctatctgatatattgtacggaattccaataatgacaaatgc

SEQ ID NO: 12645 - DNA, 607 bp, Diabrotica virgifera
  misc_feature (315)..(381): n is a, c, g, or t
  misc_feature (571)..(603): n is a, c, g, or t
tttaggcggccggagcagcgaagaagaagagggggaagattttttaagaacggggggaagccaccgaaggaagacagccgaaacgaagagaaaagaagaaccgaggggaaaataatagacaggcgggaagaagaaacagaaccaaaagaacaaggaaaacacgagagagacagcaacgaaagacaccggcgaccagaacgaccagaagaaaggaaagggagagaaaagcgaccaaaaccaagaacaagggagcaaccgaaaggaaggcaccgacagaaagaagaagagagagaggaacagacaacccgcagaagnnnnnnnnnnnnnnnnnnnnnnnnnnnnnnnnnnnnnnnnnnnnnnnnnnnnnnnnnnnnnnnnnnnccaaaaggaacaaagcacacggacgcgggcaggcgaagacaaagagccgcaaaagggacaccgaaggacaagccacgggccgacgcgcgacaacgccggagacggggaaaaccagggggcgacccaaaggaaacacccgggaggaaagcccccattcgccgggtggggtaaaagcgaagaggcccgtacnnnnnnnnnnnnnnnnnnnnnnnnnnnnnnnnntgac

SEQ ID NO: 12646 - DNA, 914 bp, Diabrotica virgifera
  misc_feature (230)..(249): n is a, c, g, or t
  misc_feature (413)..(444): n is a, c, g, or t
  misc_feature (606)..(627): n is a, c, g, or t
  misc_feature (734)..(734): n is a, c, g, or t
attgagggagactacacctatttgcgtattaactttttccatcccggtacaactatgggcagaaatgaaggtaatgtctggtctcagcctgaagcaactttccttaaagaattaacatataggagtaccaatacaaaagaaccaggagtagtaactgctccctcgtctaaccttaatacagcctttcgtctaattaaagaagttcaaaggaaatttaagacacgagaagnnnnnnnnnnnnnnnnnnnngatttggttaaacaggacacattagtactttcacagaataaaggaaatcctaaattaaaagatctgtatattaggccaaatattgtttcaaaacgtatgacaggatcattagaagctcacactaatggttttaggtatacttctgtgaggggtgataaagtagnnnnnnnnnnnnnnnnnnnnnnnnnnnnnnnntttcaaccgtgtgatggagaaatgataattctgttacattttcacctaaaacatgctatcatgttcggaaaaaagaaacatgttgacgttcaattctatacggaagtcggagaaattaccacagatttgggcaaacatcaacacatgcacgatcgagatgannnnnnnnnnnnnnnnnnnnnnagagagctcagacaaaaattgaaaactgcattcaaaagtttttgtgaaaaggttgaatctatgacaaaacaagaaattgaatttgatatcaccattccgggagttgngatttccaggagcccccttccgctctacagtccttctccagcctacatcctggttgtttggttaacctgactgaatgggcctccatttgttgtcaccctaagaagatgtagagttagtacatttttgaacgtgtacaatttccaccttgaagaacttcgaatatgggggtttgtttttaa

SEQ ID NO: 12647 - DNA, 277 bp, Diabrotica virgifera
ctccttaccccttccggaggcagctagcagaactaggcaagcgttttttctattctcctttcccacctggcaactgacaactaacaaagcagactgtcctgtctatttgatatctcttatataataggaaaatcatggatccctgatttagatttgacctattccgtatggctgaacttcaaaatcagacgaatggttctcggcttgctctcatgcctacttcactgaagaaaagaattatggctctacatagaatccgagtagaggcaactaatat

SEQ ID NO: 12648 - DNA, 760 bp, Diabrotica virgifera
cttagtatggatgttgaagtgaggattaccgattccctaaaaggcaaaggattatacgcaaaaagagattttcctaaagatgctgttatttttcaagaagatccccttgtgtcatgccagttttcatggaatgctgaatataaatacttagcttgtgatcattgtttaagaccattagaaactgctcatgaaaatgcaactcgtttggctggccatccaatggtattaccatatccagattgctgttcaacagacaaaagtaagatagtatcctgccctcattgttctacaaaatactgctcagacccccgtagagtagaggcatacagtcaataccacaatacgctatgccatgaaaacaatagcaatcatcctttggaaagattaaatgatgtctggaagaaagtccattacccaccagaaacaaacagcataatgttaattgtccgtctgctagccagaatcaggcaggcgcctaatagagatgcagccatcgcacaaactttgcagttttgccatagaactgtaaatgaagatgccgatttggctcacaaactcctgggagacaaatttgcagaccaactaagcctgttgcataacagtttagttgctgctattccgaacgatggtattgaacagtttttaccttatgaagggtttttgagaatgatgggacttataggtacaaatggaccaaggtgttggaacaagcgcgattgccctatgggtgtcaaaaaaaaaaaacttaaccctcctgaat

SEQ ID NO: 12649 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12650 - DNA, 893 bp, Diabrotica virgifera
  misc_feature (489)..(516): n is a, c, g, or t
  misc_feature (553)..(568): n is a, c, g, or t
  misc_feature (795)..(795): n is a, c, g, or t
  misc_feature (799)..(799): n is a, c, g, or t
  misc_feature (806)..(807): n is a, c, g, or t
  misc_feature (873)..(873): n is a, c, g, or t
  misc_feature (884)..(884): n is a, c, g, or t
gaacaaccacaaattgagcatttttggattaatatatcaataaaagcagcaaggcgctacataatttgtagcgccatccatatacatactggaaatacaaatgcaaatattgcatttatctcaaaacttcgtttttgggcttaggccactgttgctctgatagcctcaaagatagttactgaaaaagcaattaaggaatcaaaagtgctttcaatgatgctcttaagtcaaaggtgaaatattcggttgacccaaatgatatacacatctattatataattaagaacacgttttcctggactatcaacttatatttcatataaactctttcaaacgaaacctgattatcccagatttgtccaaacttatctacaattacattgagctaccataggcttaatcaatcatttaggtaaacattctgagtacaaattgaagtgaaactaaatgaaacatatagcggaaagctatatatcgtagactaaaagnnnnnnnnnnnnnnnnnnnnnnnnnnnngtctactatcaactagcaaagaagtaaaatatttgannnnnnnnnnnnnnnntcaacccaacataaatattgaagtacatcgagataaactatatgtcttgtttgagctaactgaagattggataaatgattaagtaacaagatattgtatggtaatatagcaccggtattctttgttgatttgttaaaatcaaagataatgtatttgaatccatgatatatactcatacccgtgcaaatgttggagggattcaaaaaagtgacaggcataatattcanacgnacgtggnnttgtcggtttgaaatgtaaatattcaacttaacgaaaataacaatactgtatgtatatttcaaggntgattgcatantcatattct

SEQ ID NO: 12651 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12652 - DNA, 172 bp, Diabrotica virgifera
  misc_feature (10)..(39): n is a, c, g, or t
  misc_feature (43)..(89): n is a, c, g, or t
  misc_feature (94)..(115): n is a, c, g, or t
  misc_feature (117)..(131): n is a, c, g, or t
  misc_feature (134)..(157): n is a, c, g, or t
cgagaagacnnnnnnnnnnnnnnnnnnnnnnnnnnnnnncgcnnnnnnnnnnnnnnnnnnnnnnnnnnnnnnnnnnnnnnnnnnnnnnncgcgnnnnnnnnnnnnnnnnnnnnnncnnnnnnnnnnnnnnnctnnnnnnnnnnnnnnnnnnnnnnnnacccaatttttttcg

SEQ ID NO: 12653 - DNA, 420 bp, Diabrotica virgifera
  misc_feature (22)..(221): n is a, c, g, or t
  misc_feature (228)..(265): n is a, c, g, or t
  misc_feature (285)..(298): n is a, c, g, or t
  misc_feature (301)..(323): n is a, c, g, or t
  misc_feature (331)..(353): n is a, c, g, or t
  misc_feature (383)..(414): n is a, c, g, or t
cccttcacgcgtccgggggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12654 - DNA, 537 bp, Diabrotica virgifera
  misc_feature (3)..(461): n is a, c, g, or t
  misc_feature (463)..(503): n is a, c, g, or t
  misc_feature (508)..(528): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnaaggnnnnnnnnnnnnnnnnnnnnncttttttta

SEQ ID NO: 12655 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12656 - DNA, 56 bp, Diabrotica virgifera
  misc_feature (2)..(22): n is a, c, g, or t
tnnnnnnnnnnnnnnnnnnnnntccaatacgagaccttactgattaccgtctatat

SEQ ID NO: 12657 - DNA, 478 bp, Diabrotica virgifera
  misc_feature (6)..(28): n is a, c, g, or t
  misc_feature (219)..(287): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnaatcaccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagctttc

SEQ ID NO: 12658 - DNA, 218 bp, Diabrotica virgifera; identical to SEQ ID NO: 7300
  misc_feature (6)..(28): n is a, c, g, or t

SEQ ID NO: 12659 - DNA, 218 bp, Diabrotica virgifera
  misc_feature (6)..(28): n is a, c, g, or t
tcgtannnnnnnnnnnnnnnnnnnnnnngatagaaaccaacctggctcacaccggtttaaactcagatcatgtaaaattttaaaagtcgaacagacttaataatatagcttctacaccaattataaactttaatccaacatcgaggtcgcaatctttattatcgatttgaactctccaataaaattacgctgttatccctaaggtaatttattcttat

SEQ ID NO: 12660 - DNA, 631 bp, Diabrotica virgifera
  misc_feature (46)..(65): n is a, c, g, or t
  misc_feature (302)..(324): n is a, c, g, or t
cggacgcgtgggcgacacacacatccccctatagcatttctaaacnnnnnnnnnnnnnnnnnnnntcattgaggtatcaccgagagatactgactaattacatcacacagtattcgcacactatagggccccttgactgacatcaataattactaaaacattattaatctaggagatccttcttgagcgcaacttaactctttagatataattcctcatatgaccaagacttgctatagctctggtgatgaaaccccaattgctaaaaaaatcattttcctctctttacaattcactcatcnnnnnnnnnnnnnnnnnnnnnnncagtactagcttagccttcccccatactattattagattaggccttaggaattatgaatacctgactacctttgatccaggtatatctatcttcctacaacttagatttctacatccctttctgtatttaccaatgacttggtatttctcgaattatcccacctttccgtctaagatcaacatttgattcaaatatgtacgttcgctttctatacctgactaatggtgagcatattagtttttttacataaggacacctagcatacaattcacccatttaaaaaggcattctaggattttcttaact

SEQ ID NO: 12661 - DNA, 823 bp, Diabrotica virgifera
  misc_feature (541)..(561): n is a, c, g, or t
  misc_feature (676)..(807): n is a, c, g, or t
ataactggtaaaacaggtgaattataaaaataacaggaattataaattagtgatgaagacagaatttttatttgattttaaacttacattttcacaatggtatcaaaatgttctcaaataagagctgctctgtatttaaatcagtgtaaacaaaaattttgttagtcatggcaaccctttttgcggaaaactgaaaagaactataaatccacaaactataaccaaaaaatgatatatttcagctcatttcaccaaaaatgtaaaagaacgatttcagacgttttggtttacactgattcatctgttctgcaaatgtttcacggtactgtttaacatttaatatagtttattgttagcaagtagtaaatagaaagcaaaacaaggaagcaataagcacatatggattttttcacaaaagactcatactccttgttgtattttctatggcctttgtattccactatttattccacattttgtgttagcaaagacaactgcctctgaaaagtaatttgtttttgatacatgactatttttgtgnnnnnnnnnnnnnnnnnnnnngttatccttgcattaaatttgtttatttaagtaaacaatttaaaattttgtaaatttttcaatgtgctttgtcattaatactctaagcatttgttatttttctaaaaggctgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcaaaaggatccaa

SEQ ID NO: 12662 - DNA, 909 bp, Diabrotica virgifera
  misc_feature (453)..(471): n is a, c, g, or t
  misc_feature (561)..(578): n is a, c, g, or t
  misc_feature (865)..(883): n is a, c, g, or t
cggacgcgtgggcagcggtaatagttactaagttacattatttttttgctgactgccgctacacgacaagtctcagtgatgttttcactcgacataattgcaatattgcttttgataacactgataaggcgaagtaaacaacatgaattgaaagggaagttgaacgaaaaatccaacaggttttgtacttcatgcgtcagaccgtgcgctatgaaattcctacttttcaacttcaaacaaggcatgcgtagcgtctgccttttgttcattacaccgtgcgctgtgacgcatgcgtttgttgaacacgaagttgcaccagtgtagacatagcttaaagcttgtttatacgatgcctcttttcgtgcgtgattgcatgcatcaatatgctcgagaggcacgttttttactacttgtgtctttctttgttaccccaaaatgcgaaagacttgtctnnnnnnnnnnnnnnnnnnntcagcgtgctatgtttttaaagtacatgccaatttctatactacaaagtacaatgttttctcactgttccactccatggaatgcacagcnnnnnnnnnnnnnnnnnngacttaaataattcttaaatttactcgcaagtaaatattctactagattgtaatatattgcttatttaaattctccatttaatatttactaaatctaaaacacaagtcaaatcggcaatggtaaccatttttaaaatgtgaaatctctattaggtgtgatgagcacctcgctttgcctctgttttgtggcatgcacagatgcatgcctcttgcctctagagatacgtggcaagttgcacgaaaagatgcatcgtgtaaaagcgcctttaggcgattatatttgaacnnnnnnnnnnnnnnnnnnntatctaatggttacaatgccaattta

SEQ ID NO: 12663 - DNA, 619 bp, Diabrotica virgifera
  misc_feature (2)..(596): n is a, c, g, or t
  misc_feature (599)..(618): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnc

SEQ ID NO: 12664 - DNA, 344 bp, Diabrotica virgifera
  misc_feature (5)..(70): n is a, c, g, or t
ccccnnnnnnnnnnnnnnnnnnnnnnnnnnnnnnnnnnnnnnnnnnnnnnnnnnnnnnnnnnnnnnnnnncgtaggattaacaattttcatattggactatatgttattctttatgtataaatagtattctatttagtttgccgcttaaatataacaaatgttaacttacaatcaaacctagtaggtaacatagaagatgttacctatcagaaaaacgataattaaaataaattagacttaaatggtaacccagatagcaagttatcgtacactacattagaaacctgacagacctcattgaattgcacttggatggaaaccgaacctgaacacttgaacctgg

SEQ ID NO: 12665 - DNA, 94 bp, Diabrotica virgifera
  misc_feature (5)..(80): n is a, c, g, or t
aatgnnnnnnnnnnnnnnnnnnnnnnnnnnnnnnnnnnnnnnnnnnnnnnnnnnnnnnnnnnnnnnnnnnnnnnnnnnnnaaggaaccctatag

SEQ ID NO: 12666 - DNA, 185 bp, Diabrotica virgifera
  misc_feature (2)..(61): n is a, c, g, or t
  misc_feature (73)..(73): n is a, c, g, or t
  misc_feature (77)..(77): n is a, c, g, or t
  misc_feature (83)..(83): n is a, c, g, or t
  misc_feature (96)..(96): n is a, c, g, or t
  misc_feature (99)..(125): n is a, c, g, or t
  misc_feature (130)..(178): n is a, c, g, or t
  misc_feature (181)..(181): n is a, c, g, or t
tnnnnnnnnnnnnnnnnnnnnnnnnnnnnnnnnnnnnnnnnnnnnnnnnnnnnnnnnnnnnaaaaagctttanatanttttanaagacgagaaganccnnnnnnnnnnnnnnnnnnnnnnnnnnngaagnnnnnnnnnnnnnnnnnnnnnnnnnnnnnnnnnnnnnnnnnnnnnnnnnggnggtg

SEQ ID NO: 12667 - DNA, 615 bp, Diabrotica virgifera
ctcctttacgccccccacttgtctagatcgcgagggggcactttttaggcccttgaagaataggtaaacacggttaagtaagacttagttggagcgtttgatttagatatataggttgaagatgaagaggatggggagggctagggtgctgaataagaagaggtttatgtcttatattgtagtgtgtgacctctaaccctgtgaacttttcttgggggacaattactttgcaaagtttcgtggtactgtgtggatattttattttcatttgcaattagatctttgggcagagctccttattcgccaggatgttctatgtcgccttctttgttattatttctttcattcccccctccttccatctacacttccttcatcattttatccacaggctacctcgtgacctttgcagtgggagctaggtttctttattgaccatgagaactgcacgttaccctgcgataactgactatttttaacttattacgtatccccttcaatttgtacaaatgtccattttgcggaaggatagatatgaatttagattaggttggtctcacacataacaaatactattttttgaatgtcctattttctttattgctttaactaatt

SEQ ID NO: 12668 - DNA, 121 bp, Diabrotica virgifera
  misc_feature (2)..(118): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngac

SEQ ID NO: 12669 - DNA, 247 bp, Diabrotica virgifera
  misc_feature (5)..(84): n is a, c, g, or t
  misc_feature (97)..(239): n is a, c, g, or t
gaagnnnnnnnnnnnnnnnnnnnnnnnnnnnnnnnnnnnnnnnnnnnnnnnnnnnnnnnnnnnnnnnnnnnnnnnnnnnnnnnnaagacgagaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 12670 - DNA, 1046 bp, Diabrotica virgifera
  misc_feature (492)..(515): n is a, c, g, or t
  misc_feature (519)..(637): n is a, c, g, or t
  misc_feature (798)..(818): n is a, c, g, or t
  misc_feature (899)..(919): n is a, c, g, or t
  misc_feature (961)..(1001): n is a, c, g, or t
agaaatctccgattacttctggaaaattatttcgtttttgtacctaattaaaaagcaaaaaaactataccaaaaagacactattaaagtgtcagattcaccatgattatcccagtaaggtgttttacctgtggaaaggttattggaaacaaatgggaggcttatttgggtcttctacaagctgaatatacggaaggtgacgctttagatgcccttggcttgaaacgttactgctgcagaaggatgcttttgggacatgtggacctcatcgaaaagttgttgaattatgctcctttagaaaagtgaaactgtagctttaaggtttatgtatataatttaaaaataatgaccttatccatagttaatttgtatattttagttctacaaaataatgcattgactttcataggcttataatttggtttttcgaaaatctgtttgtctaaaaaaaagtaaaatatgtgaagtggaaaatgtgtttccgtttatctgnnnnnnnnnnnnnnnnnnnnnnnngtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaaagatccaagtttaaaaaccgggggttggaaaccaaaaatttttttaaaggggccccaaaatttaatttccgggccggtgttttaaaaagggggagtgggaaaaacccgggggttacccaatttaatccctttggaaaccttcccctttttcccannnnnnnnnnnnnnnnnnnnngccccaccccattcccctctcccaaaatttgcccaacctaaaatggaaaatggaaaccccccccttaaacggcctttaaannnnnnnnnnnnnnnnnnnnnaaacccccaggggggacgtaaatatttggaagggccctaagnnnnnnnnnnnnnnnnnnnnnnnnnnnnnnnnnnnnnnnnnaatttttcccgcgttttttccccagaaaattttttaaaatggggg

SEQ ID NO: 12671 - DNA, 382 bp, Diabrotica virgifera
  misc_feature (7)..(83): n is a, c, g, or t
  misc_feature (120)..(143): n is a, c, g, or t
  misc_feature (145)..(160): n is a, c, g, or t
  misc_feature (174)..(186): n is a, c, g, or t
  misc_feature (189)..(210): n is a, c, g, or t
  misc_feature (222)..(250): n is a, c, g, or t
ccccaannnnnnnnnnnnnnnnnnnnnnnnnnnnnnnnnnnnnnnnnnnnnnnnnnnnnnnnnnnnnnnnnnnnnnnnnnnnncaatctaaattacggattaataagttattcacaaagnnnnnnnnnnnnnnnnnnnnnnnncnnnnnnnnnnnnnnnncatgttaaattacnnnnnnnnnnnnnagnnnnnnnnnnnnnnnnnnnnnncaaaaaaacgannnnnnnnnnnnnnnnnnnnnnnnnnnnncatatagtaaaatatctgtacagttcacatgaaacctagacagatgacattgaatttcacttggttgaatagagatatgaactgttgaggatgaaagtatccgaggctccgcgagacctactagattaattt

SEQ ID NO: 12672 - DNA, 353 bp, Diabrotica virgifera
  misc_feature (6)..(204): n is a, c, g, or t
  misc_feature (206)..(240): n is a, c, g, or t
cccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnngtataggtttagtatgtggaattcggcaacattattttcacctgtgaattaagatcatgtgattgagtatgagatatagactggtcacctgaccactgccataatttgcatgt

SEQ ID NO: 12673 - DNA, 487 bp, Diabrotica virgifera
  misc_feature (323)..(353): n is a, c, g, or t
  misc_feature (448)..(475): n is a, c, g, or t
ggtggttggcaagttattgatgctactccacaagaagtcagcgatagtgtaatgcgatgtggcccagcatctattgaagcggttagaaagggagaggttggatttttgtatgacacaccatttgtattttctgaagttaacgccgatgttgttcattttcaagaagacgaagaatctgattggggattcagtaccacatctgtcaaccaggatcatgttggaagtttgatattatccaatgaaacagggcctactgtctataacggtgattgagtcgtgaggaagataacgtatcttggttaaatattttgaattctattatnnnnnnnnnnnnnnnnnnnnnnnnnnnnnnngttgtggggtaagagagaggttttcttctacattagaagatttagcgtgcacgaggatttacgatgtataatgttgtagtattttgcaaggaggnnnnnnnnnnnnnnnnnnnnnnnnnnnngtatagattatt

SEQ ID NO: 12674 - DNA, 714 bp, Diabrotica virgifera
  misc_feature (13)..(13): n is a, c, g, or t
  misc_feature (19)..(19): n is a, c, g, or t
  misc_feature (29)..(29): n is a, c, g, or t
  misc_feature (485)..(503): n is a, c, g, or t
ccctttcacgcgnccgagnttccagaagnattgcatgggctgcttctaaagaccaagaagagtatggtgatgaaaaaccactacacatttattactgtttatgtggacagatgacattaattcttgattgttcaatagaaaaattaccactaagaaaaagagatgctgccagagtattagacggcaccaaccatgcccataaaattacttgcaatccagatgaaacagtctatttaaaacgccccgaaggaatagaaaggcagtacagaatgaagtgtaaaaagtgtggtctcctgttatattacaaacacgaaccacagagccctatcagttttatagtcaaaggatctttgataaagagtacgaacgaaggtccaatcaacaatatatacaatcaagtagccatacaaaaaccaaagaagatcatggtcacgaaacataccaaaaatatgggtaaattcagttcagttacagtgtctactatnnnnnnnnnnnnnnnnnnnatagaagccactagaagtggcagatagttatgctaacaatgctcgtataattgagaaacaactggaaagaaaggggatgacgaaacggaaacaagaacagaataaaataaatgacattaaaaaagtgcgcgggacattaatagataaataactaaactgtgtggttgaattactcctagtaaaataagtttttgataaaaaaagaagaaaa

SEQ ID NO: 12675 - DNA, 712 bp, Diabrotica virgifera
  misc_feature (12)..(12): n is a, c, g, or t
  misc_feature (21)..(21): n is a, c, g, or t
  misc_feature (26)..(26): n is a, c, g, or t
  misc_feature (52)..(74): n is a, c, g, or t
  misc_feature (104)..(135): n is a, c, g, or t
  misc_feature (142)..(242): n is a, c, g, or t
  misc_feature (289)..(308): n is a, c, g, or t
  misc_feature (315)..(331): n is a, c, g, or t
  misc_feature (333)..(357): n is a, c, g, or t
  misc_feature (375)..(425): n is a, c, g, or t
  misc_feature (428)..(505): n is a, c, g, or t
  misc_feature (512)..(587): n is a, c, g, or t
  misc_feature (589)..(612): n is a, c, g, or t
  misc_feature (641)..(661): n is a, c, g, or t
ttcaataggggnccgagttgntacancaattatattataaccctttttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggggtgcgctgtaatgcatccttgtttatatctgattgtttgagnnnnnnnnnnnnnnnnnnnnttaaccnnnnnnnnnnnnnnnnngnnnnnnnnnnnnnnnnnnnnnnnnngtttttaccgggtgagcnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnntattagnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnctttcacatgtttattaaaaaaatgatcnnnnnnnnnnnnnnnnnnnnnactggcctgttcactgattaaattgaaggggcggggcattttgaccgtgct

SEQ ID NO: 12676 - DNA, 224 bp, Diabrotica virgifera
  misc_feature (2)..(172): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaaacccttataaaggttgttttaaaataatttcaataagctgtttttt

SEQ ID NO: 12677 - DNA, 622 bp, Diabrotica virgifera
  misc_feature (104)..(128): n is a, c, g, or t
  misc_feature (158)..(180): n is a, c, g, or t
  misc_feature (186)..(198): n is a, c, g, or t
  misc_feature (200)..(212): n is a, c, g, or t
ccttttccccccgcccgcttttatttaatttaaaagagatatcccatcctttagtaaaagaaaagaaatgttttatttaacgatagggaattgagaccgcgagnnnnnnnnnnnnnnnnnnnnnnnnngaatttagtctttggacctcgggcatcagnnnnnnnnnnnnnnnnnnnnnnnatctcnnnnnnnnnnnnngnnnnnnnnnnnnngatcaatattatgataggaaaataaatacattacataatttctgcgtgaaagtttgtgtattgcacttttaaaaatccctaatttttataagaagaaaattttaatggttaatcaccaatcactctagaattgaatatactcagattagaaatacaaaatgttgtcggggaagcacctggatacactgacatttgaaaagttaccctgcaagaaaatcccagtgccaatgttggtctgattttgaggagagtcatcattaatttttaacaattaatatgtaaaattatcaaatcaacgtaacactgaaaaaactcttattacattagaacttagtctcgatgttacaggtaaggtcaaaaaggtgtacatagtagtagaaagacgattcagctccgtagaccgaatcgaa

SEQ ID NO: 12678 - DNA, 758 bp, Diabrotica virgifera
  misc_feature (8)..(44): n is a, c, g, or t
  misc_feature (68)..(131): n is a, c, g, or t
  misc_feature (133)..(166): n is a, c, g, or t
  misc_feature (182)..(336): n is a, c, g, or t
  misc_feature (368)..(449): n is a, c, g, or t
  misc_feature (477)..(501): n is a, c, g, or t
  misc_feature (578)..(596): n is a, c, g, or t
  misc_feature (696)..(713): n is a, c, g, or t
tgattgannnnnnnnnnnnnnnnnnnnnnnnnnnnnnnnnnnnngtttgtagcgtgtgtatcaggaannnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnaatggaatgtcattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgattataaacttacatattttaatgtatgnnnnnnnnnnnnnnnnnnnnnnnnnnnnnnnnnnnnnnnnnnnnnnnnnnnnnnnnnnnnnnnnnnnnnnnnnnnnnnnnnngaaggatgataatattataattaatagnnnnnnnnnnnnnnnnnnnnnnnnnggttaaataaaggaattcacctacatttctttcgcctgttaattacatgcatgtctgtatgaattatatatacacgnnnnnnnnnnnnnnnnnnngtttgaatgcgcgaggtattttgagcgagctaaggaagcatattcattattttattgattgatagctggaatgaatggatgaatgaaaaaataacctgannnnnnnnnnnnnnnnnngaattttattgttaagtaaaatagcttaattttttttacaagacg

SEQ ID NO: 12679 - DNA, 486 bp, Diabrotica virgifera
gagagtgtttgtatttttattatcattatatgtctatgattgtgatcaatgagtagcatagaacataagtcataaatcatactaggtattgtgaggaaattattatcagaggcaatgatccgaatacttatagtacaagaaacataaaaaatagagtttgtaaaatgtgttgtggttacacaaatttatgtagacaacgaaaaaacaaaaaagataagatatattggctatcccctcctcatatatgtatctgtatcgtctgatatcaacagaaaaggacggatggcggtgagcaaaaggacttacatctttaaagaaaatggataatgaacacgatatggcgataatcgaagccgcatatataaagatatgtaacgatggagatcttaagaacattagtgagaagtttgagatgatctcttgtggcactatattgtttatgagaagttaaatgatacgatatggatgaagaagggtaagtataag

SEQ ID NO: 12680 - DNA, 114 bp, Diabrotica virgifera
  misc_feature (5)..(26): n is a, c, g, or t
  misc_feature (41)..(64): n is a, c, g, or t
  misc_feature (95)..(112): n is a, c, g, or t
caagnnnnnnnnnnnnnnnnnnnnnngaaaagacccctatnnnnnnnnnnnnnnnnnnnnnnnnggttttctacatataatttttttgagtatgnnnnnnnnnnnnnnnnnngg

SEQ ID NO: 12681 - DNA, 137 bp, Diabrotica virgifera
  misc_feature (14)..(33): n is a, c, g, or t
  misc_feature (35)..(48): n is a, c, g, or t
gattgtctttttgnnnnnnnnnnnnnnnnnnnngnnnnnnnnnnnnnnttttgaatggccgggcgattttgaccgtgcttaggtataataatcattaagtgtgtagtggaaactcaattgacgggtttgatgataaa

SEQ ID NO: 12682 - DNA, 466 bp, Diabrotica virgifera
  misc_feature (2)..(56): n is a, c, g, or t
  misc_feature (60)..(108): n is a, c, g, or t
gnnnnnnnnnnnnnnnnnnnnnnnnnnnnnnnnnnnnnnnnnnnnnnnnnnnnnnngatnnnnnnnnnnnnnnnnnnnnnnnnnnnnnnnnnnnnnnnnnnnnnnnnngtatttggaggaacgcccggtattaaattaaatttagattattatgtccatctttaaaatttaaagatacataatattgtcctatctgacagtacgttattcatatatttttctatattaatattgtatagtttttataaccatgttaattaagaaaatcaacgttaaatttataagtgttgagtattgatgattaaagtattagcaatatattgtatatttatgggtcatatatgggattgataaacgaattccaccccgtttttttcacctgggtattaaagacatgactttctgtatgaactacaacggctcgtctgaccgctcattaacttgaatgcggcgcggggttttgacc

SEQ ID NO: 12683 - DNA, 134 bp, Diabrotica virgifera
  misc_feature (2)..(20): n is a, c, g, or t
  misc_feature (22)..(35): n is a, c, g, or t
  misc_feature (39)..(86): n is a, c, g, or t
gnnnnnnnnnnnnnnnnnnncnnnnnnnnnnnnnncacnnnnnnnnnnnnnnnnnnnnnnnnnnnnnnnnnnnnnnnnnnnnnnnnacgaccatccccctatcgaggtttaaaaaattcatttggcacgggttt

SEQ ID NO: 12684 - DNA, 629 bp, Diabrotica virgifera
cgaatgtaaagtccataaaatgctgccgaaatattaaatcacaactttgaagttttagacataagaaagaaacttttaaagctatattccaaaccaataagtgcctatgattgttatcaaaatataataagtaattttgcccttattcctacagggattgagaggaagaaattatctcaagtatgaaccgaatacaagtacttcgagtaacgacaaaatcggagtttctaaaatatcttctgtttataaaacattctgtagacaacggaaaaccgataaagttagttataatcgattctcttcctcctctatgtttcatatcgtcggatcaaacagaaaacaacgcatttctttgttacacagccaatattttacactatttggcaaaagaacacaatatggtgataatcgtaaccaacttaataacgttgtggaacgaaggtgattttaagaacattgatgtgatgaaagagagaatctcttgtggcacttattggtttgggatgcccaatgttaggatatgtttgaagaaggataagtataattgtagaatgactctaaccaaagctattaaagtaataccagaagttaatttttgtgatgttaagtttacagacgaaggatttgtg

SEQ ID NO: 12685 - DNA, 507 bp, Diabrotica virgifera
  misc_feature (4)..(27): n is a, c, g, or t
cctnnnnnnnnnnnnnnnnnnnnnnnnatgagaggtaatgagagtgacaccacaagatatttttgtaacagaagcacttatgatttgccgcatcggaagtagggcatgccaataaataaaatagatattgaatcagctcatgcatatatcatgcatattttttattttcttacttagtatataagtaggttaaggaatttgactggaacgctttgtaattggtgctcacgtcataaccaatccctgcataaaataattgaatatattcgattgctacccccggctctttaagtatagaataaacacagaaatgaaatagggggggtggcaccggatcaacaggtttccctcctcagtcatcagataccgtccatgaaggaccaacagcctacgtagctctgtgttagagtacgattcgcatgtaattgctacacaattaaagtgcaaataatctaatcaccacaacactgaatatacctccattaggaaagacctgcgctcgaatcc

SEQ ID NO: 12686 - DNA, 926 bp, Diabrotica virgifera
  misc_feature (105)..(128): n is a, c, g, or t
  misc_feature (130)..(146): n is a, c, g, or t
  misc_feature (233)..(255): n is a, c, g, or t
  misc_feature (286)..(308): n is a, c, g, or t
  misc_feature (310)..(326): n is a, c, g, or t
  misc_feature (328)..(340): n is a, c, g, or t
  misc_feature (358)..(375): n is a, c, g, or t
  misc_feature (409)..(433): n is a, c, g, or t
  misc_feature (435)..(448): n is a, c, g, or t
  misc_feature (450)..(466): n is a, c, g, or t
  misc_feature (470)..(488): n is a, c, g, or t
  misc_feature (490)..(529): n is a, c, g, or t
  misc_feature (542)..(578): n is a, c, g, or t
  misc_feature (580)..(596): n is a, c, g, or t
  misc_feature (598)..(631): n is a, c, g, or t
  misc_feature (651)..(709): n is a, c, g, or t
  misc_feature (820)..(842): n is a, c, g, or t
  misc_feature (855)..(877): n is a, c, g, or t
aaagaaaaatattataggaggaaagaaaagtagaagagggcgagaagatgttatttatataaaaatttcatacgttcattgtgcctgcgtgaatcaggatctacnnnnnnnnnnnnnnnnnnnnnnnncnnnnnnnnnnnnnnnnnctaaatgatatgaatttttattgtaagaaaaataccttagataatgattttgcagtgaaatgctattcgacttaaaataaatctaannnnnnnnnnnnnnnnnnnnnnnaatgcatgatcaatatatttataatgagaannnnnnnnnnnnnnnnnnnnnnngnnnnnnnnnnnnnnnnncnnnnnnnnnnnnnacattaaaatttaagtcnnnnnnnnnnnnnnnnnncataaattttcatatatgaaaacatgtaattatnnnnnnnnnnnnnnnnnnnnnnnnngnnnnnnnnnnnnnngnnnnnnnnnnnnnnnnnctcnnnnnnnnnnnnnnnnnnntnnnnnnnnnnnnnnnnnnnnnnnnnnnnnnnnnnnnnnnntaatatataggannnnnnnnnnnnnnnnnnnnnnnnnnnnnnnnnnnnncnnnnnnnnnnnnnnnnnannnnnnnnnnnnnnnnnnnnnnnnnnnnnnnnnngaatttgaatgggcgcggannnnnnnnnnnnnnnnnnnnnnnnnnnnnnnnnnnnnnnnnnnnnnnnnnnnnnnnnnngggccggatgaaaaaaaaagtgcctttattttatcttataaagaaattttatctctaaaggccaaaaaggctcaaactttctttaaaagaacgagaagacccctaatacannnnnnnnnnnnnnnnnnnnnnngttttttctaggnnnnnnnnnnnnnnnnnnnnnnnaattctttctcaatttgggggggactcaaacataaatttcacttttttt

SEQ ID NO: 12687 - DNA, 705 bp, Diabrotica virgifera
ccctcacctcctctataaccttttttcgaattacatttctaactacataaatttcctcaaaaccataccagacactgatacttaccatgcctttacaccccccttttgccccgatgtttgcccagatggtcagagactattccaggtactattctggtgtgataaaaactgttataacaagcatagtattatgccaagaatttgaacatgcctaagaaactgccgatgttcctaatgtgatgattaatctggttgttaatcactttgacacacaatttgccactacagatacacctacacttatgctagaactacctatagaccaccccgtgatcctactcatgatactacgaaattctgaggaggatgctgaaacgatctatgtaactatatttgctattatactttttgaagatcttgtagagcaagctcaacaactatttcctcctgtattaactcccaaagaaattgcaaaagttttagacaaatgtctatacaaccttccaaaacttatttccaatcttatttgcgatcctagaaatattgtcaaaatcttcgtatatctactaaacctccatacaaactaatagacaaatctaacaacatttttttcaacaggttctttcagaactgtttttctgttttaagtataacttctcagcctgaccactgataacttttgatgatcgcggaatttcgaccgag

SEQ ID NO: 12688 - DNA, 954 bp, Diabrotica virgifera
atgtctttgatgtatggaaaatagtaaagctagttgtgaaataaagatgtttagtgggttataatacctaattatggaaaactgttgtatatgagtagtttggtacttaaaattaatcaggaccagttgttcacatatattataagaatataaataacatgtacttaataaatttcgttacactacagcctgtacctggcattctaaaatttcatcatcatgattattacgttaatacataatgaaattttaacgttttaatctaccttgtaaatatatattcttatttaagatcctgcaataggtacgatgtacaattataataaataacttttcatagataataattcaaaataagtttttactggaaacaacaccaaaatttcaaatacaaaaatataaagtaaactgggatatataagataaataataacacaaataatacatatacatacacaacaatacacattcaaagatcgaagatcattaccgcaacaaatttaaaaatgggtttctgtactcttgtgacgtaagtctctccaccacagtcggagtaggcaaccgtagtaaatgtctaagaaccttgacacctcgatgcacagagcggcccataccttacctaatctattcttattatgtctatgctctgtacactagtttaaatatataaagattttgacatatgtataaagcaaaatgtcgaactcaacaatgataaaaaattgcattcaggtaattttgccataaagataataaagtattttttgaaagagattacttatgcagatcaatgtagctttgattttttacgttccaaaatatggaattttagtttacctagtcatttttttgtattctggtaaccagatggttggaagagtgtatgtgtaaatatgaatgtggaccatagagtctattctgtgttgttcggactaagtttttagggtgtggggc

SEQ ID NO: 12689 - DNA, 756 bp, Diabrotica virgifera
  misc_feature (2)..(747): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacgaga

SEQ ID NO: 12690 - DNA, 644 bp, Diabrotica virgifera
gtagtcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagggcaagtctggtgccagcagccgcggaaattccagctccaatagcgtatattaaagttgttgcggttaaaaagctcgtattcgaattctg

SEQ ID NO: 12691 - DNA, 934 bp, Diabrotica virgifera
  misc_feature (478)..(498): n is a, c, g, or t
atttctacagttaacacctcatagttttatctattcaaatgaattagctcctacttaacaattaagtacgaatttttaaaagtggttgagtgatgaaacttcaagaatatccagagctgaataagatggatgagccagcaacgacacgatatagcaataaattccttcactatttcaaatatgtcactgtggaaccgacaatgcttttgtatatgatggcgttcatgaccacaaatgtagcagagcaatcattttatgtttataagacgtgtaccataaaccatggatacaacaaaacgatctgtgataatatcaatgctcctgagtacaaaaatatctccaaagaagtacaggctagcactgcaaaatttcatgtatggaacaacatagccggtcatgtgacaccgataatattggcacttttcattggggcttggtctgacaaacgtggtcggaaacttcctttacttatcggtcnnnnnnnnnnnnnnnnnnnnnctctgatgataatcgtcaacactctccaacctagctggccagtggaatatgtcgtattcactgccactttaccttctgccttaactggtgcagatgttacaatcttcgccacagcattcgcttacttggtagatgtttcatctgtaagcaataggactatgagggttactattctggaagtgtgttatttagcaagtatgccgttaggaatagcctttggtgcctacctcttcaagtttgtcttcaacagatcatatacctacatgtttgtagttaatagcatactaatggtcttggcgatcttgtacacatccttacgtctaagttggaggagtaattccatgcaaagacctctttcggaagcttcaacaaatttttagacttctttgactaacatcacgctgtttccactttcggaatgttgtcccaatacaga

SEQ ID NO: 12692 - DNA, 910 bp, Diabrotica virgifera
  misc_feature (201)..(221): n is a, c, g, or t
  misc_feature (437)..(455): n is a, c, g, or t
  misc_feature (735)..(759): n is a, c, g, or t
  misc_feature (769)..(769): n is a, c, g, or t
  misc_feature (802)..(802): n is a, c, g, or t
aatcacttcaacatccctgtcggtaaaactgatcttctgaaacctcccaagtcgtttcccactcctgtcactcggtatactctgtgtgacatgacagtagagtggcacatgtatggtggaaacgatttcaaaatagccgaaagcgaaaacaagaagaagactgtacaattttcagaaactcaactgaatgataccgttagnnnnnnnnnnnnnnnnnnnnncgaagtgcatatcactagtaatatggataagaagagagctaacatgaattggatagtcaagggaggagttaatagggatcatgatgttcacatggagttacatttaaataaggttagatttcaacacgaagtgtatccagaaacaacgacacaagcgtcgcgacaagtgttaataatatccgacgtagaaattgtagatagattagaatcaagtcnnnnnnnnnnnnnnnnnnnccaatatactagtcaaagcaggccaaaacagtcacatgcacatatggtagtcattaagtcccttcacatacgacctgacccgaagctgccaactcaggaatgttgtctgaaagtatcgatattgccgcttcgattaaatattgatcaagactctttattatttctcattaatttcttcagtgatcttagtgacgatcattgcgaaaagacggatgaccaaggcaacatctccaaacacaacacccccacccaccatccacctgtgatgacaatcagcgannnnnnnnnnnnnnnnnnnnnnnnncaagcattanaagttgtagacgaaaatttaatactgttaatgnaggagagtaggcatcagtttgatttggataatgattcagtaaattctacatctactacgtcagatggatcaccagtcttcttcaggaatctaatatccagtctggaag

SEQ ID NO: 12693 - DNA, 538 bp, Diabrotica virgifera
  misc_feature (7)..(56): n is a, c, g, or t
  misc_feature (66)..(115): n is a, c, g, or t
  misc_feature (130)..(182): n is a, c, g, or t
  misc_feature (204)..(218): n is a, c, g, or t
  misc_feature (220)..(232): n is a, c, g, or t
  misc_feature (237)..(274): n is a, c, g, or t
  misc_feature (280)..(302): n is a, c, g, or t
tttaagnnnnnnnnnnnnnnnnnnnnnnnnnnnnnnnnnnnnnnnnnnnnnnnnnnatgtaattgnnnnnnnnnnnnnnnnnnnnnnnnnnnnnnnnnnnnnnnnnnnnnnnnnnctagattgaatatcnnnnnnnnnnnnnnnnnnnnnnnnnnnnnnnnnnnnnnnnnnnnnnnnnnnnngtgaagaatatataagaggtgnnnnnnnnnnnnnnngnnnnnnnnnnnnngttgnnnnnnnnnnnnnnnnnnnnnnnnnnnnnnnnnnnnnncctaannnnnnnnnnnnnnnnnnnnnnngagatgggttaggtttagtttcttattgaattagtaatttattatcagaatcattaaaagatttaatggtgtaatattaactgttttatctactccaagtggtgatgtagaatttttgataggtgattgcttgaatattaaattttgatagttgtaacatagtatgtatagtagaatttagtgtattaataacagttttgattatgaccataatactagctggatctgatatgttg

SEQ ID NO: 12694 - DNA, 810 bp, Diabrotica virgifera
  misc_feature (98)..(126): n is a, c, g, or t
  misc_feature (544)..(562): n is a, c, g, or t
aaattttattatagttacaataatagaaattacgtttatgaatttaacgaaccagaattaggataaacatttttgaaacatttcgtatttctcggagnnnnnnnnnnnnnnnnnnnnnnnnnnnnncacatggttttactactttaaagtgatcattcaagataaaaaattatttagttatcatattaaaaagaatatacaaaaaatatgtgtgaaatatatttaaaaaaagtggtctcaaaaaaagtatgtatcattactcttttatttttgggtataggaatgtacataatatgcataatgcatttttgtataaattcagtaatactaaattttctaaaaaaaatatgctaaaaaatttgttgacgttacgaattgtaccattaccaatatgtacctatagttacgagatgtcatggaaccaatagtaggtacctaacttacttagatttcacgaaggaacactctttatttaaatcacttaccttccaaaagaactagtgcatatcaacagatgccatatcgttaagttagaattataagnnnnnnnnnnnnnnnnnnngtgtaaacatattctgaaatagaactaactctaagtctctttcataaaactaacgggcataactgcaatatctgagaaatgttaacactctaattttataatgtttctcttaataattttataatactttagattttaacactccaaaaggattagcttgttaaatactaccctaaaacttacaactaaaattctacaagatcttatgaatcagaggataatttaacagatgtacaccagagttttcg

SEQ ID NO: 12695 - DNA, 919 bp, Diabrotica virgifera
  misc_feature (316)..(332): n is a, c, g, or t
cttatttatgtgtttttgctgcatatgtatatagtgttcagcatataagtccatattgtagtatcaaaaatacgtaatattatagagctcttactctcagttgtaatctaaggtctctatgaatactttaaattgtaatcgtttattttaattgttattgtcattttctgactctttgtaagatgtgtccataaaattgtgccatttttagtgacaaaacaattttttcgggatttcttcatcttcacatgtttctttaaaaatggagtgagtcactatattggatatattcacttatatggattcacattgaatnnnnnnnnnnnnnnnnnccctcccgatttcaatttttgaactgcgatctgtggcagtaaaattttattattcttaaatccctttttctatgattttttctttagaatttggactaactaactgttcatgtcttttcatttttctttctgaatccaaaccgactgtcacatattccttcttttagtgtgttatttatgtatgtattgttttcaaaagtaatttacgaacattatttataaatgatgttattgttctgtattcactacagtcttcagcgtctgtattttagggacagcgcaaaaagtgaatattaacaattattcttttggtataaatatgtcttgtgttttgtatgttgtggtatacatgtctactaaggttttatcatttacgaattttagctgtcttactgggatttgatctggacctactgctttgccatttttgctgtttttattataccattttaatattctcttatttgtgaaatcgcaccgtcttctacttcttcttccatctgttgtggtctatcctctctgaaaattcattgatatattatgtccatcttcatctattttcgatgcgaaaatcagtctgctattta

SEQ ID NO: 12696 - DNA, 163 bp, Diabrotica virgifera
  misc_feature (8)..(138): n is a, c, g, or t
attattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaataattaccctagggatacagcg

SEQ ID NO: 12697 - DNA, 932 bp, Diabrotica virgifera
  misc_feature (764)..(764): n is a, c, g, or t
  misc_feature (781)..(781): n is a, c, g, or t
  misc_feature (827)..(854): n is a, c, g, or t
cgatgtcgtcgacacccaaaggacctcagagtgcgctggtttcgacaccggtgaaggatagagcgaggcctgatcgagattacagcccacttagcacgccgcgaggtccatcatcgatattaaaggccgaacccaccgcttcctgctcgacgacggatgtcaccgcgacgccaaataaacgcttcaccagtgatactcctcgaacacccacacccttcaagaaagccctagcggatttggaaatgaagtccgggccgatcaaaaaccttcctgacaccccatcctcaagattggaagacatcacggagatcatgaagaaagatcaagacagttcccactacgaaacggacaccagcgtcatggtcactaacgatagtggctatatgaccggcaaacgaaaaggagctgcgtcttctgcagccggcaaagaaaacgtacttcctagcaagagggtgcgtaaagcgttggccccctcatgggcttcgtcctcctcccaaatgagctcctcggatatctcattcgcagtcgagactcctagtaagtcattgggaggggacacctcgatattattttcaactccgtcatcgataatgaaagattccttaggagtgacaggaatgatggactatcaccctcaggcaggatcctccaagctggactatctctgggtcatgatagcttgcggccaaacgaaggaccagcttgagcttactgaacaagcacataaatttcttaaaacgtctggtttaaaaccaagatctttnaatttttagcgtcttanatattgtatatatgatttacattcgttatttgaatgtagaaaaacnnnnnnnnnnnnnnnnnnnnnnnnnnnncagtatggtttttacgtctacagaatttcgttaatgggtagatttattttatatttgaattctatttacaatattcat

SEQ ID NO: 12698 - DNA, 58 bp, Diabrotica virgifera
  misc_feature (3)..(3): n is a, c, g, or t
  misc_feature (25)..(25): n is a, c, g, or t
  misc_feature (38)..(39): n is a, c, g, or t
tanattaccttaggggatacagcgntatttttattggnnagagtcaaatcgataataa

SEQ ID NO: 12699 - DNA, 893 bp, Diabrotica virgifera
  misc_feature (4)..(19): n is a, c, g, or t
  misc_feature (81)..(81): n is a, c, g, or t
  misc_feature (161)..(181): n is a, c, g, or t
  misc_feature (597)..(609): n is a, c, g, or t
  misc_feature (611)..(628): n is a, c, g, or t
  misc_feature (640)..(661): n is a, c, g, or t
  misc_feature (871)..(871): n is a, c, g, or t
atgnnnnnnnnnnnnnnnngcaactcggggacgaaaaagaagccaggacagtgttgcaaaatatcgtgaaaaatcacctcngttgccaattccagtgatgtcgataaaattcagtggccggccatagagagcaatatatgaaagaccagtattatttgtcnnnnnnnnnnnnnnnnnnnnngagacactatttttaaagaaaaacgagcgttttgatagttcctattttaatgtatacggacgatatttgttaatttgatttattttcttacttatgtcttcattatagtgcgacagattcgtgcaaatattataagaattgtgcatttaatgatagaaccacataatttggaccacgtatactacacatatacaggttcaaatttagatacgaggccatctcagatcttgccttttacaaaaatggcgggcattcaaaatggcgacgatacatatgtgactaatagcacgataacttttaaacgaaaagtccgacatcaaccaaatttggtatatgggttctttttttatgtataagatcgagctcctgaaccggaagaattggtttaccaaaaattgtgtttttcctgatttttnnnnnnnnnnnnngnnnnnnnnnnnnnnnnnntctttcaccctnnnnnnnnnnnnnnnnnnnnnnggtaataccggcattaaaaagagcgtaaaaatattttttaggaaatattttgaactttttagttatgttaattaccatgtaatcaatgcataacttatcttcacatgtacttatgtgcagcagattcgtgcaaatattataaaaattaccgtgcatctaatggtagaagcatataaatttggacacatatactacacatataaacgatcnaatttagatacgtggccatctc

SEQ ID NO: 12700 - DNA, 217 bp, Diabrotica virgifera
  misc_feature (2)..(15): n is a, c, g, or t
  misc_feature (21)..(43): n is a, c, g, or t
annnnnnnnnnnnnnctattnnnnnnnnnnnnnnnnnnnnnnnggaggatgatgaaatttgcatatgttaaatatgggaataatagatcgtgattcttataagcagagatccgacaacagcatctatgttataggggtacgtttcctatgtagaggatcgagctcgtgatcagcaaatattgctgaaccagagatagtgatgttccggatttatgat

SEQ ID NO: 12701 - DNA, 462 bp, Diabrotica virgifera
gataaagtagctagttaagtaagaagacaaaatgtataaagtagctgttttagtttgcttccttattgcagcaataaatgctagcccatacggaacttatgggcatcaggataaacatgtccaaccagttcctcatgttcctgaccatccccacggctcccatggccatgaggaacacggcggatatggtcctcaccatggtggtcaccaagattatacgcacggttctcatggtcatgaggaacacggcgaacatggttctcaccacggtggtcaccaagattatacgtacggttctcatggtcatgagcaacacggcgaacatggttcacaccatggtggtcaacatcccggtgcatacggtcctcatggtcatgagcaagagcaccaacatgagtctcaccatacgtacggtggacacgcatattaataattgttataatgtaacatgtttgactgttc

SEQ ID NO: 12702 - DNA, 88 bp, Diabrotica virgifera
  misc_feature (7)..(85): n is a, c, g, or t
cgagaannnnnnnnnnnnnnnnnnnnnnnnnnnnnnnnnnnnnnnnnnnnnnnnnnnnnnnnnnnnnnnnnnnnnnnnnnnnnnnggt

SEQ ID NO: 12703 - DNA, 653 bp, Diabrotica virgifera
  misc_feature (456)..(473): n is a, c, g, or t
  misc_feature (545)..(641): n is a, c, g, or t
cggacgcgtgggcattttggtgtcattttgaagttaagacaagacgagcaaaatatatcttgaattcaaatgtgtattttcaaaagtattatataactaattaattagttagaaacgacttcacctactacatagtccgtgttatacgaattctaagtgatatgtgttatttctgttcattcaaaataacatctctaatgtgataattctggttaatctgtatattttggactttgagaatggatacaggagagagatctctccattccacaaatgttgcagatattagggaaggttactacaatgaattttcccaagcttgtttttctatggaattagaaaaggccctagagaggcgttgctccattattgttatagaacccacacgacttgacgatgaaactgctaggtggattagtttcggaaattacttgcacaaaacggcaattatatctnnnnnnnnnnnnnnnnnntcaggatttgcctggtcagatacttttgtatcctcaagcaccgttaagaattatttcttcattatgtagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattataagcat

SEQ ID NO: 12704 - DNA, 735 bp, Diabrotica virgifera
  misc_feature (159)..(177): n is a, c, g, or t
  misc_feature (348)..(368): n is a, c, g, or t
ctggggtcggcctgcaaggtggcaaggctaagagatgttggcaatattcggactattctcatgaggaaagacatttgtaaacataacaaactgaactacattgactgtgagctaaaggtaacatatgattctctactccaaactttacattatattaannnnnnnnnnnnnnnnnnngaccattcttattgctatataagcaattttacagacttttttcgtaatgaaatgttattacagtttcaatttgacataacaattaaggatatacatggtctttatttattatccgtatatatgtaattcaacccataataaattatagagattaaatatttttatgtacgnnnnnnnnnnnnnnnnnnnnntcaaattaatgatgatagatgctacataagacaataaattatcttatttaaacatatgtgtttattaatattatatctcttatgatttgtactttgtatattataaacatgacactttggattacatatagagtgtgaactgacaagtgcttaatgtgaatgtgcagaaaattgtgacctatgctaaggtacaataaacaggagttactttaatctgagagaaggaatgaaaggttggatgataaaacaactggcaatatttaatctatcaggaaagattccctaagggagaaagcccatgttattttatgagccgagaagacccgatttaagtccaaacgttataaagaagttttttgatcttaac

SEQ ID NO: 12705 - DNA, 749 bp, Diabrotica virgifera
  misc_feature (2)..(748): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 12706 - DNA, 547 bp, Diabrotica virgifera
  misc_feature (139)..(157): n is a, c, g, or t
  misc_feature (440)..(454): n is a, c, g, or t
catttgcaaattttgcaggacaaaatgacgcagctgcacattcaggaaatcctgaaaaagatagcaatgacgaaacgacgaaaaggttttaaggattatttaggaagatggaggtggcattgatttttttctgtttgtnnnnnnnnnnnnnnnnnnngcagttcaaacagtttttgtacagtaacagaaaatgtataagcgtcaaatgagactagtttcattgtcaataaatccgtgtggatacttttatcaaacttttttaggttctcactccatttagggtataatacaaggtatcccaaaatgcacgaaagatttgaatttggcgccattcatgtagtgagcattaccaacaaccaaacaaaaatagtttgacagctgagagtttaggattgttaaaaatggggcgttacatgagagaacaacgaaaacattgaaannnnnnnnnnnnnnngtcgaacaagctaaaaatgcgagcattatcataacgtaaactttgtttatttacgtattttaattcataatatgaaaaattactattacgaaa

SEQ ID NO: 12707 - DNA, 98 bp, Diabrotica virgifera
  misc_feature (2)..(90): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgat

SEQ ID NO: 12708 - DNA, 253 bp, Diabrotica virgifera
  misc_feature (7)..(44): n is a, c, g, or t
  misc_feature (80)..(101): n is a, c, g, or t
  misc_feature (109)..(131): n is a, c, g, or t
  misc_feature (166)..(192): n is a, c, g, or t
  misc_feature (204)..(240): n is a, c, g, or t
taacagnnnnnnnnnnnnnnnnnnnnnnnnnnnnnnnnnnnnnntgcgacctcgatgttggattaaagcccaccttgccnnnnnnnnnnnnnnnnnnnnnntgttcgannnnnnnnnnnnnnnnnnnnnnnagtttaaaccggggtgagccaggctgggtttctannnnnnnnnnnnnnnnnnnnnnnnnnnacaaagggaccnnnnnnnnnnnnnnnnnnnnnnnnnnnnnnnnnnnnnctaaaaaacaaaa

SEQ ID NO: 12709 - DNA, 821 bp, Diabrotica virgifera
  misc_feature (3)..(559): n is a, c, g, or t
  misc_feature (561)..(676): n is a, c, g, or t
  misc_feature (682)..(718): n is a, c, g, or t
  misc_feature (720)..(766): n is a, c, g, or t
gtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaagnnnnnnnnnnnnnnnnnnnnnnnnnnnnnnnnnnnnngnnnnnnnnnnnnnnnnnnnnnnnnnnnnnnnnnnnnnnnnnnnnnnntaacagcgtaattttatgggagagttcaatcggtaataaagatggcgaccccgat

SEQ ID NO: 12710 - DNA, 191 bp, Diabrotica virgifera
  misc_feature (13)..(13): n is a, c, g, or t
  misc_feature (23)..(23): n is a, c, g, or t
  misc_feature (36)..(57): n is a, c, g, or t
  misc_feature (59)..(189): n is a, c, g, or t
gttaaaagcttanatttttttanaagacgagagacnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncg

SEQ ID NO: 12711 - DNA, 890 bp, Diabrotica virgifera
  misc_feature (13)..(36): n is a, c, g, or t
  misc_feature (42)..(64): n is a, c, g, or t
  misc_feature (255)..(328): n is a, c, g, or t
  misc_feature (333)..(398): n is a, c, g, or t
  misc_feature (416)..(434): n is a, c, g, or t
  misc_feature (443)..(457): n is a, c, g, or t
  misc_feature (459)..(475): n is a, c, g, or t
  misc_feature (478)..(497): n is a, c, g, or t
  misc_feature (512)..(532): n is a, c, g, or t
  misc_feature (670)..(719): n is a, c, g, or t
  misc_feature (724)..(827): n is a, c, g, or t
  misc_feature (837)..(837): n is a, c, g, or t
  misc_feature (839)..(841): n is a, c, g, or t
  misc_feature (845)..(883): n is a, c, g, or t
atctaaatatccnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattatacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaccccnannncccnnnnnnnnnnnnnnnnnnnnnnnnnnnnnnnnnnnnnnnctcatcc

SEQ ID NO: 12712 - DNA, 175 bp, Diabrotica virgifera
  misc_feature (5)..(5): n is a, c, g, or t
  misc_feature (8)..(8): n is a, c, g, or t
  misc_feature (11)..(167): n is a, c, g, or t
ccccnaanccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattttttt

SEQ ID NO: 12713 - DNA, 670 bp, Diabrotica virgifera
  misc_feature (5)..(52): n is a, c, g, or t
  misc_feature (57)..(131): n is a, c, g, or t
  misc_feature (161)..(208): n is a, c, g, or t
  misc_feature (236)..(299): n is a, c, g, or t
  misc_feature (322)..(417): n is a, c, g, or t
  misc_feature (441)..(459): n is a, c, g, or t
  misc_feature (469)..(503): n is a, c, g, or t
  misc_feature (534)..(577): n is a, c, g, or t
  misc_feature (580)..(598): n is a, c, g, or t
  misc_feature (611)..(631): n is a, c, g, or t
  misc_feature (635)..(653): n is a, c, g, or t
ggtgnnnnnnnnnnnnnnnnnnnnnnnnnnnnnnnnnnnnnnnnnnnnnnnnatctnnnnnnnnnnnnnnnnnnnnnnnnnnnnnnnnnnnnnnnnnnnnnnnnnnnnnnnnnnnnnnnnnnnnnnnnnnnggggggtgttgtgttgtgggggggcgcggnnnnnnnnnnnnnnnnnnnnnnnnnnnnnnnnnnnnnnnnnnnnnnnngcgctgccccccccctccctcccctccnnnnnnnnnnnnnnnnnnnnnnnnnnnnnnnnnnnnnnnnnnnnnnnnnnnnnnnnnnnnnnnncgccccccactacatatttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgacgccgatcaaaatctctnnnnnnnnnnnnnnnnnnntcctctttcnnnnnnnnnnnnnnnnnnnnnnnnnnnnnnnnnnnagaaagcgggccggccccccgccccccacannnnnnnnnnnnnnnnnnnnnnnnnnnnnnnnnnnnnnnnnnnnggnnnnnnnnnnnnnnnnnnncgggggggggtgnnnnnnnnnnnnnnnnnnnnntttnnnnnnnnnnnnnnnnnnnccacccccctccacccc

SEQ ID NO: 12714 - DNA, 844 bp, Diabrotica virgifera
attgtctacggttacctggtgactggatttttctctgtaatggcagctatgtccaccagcaaaggcatgttgatgggggccaaatttatgtctgggctaattttgaatggtccatactcagctaccactacacacatcaccgaattccactcgtccaaatacagagggaccgttcacatgataagaggaatcttcttcagcgtgataaatctttttttaccagtgttagcgtgggccattctaccgaggaagattaacataacaatctttggttttgaatttcacgcatggaacgtcttcatgttaatttgtgcctctatgaccataatctctggtatcctttatatgtttttaccagaaagtccgaaataccttatgagtatgggaaggaacagagcagcattagtagttatgaggaaggtttattctaaaaataccggcaatcctcaagaagactttccagtgaaaaaactggttaacgaagcaaaacaaaatttcacctccagtagagttgaaatggcgacagctctaaaaagcggctgggaagaaatgaagacaattttacataggcctcatataaataatatgattttggcctcttttaatgcattttctgttgtaatgagtttaaacacgttgaagttttggcttccgggaatcttccaatccatcagtgactaccaaaacaaccacaacggtaccagtagcagcatgtgtgtaatgttaggagagatgagtaaaccaaaaaatattacttctagtcaagaatgttcagtggatctggataatttttccgtataccttaggacctttattgtagcatctgcaagagttgaagtttttg

SEQ ID NO: 12715 - DNA, 991 bp, Diabrotica virgifera
  misc_feature (585)..(623): n is a, c, g, or t
  misc_feature (840)..(841): n is a, c, g, or t
caggtttcaaagagaagatcttataagattggcagtggcattgggaattcctgaacaaataaagacaaggtctagacattcatctggaggactcgaaggactatgtattttactaagaagattagcatatccaagtaggctttgcgatttggaacaacttttccgaaggtccgctacatcaatatctgaaattagtaattatgttaataaccatatttacaggaatcatggttatctgttaagagatttgggaaacttgccatggttaaacagggaaaaactaagtgcctattctaatgtaagtaaacttaatttgtattctagtaaaatatttcagctttttatatatttgtagtcaattgcagcaaagggagctgcagtacaaaattgttggggatttattgatggcacagctaggccaatatgtaggccaacagagttacaagaagaatactattctggacacaaacgagtccattgcttaaaatatcagtctcttatttgtcctgatggaattattgtaagtcttctgggggcatattcagggcgtaggcatgatgcatttatttttggacaaagtgggtnnnnnnnnnnnnnnnnnnnnnnnnnnnnnnnnnnnnnnngtatatatgtcatttatggagatcaagcatatggaatccgagagctactcttgtgcccttaccctggccgaggaatcactgagcaacaacagaactttaatttaagtatgagtgtaactcgacaagcagttgaatggggattccagaaaattatttctcagtttccatttttagatttcaagaaaaatcaaaaactattattgcaggaaccccgagnncccgtttaaaacagctgttcttttatgtaactgtcataccatttttatatggaagtgaaacagcacaatttttttaataattgaaccagtattcttaaaggagtatttaaacctataatatgttagtttttataaatggtaatttacatg

SEQ ID NO: 12716 - DNA, 677 bp, Diabrotica virgifera
  misc_feature (616)..(634): n is a, c, g, or t
ccttttgaaaaaaggtctttttgaagaagctattgatctatttgatatagctaataatcaagaagaagttctgaaactcaattgcagtattttatcaagaacagtccacttagaaaatgaaccaaattcgttaagaagtagaattactgaaaaagcgacaaacttcgcaaatcgatttttgagagaaggttataaaacaagtcctactatagtaaactcctttattaaattaaaagatttgattacattttttaatcaatatcatgacaaaaattatcctcaagcttcgaagactcttcacgatttgcaattggtaccccaaagaatggaagaggttgacgatagggttaagacttttaaaaactatcatcaagatctttgcaaagtgtttccagatatagttctagctgcaatgaatatgatatttgcacaataccaaaaactgaaatcgaatactgaatacataccgaggttcagggatgagacaatggaagtccaattgaaaacactgagggaacaagcgaaatgtttgacaaactttactggaatgttgccatatagaatgccaggagataccaacagccgtttaatgcaaatggagattttaatgcattgnnnnnnnnnnnnnnnnnnntgatatattgctaactttcaaaaataagatgtacttttataat

SEQ ID NO: 12717 - DNA, 644 bp, Diabrotica virgifera
  misc_feature (2)..(602): n is a, c, g, or t
  misc_feature (604)..(635): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnngtcattagc

SEQ ID NO: 12718 - DNA, 200 bp, Diabrotica virgifera
  misc_feature (5)..(49): n is a, c, g, or t
  misc_feature (55)..(59): n is a, c, g, or t
  misc_feature (78)..(97): n is a, c, g, or t
  misc_feature (119)..(180): n is a, c, g, or t
caacnnnnnnnnnnnnnnnnnnnnnnnnnnnnnnnnnnnnnnnnnnnnncccccnnnnncccccacctctctttcacnnnnnnnnnnnnnnnnnnnnacaatttatttaactgggggcnnnnnnnnnnnnnnnnnnnnnnnnnnnnnnnnnnnnnnnnnnnnnnnnnnnnnnnnnnnnnngcccaacctctttccaactt

SEQ ID NO: 12719 - DNA, 109 bp, Diabrotica virgifera
  misc_feature (34)..(51): n is a, c, g, or t
gtgaccgtgctagggtagcatattcattagtttnnnnnnnnnnnnnnnnnntgaaggaaagtgatgatatataactggctttgattaatttatgaagaatttattttta

SEQ ID NO: 12720 - DNA, 959 bp, Diabrotica virgifera
  misc_feature (270)..(282): n is a, c, g, or t
  misc_feature (284)..(301): n is a, c, g, or t
  misc_feature (721)..(721): n is a, c, g, or t
  misc_feature (780)..(780): n is a, c, g, or t
  misc_feature (850)..(850): n is a, c, g, or t
  misc_feature (860)..(861): n is a, c, g, or t
cttacataaaaataattatatagagaaattacaccatatatttacttttttatcagactgtgaaattgaaaaatttgaaggaaccgaaaaaaaccgtttggaccgaaaaaattggtcagaaccgaatcgaaatattttaccaaaaccggaaccggaccggacctaaaattttgaatttgactagaatcggaaccggaccggaaccttttatttcatttcggtccgggtccctggtttaaatacatttcgagtacttttagagtacttaannnnnnnnnnnnncnnnnnnnnnnnnnnnnnntaagatacgaaatcgaaccagatcttaatagagtaagatcgagaaagtgaaatcaaattgtatgattcttcaaaaattgtgtctgtaactgtcgatgttaagtcactaccagtatcatatgaattccaatttgtgtcttctcctaaattgtcacgaaatattgctgagatacctatttcagtttaaccactggcgaagcgtccatgtaaccactgctacctttgataacagttaaaaatcttgcacataaatattttatgactactatgaaataattccatttatattttttaccaacagaaatatttgttaatagtacatacctaattcagtaaatagccaactagacgcacgaaaatattggcgagattatgtgaatccgttgcacgttatatgcacattatacgttgttaccacttnttggttgtggtaacgaaggatgatcctcgctatcgctagggactggcttgtttctgaanattttgaaggagctacggctctagaggacggcgcgtgggcacgtgtgggatatatcagttttttttaggnaaccggctgnnactattacagaattacagtgtgcctgcattaaaacattggaaagagtgttgctgcgtaatcgatcaactaacttaaaagtcatcctcctgggtatatg

SEQ ID NO: 12721 - DNA, 675 bp, Diabrotica virgifera
  misc_feature (566)..(586): n is a, c, g, or t
gtgctcctggacctctttgccatcaactatttttgttttttgctcctgaccatgtctgatgagaaaaactttactccgaataagaggaggaggtagaagaagttgaaactcaattttctttaaccactaccaccatagtatgggggggagagcataaaacttgatttatcgtatattttgattataatagatcgcttcattttttaccgctttgcgattaatatttactagatcctttgttggagacggagtgaagtgatagttcaagatactcggggacctcttcgataaacaaattgttattcgtgttgatattttctggccaaaggaggattatatcaacgatggaaaaaatcgacaatatatctctcattagcaatgaaaagaaaaattgttgagtgatcaactttgagttgagtgaaccacaagacaagccacttgtcggtgatgatatctcgtatacagcacaacaaaaacaatggatctaacttcgccaatatctacagggacagccggatccaacctctctgacgctcaacgtgagtaggattaagactactgtagannnnnnnnnnnnnnnnnnnnnctccctttccatccgtatcaaatccttggtcctagatggactttacgtagatagactctgctatagagccacagaactctgggattgca

SEQ ID NO: 12722 - DNA, 938 bp, Diabrotica virgifera
  misc_feature (790)..(791): n is a, c, g, or t
  misc_feature (797)..(797): n is a, c, g, or t
  misc_feature (845)..(845): n is a, c, g, or t
  misc_feature (866)..(866): n is a, c, g, or t
  misc_feature (873)..(873): n is a, c, g, or t
  misc_feature (904)..(905): n is a, c, g, or t
aaatttttgctggatttatttttattcaggtatttgaaaatatttgttatttgttataaaagtatgttaaccctttagaattcgtacaggagtattgctcctacattcatagttaatgtctgtgataactatgtgatatgtctaccaaaaactaaaaacgaaagtttgctaaacatttaaattctggtctactattggaaaaatcattttaatgtatagaatatcattgtactatgttcttaaacagttaatcctaaaatagttacatattgtacaacagaaaattaattttggtgtaacatcaaagatagtgtacacaggatcctctgggcatatctgattcatttatgttttgtgttaattaacaatgaaaaatattcaatttatccacttgaattttgttctcaatgccgtaataaaaaatacgacctattgttgatgcttattttattttaaaacagtgagtgtttttcttatttatatatcctatacttataagacaataatttaaaacctctatagctgtctaaattgccaatataccaaagaacttccacaatgttgtttactgttttattctgaaatctcagtattattattttattgttcttactgatacattcccaaagccttacgtctataaagattatatgaaattattatacgtaaataatttagaactgctatttttaatttgcaattcggacatatatggcccaactataactaacttgccagcgattctgtaattcccagtgaaactgcagataatttctacagtttatgtagnntaaggnatttttatttaattatcgtttatttcccttttttgtttcattgattanaaataaccgaaatcgattggngaaattnttaaaactatgacactccttcgaacattgcnnaataaagacggacatatatgacccactataacc

SEQ ID NO: 12723 - DNA, 530 bp, Diabrotica virgifera
  misc_feature (19)..(61): n is a, c, g, or t
  misc_feature (75)..(111): n is a, c, g, or t
  misc_feature (118)..(177): n is a, c, g, or t
  misc_feature (217)..(244): n is a, c, g, or t
  misc_feature (254)..(288): n is a, c, g, or t
gtaggtaattagtattggnnnnnnnnnnnnnnnnnnnnnnnnnnnnnnnnnnnnnnnnnnnaccctggggatccnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatgaaatggtattccgttttaaatatatccaaatttttnnnnnnnnnnnnnnnnnnnnnnnnnnnncaaaaatttnnnnnnnnnnnnnnnnnnnnnnnnnnnnnnnnnnngttttaaggaagaagttaacaataagtatttactacagttagaattttggatctaaaactcggcttaagaactttccttgtgtcaaagaggctgaatattcccctcgagaatttctccctctacttcgcgaaccggttcccactccattatttcgttaggtactgctggaaatagtgagcacacgaccactggtcatacacccagaacactcgggatgaccaaacgaaagccacagtactct

SEQ ID NO: 12724 - DNA, 116 bp, Diabrotica virgifera
  misc_feature (5)..(5): n is a, c, g, or t
  misc_feature (8)..(10): n is a, c, g, or t
  misc_feature (12)..(12): n is a, c, g, or t
  misc_feature (16)..(41): n is a, c, g, or t
  misc_feature (46)..(106): n is a, c, g, or t
ccccnatnnncnccannnnnnnnnnnnnnnnnnnnnnnnnnggggnnnnnnnnnnnnnnnnnnnnnnnnnnnnnnnnnnnnnnnnnnnnnnnnnnnnnnnnnnnnncaaatttttt

SEQ ID NO: 12725 - DNA, 248 bp, Diabrotica virgifera
  misc_feature (4)..(134): n is a, c, g, or t
  misc_feature (138)..(138): n is a, c, g, or t
  misc_feature (151)..(238): n is a, c, g, or t
gagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacnaaatttatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaatttttt

SEQ ID NO: 12726 - DNA, 907 bp, Diabrotica virgifera
  misc_feature (303)..(321): n is a, c, g, or t
  misc_feature (753)..(753): n is a, c, g, or t
cttttcttggctattcttgtccaatgttccatcttgtgtaattttaagacccaagtatttatattcctgacagtgattaatagttatttcattttccaacgatagatcctgctgtatacctcaaacacacatatattccgttttgttggtattcatttccaaaccccagtgcaggattgggagtatagacagactcgacaaagacatcaacttttgaaaaggataattacgaagtacagcaacattgaagataacattaatgtcattaggaacttggaattacagagaagtgatatagactannnnnnnnnnnnnnnnnnngcccctctagatccactgctggacataggcctcccatgtttgtagacaagtagactaatagaataacaagtatagtgtaagtacatgtaagtaggtaggttaacaccttggctaccgtgtgagatgccagcatttcacacaaaatattgactgtaataccgtgtgagacgctggcttccattgttattaaatgatttaaaatgctctaaagcgagagtttttagtttctcatattggtttcaaaataaggataaaatggtacaaaattacaggttattagtttaagtgatcgctaaccaaggtattaaacgttaataaaggtatggtagttattcgctccgagcgttaacaaagtgtcaaagcaaaatcgaccgacctgctcatgggtggcggttttttgaaattttataaggacgctttgtgtatgtttanatgagacatttaaaaaaatgtcgtgtcacgctagtgatattatgtattaatataaacagaaaataaaaacgcactataaattcttcactttccaatattgattatcagtttgattttgtatgcataacctcactatcgcagtttatgtcaataa

SEQ ID NO: 12727 - DNA, 890 bp, Diabrotica virgifera
  misc_feature (749)..(749): n is a, c, g, or t
  misc_feature (790)..(790): n is a, c, g, or t
  misc_feature (848)..(849): n is a, c, g, or t
aaaagaagctcgagtatatatacataaaaaaaagaaaaacataaatccgaaaaatggaaaattcatcggctgcgttgaaacttagtggtggtgacaactgggtagcctggaaatttcaaacaagggtagtgctaaaaagccgtggttattatgacatagtaataggaaagtctgtgagaccgagcactactggagatgaccaaaagaaatgggatgctggtgattcaaaagcacaagaatttatagtaaccagaatagagcaaggccctatgacacacattttatcctgtgagacctcgaaagatatgtggacaaagttgaagtctgtctacgacaaagagtcagaggtgagcattcatttaatgcaacaaaagttttttctcttggagttttcatcaggtaaaaatgttgcctcattcatatcacagcttgaagagataaaaaataagctaaagcaagctggtgaagagctgtccgataaaatgatcatgacaaaaatacttatggcattgccagaggaatataagcattttcggtccgcatgggaatccgtaccatctgataaacaaaccctagatgaacttacatcaagactacttatcgaagaagaaagaagtaagtcaacacagggcagcacagcattggcgatgaaaagtgatacaagcagagaatttaaagggcaaaagaaaaccaggttaaagtgccatttttgtggcagaggtggccatattgcgaaaaattgctttttncagaagaaagagagagataataatagccagaaagacataanagtatgcagtcaatgtaaaagacgaggacacaacttacaaagagtgttggtttaatannaataaaaatgaaaaacaacagacaagcagagaagaaaataa

SEQ ID NO: 12728 - DNA, 707 bp, Diabrotica virgifera
cgccaagtcagctgcactcaaaaacccgattaatccaaatctagttccaattaccatcccaccaggtggaagagctccagctcacgctatctcgtctgccctttctagccattcttatccaacatcatctccattatctccaaagttaaacacagctggtacccaatatcagacaaattactccggtcccaaaccattctcaagcgtaaatgcgccactctctccccataacactcttccaagagcagccccattatctccagtagctccagcaccatcttttaatagtcattcttatactccttctgcttacagtccttcatcaggacgattctcttctgttaaaccagctggtggtctttttaaaggtgctggaagcggtaaacaatctacaggtgtaagaattgcaccaagacgtggtcgtggtatcttaaaccccgctgccattggtggcgctagaattcctctttgtggtagctgtaatatgcaagtcagaggaccatttataacagcccttggaaagatttggtgccctaaccatttcatctgctcgactccttcatgcagaagacgtcttctagatattggatttgtagaagaacgtggagaactatgctgcgagtactgcttcgaacaatacttaactcgtccatgctctatatgtggtggagaaaatgacagcggactgcttgaagggaataggaaag

SEQ ID NO: 12729 - DNA, 664 bp, Diabrotica virgifera
  misc_feature (3)..(19): n is a, c, g, or t
  misc_feature (60)..(81): n is a, c, g, or t
  misc_feature (188)..(207): n is a, c, g, or t
  misc_feature (440)..(467): n is a, c, g, or t
  misc_feature (469)..(485): n is a, c, g, or t
  misc_feature (488)..(507): n is a, c, g, or t
  misc_feature (511)..(532): n is a, c, g, or t
  misc_feature (536)..(563): n is a, c, g, or t
cannnnnnnnnnnnnnnnnttttataactttttattttctggtagataattaatattgannnnnnnnnnnnnnnnnnnnnngaaaaaacatctattttttgtaaccttaagctgccggacttattgattaatgatctgtctatctaattgttatcatgttttaaaaacttttttattacaaattgttnnnnnnnnnnnnnnnnnnnngactgtttctgttgctatgatctgtcctccttctttaaaattatctttctcctttatggcccatccagatttatatcattcttattttgtatgatgtataattattcttatgttattagacttttgtgtttgtaggcttgtttttctacattatactttattacaattggattgtatattaagctcctagtgtaccacctcccatatgttaacatatgatgttatttatttcnnnnnnnnnnnnnnnnnnnnnnnnnnnngnnnnnnnnnnnnnnnnnccnnnnnnnnnnnnnnnnnnnngttnnnnnnnnnnnnnnnnnnnnnntatnnnnnnnnnnnnnnnnnnnnnnnnnnnngctctaaatgaattctcgccacatttttttcacctgattattataatcatgactttttgaattatatatagagcctcgcctgccctctgattagtttgaat

SEQ ID NO: 12730 - DNA, 763 bp, Diabrotica virgifera
  misc_feature (2)..(29): n is a, c, g, or t
  misc_feature (32)..(45): n is a, c, g, or t
  misc_feature (50)..(557): n is a, c, g, or t
  misc_feature (564)..(601): n is a, c, g, or t
  misc_feature (728)..(746): n is a, c, g, or t
cnnnnnnnnnnnnnnnnnnnnnnnnnnnnacnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagtttataattggtgtaacagctatattattaattctgttcgactcttaaaattttacgtgatctgaggttaaacgcgggtgacccatgttgagttctatcgttnnnnnnnnnnnnnnnnnnngaacataggaccaaatc

SEQ ID NO: 12731 - DNA, 697 bp, Diabrotica virgifera
  misc_feature (301)..(324): n is a, c, g, or t
  misc_feature (495)..(512): n is a, c, g, or t
  misc_feature (515)..(527): n is a, c, g, or t
cggacgcgtgggatgctgtgatttttttttgtgacggatattcttgagttgaggttgatttcatgtggtcgggtgaactatctttcagtgaattcgtcccaggagcgcaactcataaatgttggcaatatcattttgaagtcttctactttggagtgtatagtatgtgtctgaattgccagtgtgggtgagtcggattaaatggattattggaggaattttttacttagcaacaacatttttgtttagtttggtagtattttgtattttgacaacgacatccgagttgggtgtcgaaacgnnnnnnnnnnnnnnnnnnnnnnnntggcttgtttcctatctaaatggttaattatgtaaatatgtagtgtgttagctgttgttttatgaacaacataaaacattatgtgaaatattgattgtatgttatccatgacacagaacaaaagttaaaatgcatgtttttacatttgtagccttttaataaccttatcannnnnnnnnnnnnnnnnngcnnnnnnnnnnnnntctcagtaagttggaaccatggacgtataaatagaagtagtatatcttgtattatatacgtacagggttggaatgatatgaaggagttttttattatcattttgacgaacaatgtattttttattaatgctatgattgatcccgtgacctgtagaaatcctgaaaaatat

SEQ ID NO: 12732 - DNA, 555 bp, Diabrotica virgifera
  misc_feature (23)..(42): n is a, c, g, or t
ccccttccccgcgcccgcggtcnnnnnnnnnnnnnnnnnnnngcctattcttccagcaggcgtattgaagattttgatttaatgatagtcagtctagcagcgagagagaatattgtattcttataatagaaaaatttcttccttgaaccctgagtatcaaggataaaaagttgaaaatcatatatccatcattttcgacccccgaagagctacaaaattaaaattcttattgtaaaatcaatattataaataactgttttgcatcgaaacgccatgcgcgcttagaccacatctaaatactggaagaactaaattaaatctaagtactaacaatacatctaaaggtaaatagtcttacataatctgtatgaaatgtattaacggcgggctcatgaagcagattttattatcatatgatttgtagtgaaagaaatgattaggaatttacgtattttgaagtatgttctacccaagcttgagctgataccatgtatggtaatggaagacttgtgcttaccatacatactacagggacatgactcgcaggagatgact

SEQ ID NO: 12733 - DNA, 881 bp, Diabrotica virgifera
  misc_feature (656)..(674): n is a, c, g, or t
ccttgttgacaaattttgtcaaatttaaaaagcaacaaacataataatattatggatattacaacaaaattgtcaggtttacaagaaatatccaaagcacaactctccaagatattaaacgtggtttcaaacccgaagtatttaataatagaaccatcattaattaggccactggaaagagtatgtggtgttacatggttaaaaggaaatggcatagagaaaatatttaaattagaacccgtaaatccatatgcaggatcaaatgttgtattttacatgatatattttgatacaatagtatttaaacaggtagtagatcagatcagatcacagattgagaacattgaacaaccagtaaagaataaatttcacattattgtagtaccttgttacaattgtgcatttgaaaatgaactagaagcattaggtgtttatggtacaataagaatacatcacttccagtggatgcctttacatctggacacaagtttactgagtctcgaaataccgaatctatacagttctctctttgtatataaaaacttaacttatctacctgttttgtccaagtgcttgtggcaactcaattttgtaataggtaaaccaaggtttattttatgtctaggtgagtattctaaagcagttctagctcaatnnnnnnnnnnnnnnnnnnncagaggagaaactgatagactagaatctgattttggagccttaataataatggatagaaacatagactacacaagtgcattattaactccaggtacatatgcagccctactggctgagatatacaacgttagtgcagggatttgtgaaaaaaaggaagagaaactagaaaaatttgatacgaaatgtaatccttttaccagaaaaac

SEQ ID NO: 12734 - DNA, 477 bp, Diabrotica virgifera
attgcgtagatcgagggaggataatcatttttgatcttaaaagttgctgatacgtacatgcagtgagataggatggcatagggatatgagatattcatcctcgaaatactgtacgaactcgtctgagggagatctatgtctgaataggatgaatatattatttgtttgaggataggcgatacgaaattacacacatgattgtgactaacatatatttttcgtttgtatagatatcggctgttcgcccgatcggaagtgtagatagttcttggcggatttgctgtgctacattagttatctatcaatacccataagcaatcagatggttgatgcgaaaaacctggaatatctgctgacgtgattcggaaaccaaaaaaataagcgtgtagataaatagcattttagcatcgaaaaaaatatttatgtatttatggagttataaaagtttacaacctggtctgagatatccatccccta

SEQ ID NO: 12735 - DNA, 773 bp, Diabrotica virgifera
  misc_feature (11)..(33): n is a, c, g, or t
  misc_feature (224)..(297): n is a, c, g, or t
  misc_feature (302)..(367): n is a, c, g, or t
  misc_feature (385)..(403): n is a, c, g, or t
  misc_feature (412)..(426): n is a, c, g, or t
  misc_feature (428)..(444): n is a, c, g, or t
  misc_feature (447)..(465): n is a, c, g, or t
  misc_feature (480)..(500): n is a, c, g, or t
  misc_feature (638)..(687): n is a, c, g, or t
  misc_feature (692)..(743): n is a, c, g, or t
  misc_feature (745)..(772): n is a, c, g, or t
ccctttcgtannnnnnnnnnnnnnnnnnnnnnngatagaaaccaacctggctcaccccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggaaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagggggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnngnnnnnnnnnnnnnnnnnnnnnnnnnnnnc

SEQ ID NO: 12736 - DNA, 87 bp, Diabrotica virgifera
  misc_feature (11)..(85): n is a, c, g, or t
cagaaaaaccnnnnnnnnnnnnnnnnnnnnnnnnnnnnnnnnnnnnnnnnnnnnnnnnnnnnnnnnnnnnnnnnnnnnnnnnnnngg

SEQ ID NO: 12737 - DNA, 955 bp, Diabrotica virgifera
  misc_feature (718)..(718): n is a, c, g, or t
caatttttgtactcccttgaaaaagtacggtattgtattttcaaaaacctctagcgtagcgttgagttcctctaaaacaccaaaaactacggaaggggcactttctttagcaaactccaagcacgttacaaaatccctgacccaactaggaagaatggatgaagtcaacagacatttgctgtttttaaaccatgtgccaaaatgtggaacggagatattgattttgttgttacagaagttacaagggtataacaattatagacatgtaagattaaaatatggaaacaaaaggctgctgtccaacttacaacaggaacacctggtatatgagatgtatgatataatgaaaaaagaagctgtaccagtaagcctagatagacatgttttcttcattaattttacccaatttggtagacaatttccaacttatatcaatttaatccgacatcccgttgacaaaatcatatctaggtcaacagataaagaagtgagaaaagattatttttataaatgcttggtaagcaagagaaacggctgcaatttcaaaaacggacaaccttatgaactttccattccatatttctgcggccatgataaactttgtatgattctaaacaacgattgggctttacaacgtgccagacaatatgtagcgaaatattatccagtcgctggtgatttagaggaactcaccgctacgctagaggtttttgatcantacataccgtactttttcaagggagaacaaaaattgtaccgaaaagagtttcttcatctccagaataataggaaaaaagcggatgtccccaaatggtaataaacaattaaaaaactctttaatcaatgaaagagagttttatgagtggaataaaaagaatactgtttaaggaagttaaaaattttgtatggaaaacatccaacccttaatacccaaggggttaccttgggaattttt

SEQ ID NO: 12738 - DNA, 104 bp, Diabrotica virgifera
  misc_feature (2)..(43): n is a, c, g, or t
gnnnnnnnnnnnnnnnnnnnnnnnnnnnnnnnnnnnnnnnnnngtagaggtatgttacgaaaggataaacgtaaactatttacaagtggagatgatatgtagta

SEQ ID NO: 12739 - DNA, 92 bp, Diabrotica virgifera
  misc_feature (15)..(90): n is a, c, g, or t
aagacgagaaacccnnnnnnnnnnnnnnnnnnnnnnnnnnnnnnnnnnnnnnnnnnnnnnnnnnnnnnnnnnnnnnnnnnnnnnnnnnnngg

SEQ ID NO: 12740 - DNA, 95 bp, Diabrotica virgifera
  misc_feature (3)..(60): n is a, c, g, or t
  misc_feature (65)..(65): n is a, c, g, or t
  misc_feature (87)..(87): n is a, c, g, or t
ggnnnnnnnnnnnnnnnnnnnnnnnnnnnnnnnnnnnnnnnnnnnnnnnnnnnnnnnnnngcttnaattttttaaagacgagagacnctatagag

SEQ ID NO: 12741 - DNA, 117 bp, Diabrotica virgifera
  misc_feature (2)..(19): n is a, c, g, or t
  misc_feature (32)..(73): n is a, c, g, or t
  misc_feature (86)..(116): n is a, c, g, or t
annnnnnnnnnnnnnnnnnattaataataagnnnnnnnnnnnnnnnnnnnnnnnnnnnnnnnnnnnnnnnnnnctatattgggggnnnnnnnnnnnnnnnnnnnnnnnnnnnnnnnt

SEQ ID NO: 12742 - DNA, 310 bp, Diabrotica virgifera
  misc_feature (7)..(44): n is a, c, g, or t
  misc_feature (110)..(132): n is a, c, g, or t
  misc_feature (164)..(191): n is a, c, g, or t
taacagnnnnnnnnnnnnnnnnnnnnnnnnnnnnnnnnnnnnnntgcgacctcgatgttggattaaagtttataattggtgtagcagttatattattaagtctgttcgannnnnnnnnnnnnnnnnnnnnnnagtttaaaccggtgtgagccaggttgtgttcnnnnnnnnnnnnnnnnnnnnnnnnnnnngtacgaaaggaccaaatatatacaataattttcatatttagatatatattagcacccgcttgactgaagccaagcacggaattccagtaaccacccaaggaccttactactgtgaagat

SEQ ID NO: 12743 - DNA, 173 bp, Diabrotica virgifera
  misc_feature (13)..(167): n is a, c, g, or t
agggttggatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggg

SEQ ID NO: 12744 - DNA, 677 bp, Diabrotica virgifera
  misc_feature (320)..(351): n is a, c, g, or t
  misc_feature (373)..(387): n is a, c, g, or t
  misc_feature (389)..(412): n is a, c, g, or t
  misc_feature (416)..(478): n is a, c, g, or t
  misc_feature (480)..(500): n is a, c, g, or t
atttttaactcatttctgttactaaagcacaatggcgactaccaaaaaccttgtaaaattatttgacaggcccaaagagttgtgtattatgcccaaaggagacgacaaaactatatttgatgtgcctgcggaatatttgcctgaccaatacaaaactgttggcgttcaacttgtgtcaaaatttggagaagaagccgttggaggaaaaattcaagtgaaacccatttcgattccttatctgggtgatggtttggacttaataaaaaactcaaatttttcttgatttcagtcatatcatacattctgaccatatattatcnnnnnnnnnnnnnnnnnnnnnnnnnnnnnnnnattttataaggatatggccttnnnnnnnnnnnnnnngnnnnnnnnnnnnnnnnnnnnnnnnctannnnnnnnnnnnnnnnnnnnnnnnnnnnnnnnnnnnnnnnnnnnnnnnnnnnnnnnnnnnnnncnnnnnnnnnnnnnnnnnnnnnaaatatgtttaatgtgttagaaatagaaattaatgatgatatgataatgaacaagtagttattatagaaaagatatatatagtttgataaatgaattctacaactgttctatcacctgattattacaaacatggctgatagtattaaaatataccttgtccccctgccccatgaata

SEQ ID NO: 12745 - DNA, 241 bp, Diabrotica virgifera
  misc_feature (4)..(233): n is a, c, g, or t
gtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaattttt

SEQ ID NO: 12746 - DNA, 68 bp, Diabrotica virgifera
  misc_feature (8)..(66): n is a, c, g, or t
gaaagggnnnnnnnnnnnnnnnnnnnnnnnnnnnnnnnnnnnnnnnnnnnnnnnnnnnnnnnnnnngc

SEQ ID NO: 12747 - DNA, 103 bp, Diabrotica virgifera
  misc_feature (2)..(24): n is a, c, g, or t
  misc_feature (31)..(64): n is a, c, g, or t
  misc_feature (66)..(98): n is a, c, g, or t
gnnnnnnnnnnnnnnnnnnnnnnngaccccnnnnnnnnnnnnnnnnnnnnnnnnnnnnnnnnnngnnnnnnnnnnnnnnnnnnnnnnnnnnnnnnnnnggggg

SEQ ID NO: 12748 - DNA, 924 bp, Diabrotica virgifera
  misc_feature (13)..(39): n is a, c, g, or t
  misc_feature (874)..(874): n is a, c, g, or t
caaaattaaagtnnnnnnnnnnnnnnnnnnnnnnnnnnncactttgtagaataaaaaataatcattataatataagaaagcgttttaatagtagcaatactattaacagtttattaaaaaatgtaatagtgggagaagtgatgaatataaaaggatggataaaatccttacgaaaacaaaaagaaaattattttctagatattagtgatggatcaaccagtgaaagattccaggtagttgttcccctaagtctcgtttcaaaaaatataactgtagggtcttcaataagcactaatggtgttgtacaaacctctccaaatggccaaacggaattgctagctaatgagataaatatttatggtgattgcatagtaaccaatggatacccgtttgcaccaaggaagaaatattcctctgaatatgtgagacaatatcttcatttcagacccagaaccaataaatttgcttcattgttaaggactaggagtgcagcccaattatattttcatacttttctaactagtagaggatacattaacgtccaaactccaatattaacatccaatgattgcgagggtgctggagaaatatttagagtgatgccagaaagtgaacaactcattaaatccatgttaaaagaaggtggataccaggaggaagcattttttaatacaaaagcctttctcactgtctctggacaattacatttagaagctgcagcacatggtttaacaaaagtgtacaatttaggaccaacttttagagcagaaaactccaaaagtagattgcatttagcagagttttacatgctggaagctgaaattgcttttctagaagaactagaaacactgttatcaataattgaagaattagnttaagaagtaacaaatttagttctagataactgcgaggctgatgtacata

SEQ ID NO: 12749 - DNA, 912 bp, Diabrotica virgifera
  misc_feature (72)..(86): n is a, c, g, or t
  misc_feature (400)..(418): n is a, c, g, or t
  misc_feature (809)..(809): n is a, c, g, or t
  misc_feature (838)..(865): n is a, c, g, or t
aaaatgaacaaatttttagttaacttcggtttgtttgttcttgctgcaagctgtgtagtttgcgcaccaaannnnnnnnnnnnnnntagaggagtggtcgaggaagcagatctgcaaattgctgaactagtcaaaccttacatcggcgaacgtagagtggtatccaaagcactgcaaaagtatcttaaagattccgattatcaagtaataaaagatcttactcgtgaattcgacaaacacaaggacaagtgcgcagatatcgaaaagaaaatgaatgataccatcgacgacctcgccaactgcattgaagatatcaccattggtgatagtaccgtctgcgctaccgcccaacgtgccattgaaaaatgcgccaagccagtcattgaattagttagcggannnnnnnnnnnnnnnnnnnaagaacttcccgccttagctgagggagttgttcttgctatttggaaacaagcttgcgcttctacagtagaacaagtattagaattattcaatccatgccaatggaagagtttctcaagtcttgaaaaaatcgaatcctgcaaagctgtccccactgaagttgaaagctgggatcacagtaaacagcttcctaccactgaaaacatttgcacactcttgcccaaaatcaagaaatgttcctccgacttccacggacagtactgcaagaacccagtcactcttagctctttcgccaaattccacaaagccattgaaaccgagactgaaaaaatttgccacgaccctgtcaaaaacgaagtcgcttaattttatgaaatgttaatttttgttanataaattttatactcatctttttatcacnnnnnnnnnnnnnnnnnnnnnnnnnnnngccagctttaacttgttttttgaataaataaactaagattaattgct

SEQ ID NO: 12750 - DNA, 588 bp, Diabrotica virgifera
tgattctttaatatgatggtatttcctcttaaaagatactaaaatgtcctagtacactaggcagcataagcattgacctgacataaaaggtaacatatatgccctaaagattagattctggtacacctaggatgatcgtgtgcttgaggatactagatagataactaatattcgcaattaaagtacctcaaaaatcttaatttttaatgcagaataattattgtctcataggctcgatcccaaaaaatgggtattcggatataaatatatctaagtcttcacgagaaaaagcttgtctaattattatgcgtaataatcctatgataaagatttgtttactgctacttcgatgatatatatgggatgatctttgaaatacaatgtttattaaaattcaattttgaaataaacaacagcaataacattagcctaagttgaaagaattgtatatttacttatctgacataatcttcgatactttgatagaaatttttacatgatataggaataaagttgactcagagtaacttaatgaggatatgaatgggatcatgatatggtcatatcacatgtgtattaccgtgattt

SEQ ID NO: 12751 - DNA, 776 bp, Diabrotica virgifera
caaaatgaagacctcggttttttatttcatagcacttttttgttgctgttcagctgaattcaacatatttcagctggccaagcatgctatcgacgtcggatcttccattactaaagacgtgctcgataatgttttaactgttaatgatctaccagatagaattactgttccagaaattattaaacgtgaaggatatgaagtggaaagccactttgtcactactccagatggttatatactaaatctccacaggatcccacatggtaaacactcagaaggaaaaaggaaatccacacctgtatatttgcagcacggtcctttatgttcctcagccgactgggttatatttggtccaaagagagctcttgcgtttattcttgctgacgcagggtatgacgtatggatgggcaatgtacgcggtaacacgtactcaagaaatcatacttatttatttcccgaagaagctcaattttggaaatttagttggaacgaaatgggcatgtacgatattccaaccatggtcgactacattttaaaggccacaggaaagccacaattgtatcatattggacattcacaagggacaacatcattttatgttatgacatcagaacgtcctgagtataatcaaaagattaaagcacacatcagtcttgctccagtggcatatatgcacaatctgggccgtccattagtgagagccctaacttttgatcgacttgcctttgtaaataaatgatgattggaaaaagcgagtttatgccatccacctattt

SEQ ID NO: 12752 - DNA, 864 bp, Diabrotica virgifera
  misc_feature (299)..(337): n is a, c, g, or t
  misc_feature (798)..(820): n is a, c, g, or t
gtgatgtgaaaaaagaaaattcgtctcagtatttttgattttgattttcacaacaatcataaatctacactgactattgttaggagcaaaataaagttcactgtaagacacagtgcagtgaactcaaatccaaataataagaagaagaaagtaaaatggaaataaatgatgatgattcatacaaaaatgaattatctaatataaaatgcaaaatcgaaataaaaactgatgatgagaattacgaagatactccagtttggattaaaaatgaatttaaacaagaagtgctttctgaactnnnnnnnnnnnnnnnnnnnnnnnnnnnnnnnnnnnnnnncattgttgattcaaagatttggttcgatcaaatcagcacgacagctttagttgcagatgttaagacagaggaaattcaggaaccaaaagtaatttgcaatgaattagatttgaatgaagaacatcagacaagtcaacatggttttcttcagagtgtggttaaaactgaatcagaaaaatctttaaccacttacatcagagaaaattcgtacaagtgtgaaacatgtttaaaggaatttagtcaagagggaaatttgaaaaaccatttaagaatacatactggagaaaagccattcaagtgtgatatttgttttaagcaatttagtcaagagggaaatttgaaaaaccatttaagaatacatactggaaaaaagccattcaagtgtgatatttgttgtaaacaatttagtcaaaatggacatttaaaaacgcatttaaggatacacactggcgaagaaccgnnnnnnnnnnnnnnnnnnnnnnngcaatttagtcaaaatggacatttaaaaaccgcatttaaggata

SEQ ID NO: 12753 - DNA, 893 bp, Diabrotica virgifera
  misc_feature (751)..(768): n is a, c, g, or t
cccacgcgtccgtgatcaatggtggaccttcgcgctttatgaagttatatttattatcaaatcattgaattatagacccgtactctgtactaacgcttggtattattaataacgaacagtattttaaatatctctataaaaaggactagttatggtcactagacaagaaattaagggtgagtgactagaatgggacatgaaattgaagactctactatgcacagaaagagatctcggacaattgagggatgacgatagttcaatggagactggtaaaagatctgaaaaatatgtaattcatgaatacattctgcggctaacatactaaagggatttcatacctaaagacattatactttccgatgaaatctgaataacatgaaccctatgaaaacattctaaatttcgtgttctgtgcatatacaggggagccgcgcaaatcgtcaactaattatgggggacagcctgtgcggattctgaaaagttcggattatccgaaagatagccctaactagtgaataaaagctttgatgttgagtcgcaaaacgttctcgcaagagtctggacaatatttttgaactcaagttgacttcgagagaaccgaaataagtttatattataatgctaggggagcaaagtatgctaaatatgcaatcactcgagcgttgtggggacctattgagttctgattattaagacctaaaaccaaatatagttaagtaaaattttctgtcttagtggggacttcccnnnnnnnnnnnnnnnnnnccatttccaacaattgttttttccgagtatagcgtaatctattaataattcgaaaaaatgtttcgaataagagttgcttatttttaacggaaagaattcaaaatctgcaatgaaaatttggggct

SEQ ID NO: 12754 - DNA, 643 bp, Diabrotica virgifera
  misc_feature (2)..(17): n is a, c, g, or t
  misc_feature (19)..(61): n is a, c, g, or t
  misc_feature (71)..(111): n is a, c, g, or t
  misc_feature (118)..(177): n is a, c, g, or t
  misc_feature (188)..(465): n is a, c, g, or t
  misc_feature (467)..(550): n is a, c, g, or t
  misc_feature (552)..(566): n is a, c, g, or t
  misc_feature (575)..(642): n is a, c, g, or t
gnnnnnnnnnnnnnnnngnnnnnnnnnnnnnnnnnnnnnnnnnnnnnnnnnnnnnnnnnnnaccttggggnnnnnnnnnnnnnnnnnnnnnnnnnnnnnnnnnnnnnnnnncaatttnnnnnnnnnnnnnnnnnnnnnnnnnnnnnnnnnnnnnnnnnnnnnnnnnnnnnnnnnnnnaatggaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnctttttggnnnnnnnnnnnnnnnnnnnnnnnnnnnnnnnnnnnnnnnnnnnnnnnnnnnnnnnnnnnnnnnnnnnng

SEQ ID NO: 12755 - DNA, 72 bp, Diabrotica virgifera
  misc_feature (3)..(61): n is a, c, g, or t
ggnnnnnnnnnnnnnnnnnnnnnnnnnnnnnnnnnnnnnnnnnnnnnnnnnnnnnnnnnnncccaatttttt

SEQ ID NO: 12756 - DNA, 520 bp, Diabrotica virgifera; identical to SEQ ID NO: 8614
  misc_feature (22)..(321): n is a, c, g, or t
  misc_feature (328)..(365): n is a, c, g, or t
  misc_feature (385)..(398): n is a, c, g, or t
  misc_feature (401)..(423): n is a, c, g, or t
  misc_feature (431)..(453): n is a, c, g, or t
  misc_feature (483)..(514): n is a, c, g, or t

SEQ ID NO: 12757 - DNA, 73 bp, Diabrotica virgifera
  misc_feature (11)..(11): n is a, c, g, or t
  misc_feature (27)..(27): n is a, c, g, or t
  misc_feature (30)..(30): n is a, c, g, or t
  misc_feature (35)..(63): n is a, c, g, or t
  misc_feature (66)..(66): n is a, c, g, or t
  misc_feature (72)..(72): n is a, c, g, or t
aaataaaattntattaaaatttaattnttnaaatnnnnnnnnnnnnnnnnnnnnnnnnnnnnntanatatgnt

SEQ ID NO: 12758 - DNA, 93 bp, Diabrotica virgifera
  misc_feature (5)..(71): n is a, c, g, or t
  misc_feature (74)..(89): n is a, c, g, or t
attgnnnnnnnnnnnnnnnnnnnnnnnnnnnnnnnnnnnnnnnnnnnnnnnnnnnnnnnnnnnnnnnnnnnatnnnnnnnnnnnnnnnnttat

SEQ ID NO: 12759 - DNA, 106 bp, Diabrotica virgifera
ctttaatggtttagaagatacaataattcaaacaaataaactgctaacaacaaattatttgacggcttttcagcctggtaccatcgaaaaatctaatctacgtagc

SEQ ID NO: 12760 - DNA, 81 bp, Diabrotica virgifera
  misc_feature (3)..(3): n is a, c, g, or t
  misc_feature (11)..(71): n is a, c, g, or t
ggnggtgattnnnnnnnnnnnnnnnnnnnnnnnnnnnnnnnnnnnnnnnnnnnnnnnnnnnnnnnnnnnnnatttttttga

SEQ ID NO: 12761 - DNA, 921 bp, Diabrotica virgifera
  misc_feature (57)..(75): n is a, c, g, or t
  misc_feature (668)..(685): n is a, c, g, or t
  misc_feature (732)..(757): n is a, c, g, or t
tttgttgtataattcacttcgcaataattatgtgatatatttgatttaaaatgaatnnnnnnnnnnnnnnnnnnngagcaacaacgtcaacttagatttctgatatagataatattacgtgcaacggtatctatattgtaccgactgtagtttctaaaaatagttaataatagcggaaattttgggtgatgcatatcttttgaaactatgtgtatattcttaccattggccataattcagcgccaggtgtttgatcactctaagataaaattatgctccgtttatcgcatgcacaaaggctgccaaatgggctgaatagttaccaattccgatactggtgccgaacttgatccatgaacatccagggaatatcctcggatagtgacataatatcataatatggagcgttaagcgcctaatttggtaggacaaagtgtagagccatcaataaaccactatcaaatatctactggggatgtgtgaatgttataacgacgccgacaatcccctgcaatttgccgcgtgtcaacattctctctgatgcaagcatgaggaatgttggagagtggaaatttatgtgtgaggccagtaggtctttgggcctattttatactgaatgttttatatactttactattttaattgggaaataagccacaatttaactnnnnnnnnnnnnnnnnnnacgtttcgacttccacttcggacttcggacttcgttgtcaaaatacnnnnnnnnnnnnnnnnnnnnnnnnnnattgttgctttataaaaaattcttctaatagaaaatataaatgtataccatttttattcagttgcaatgcgaagccaaaactgtcttaatcttcacttagttcagagatcgcaaaccagcactctaattcgacgatttcgcctcttactagaggcatcattcag

SEQ ID NO: 12762 - DNA, 259 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(194): n is a, c, g, or t
  misc_feature (201)..(241): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccagggttggttnnnnnnnnnnnnnnnnnnnnnnnnnnnnnnnngaaaggnnnnnnnnnnnnnnnnnnnnnnnnnnnnnnnnnnnnnnnnnacataagaatattaaggg

SEQ ID NO: 12763 - DNA, 904 bp, Diabrotica virgifera
  misc_feature (460)..(490): n is a, c, g, or t
  misc_feature (690)..(709): n is a, c, g, or t
  misc_feature (720)..(743): n is a, c, g, or t
agcacacgaataatcatcttttaattttccctataatcctttcaggatggcaatcagaccagtttaccgtcctcaaatcatcaaaaagaggacaaagaagttcatcaggcatcagtccgatagatatggtaaacttaagagaaactggcgtaaaccaaagggtattgacaacagagtcagaaggcgtttcaagggacaatatttgatgccaaatattggttatggttccaattctaagactaggcatatgctaccaacaggtttcagaaaagttttggtacacaatgtaaaagtaagtattttattttcattattaatcataacctaactaaaataagcatgctgcataattattatattttatggctgcatacataatattatgtctctattaaccctagaacagcagagctctttcttctaatttatactgcacagttgggtctcgaaaacccttaannnnnnnnnnnnnnnnnnnnnnnnnnnnnnnctttttttgcagtagagttgacaaaacaaccaccaacaatgtcttattttgaaaatatgtttataataatgtactctctccaagatgaaccacaaaatttaataaatacaaagattaactacattttgacccaacatgagcaactacaggaataaataaccaacaggaaggagaaagaatgagttacgcttggcccagcnnnnnnnnnnnnnnnnnnnncaacatacacnnnnnnnnnnnnnnnnnnnnnnnntacgagacatttttgtgattctgaaattattgtgattgatggaaaatagttggtactcttgtggagattcatcttaagatatgtatgcagcactataatgtacacaatctcgttgacaaaatagtaaattccaagatccaatagggctactaacatttcgt

SEQ ID NO: 12764 - DNA, 237 bp, Diabrotica virgifera
  misc_feature (3)..(71): n is a, c, g, or t
  misc_feature (73)..(136): n is a, c, g, or t
  misc_feature (163)..(200): n is a, c, g, or t
ctnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnngggggggataaaaagagagatttaacnnnnnnnnnnnnnnnnnnnnnnnnnnnnnnnnnnnnnnccccaacttttttttgtctactaacaacaaaattacc

SEQ ID NO: 12765 - DNA, 825 bp, Diabrotica virgifera
  misc_feature (140)..(164): n is a, c, g, or t
  misc_feature (440)..(459): n is a, c, g, or t
cggacgcgtgggaatctatggtgttatttatttaaaatagtgtacagtttgcttatgtagagtatgtttgtatgttgtaaataaatatgtccatatatggtgattcactttaaatttgaatttataagtatataaaaagnnnnnnnnnnnnnnnnnnnnnnnnngcctgtgtaataattggtaattcataaatgagaaaaataattattctacaaatacatccttgtccaattacaaacttcactttgattgaagtataagtacattttttatctccttatctagaaatacaagatgagtttgcaaaaagttgctgtggtaaccggtgggaataaaggaataggatatgccattgtcaaaggcctctgtgaacgatttgatggactcgtttatctgacagctcgagatgtagaaagaggtcaagccgctgtagctcagcnnnnnnnnnnnnnnnnnnnngcagtgtttcaccaactggatattaataaccaagccagtgtagacgaattaagggattttattaaaaaagaacatggcggattggatctgctaatcaataatgcagcaataggctttggtagagcagctacagaatctccatttgtccaagcatcaaaaactatagaagccaattactttggaaccctaagagtttgtgaagctttgttttctttgttaaggaataacgcaaaagttgtaaatctttccagcgctttaggacatctgtctaaaataccgacagagaatctcacaaatgaattttcgagaaaaggatttaaccatatcagaactcagtaaattacttgaaaagtttgtaaaagctac

SEQ ID NO: 12766 - DNA, 1010 bp, Diabrotica virgifera
  misc_feature (813)..(813): n is a, c, g, or t
  misc_feature (824)..(844): n is a, c, g, or t
ctgtgatatacatttttcggaaaaatatagttttattgaattgcaaaatgaaagcagattctcagaaaacaaaaatagacgaatgtaattataaaatacgtaaagatcttttcacattagtgtagaatgatgataggcgtgccaaattatctccttgttgtgtctatgtttgttgtcctatctttgcctcaaaagcatcttgcaattttgttctgcagcctaaccttatacttgaccgtcgataattttctctcatacatctcattttaatcataaatacacttctccaagaaattaacgcaccaccttaaaaatggatcatttttgatgtctcgaatttcctaaacatgtccgatttaaggggtcatatacgtttctcggcttcaaaaaatcgattttattttttgaagttatacttctttaccggcgatagagggtaaatttttatatgggaaaacctagcgaccgggcgcatgcgcattataactttgttctgattggatgttcaaatgacatgtcaaaaattattcaataatggtggctgtggcacagctgtagttagattatttatggttgttgcgttttaaaatttgtgtgaaaagaaacaacaaacaaaagttagttaatagttatactgcctttttaaatagttttcatatacctatatttttggactattttggacaaggaaaactcattctaatttggtaagtacctagtttttattataatcatattgtaattatacatttggattaggttgaaatacatacatttattttctcaagaatgctgattttagagagaaatccncaattaggttnnnnnnnnnnnnnnnnnnnnngattttttggcgtagattatttatctagtaggtatgtaatgctttgatttacatactttaatttgattaaccaacaaaaagttctacccaatccttcatcaaatatacctgttttccttactggtttgttatatggaatttttaatattttccttccaccaaaatt

SEQ ID NO: 12767 - DNA, 114 bp, Diabrotica virgifera
  misc_feature (2)..(26): n is a, c, g, or t
  misc_feature (34)..(74): n is a, c, g, or t
gnnnnnnnnnnnnnnnnnnnnnnnnnaatttacnnnnnnnnnnnnnnnnnnnnnnnnnnnnnnnnnnnnnnnnncaagaccacaacacccctatacagttttttaaaattatta

SEQ ID NO: 12768 - DNA, 904 bp, Diabrotica virgifera
  misc_feature (705)..(723): n is a, c, g, or t
  misc_feature (877)..(903): n is a, c, g, or t
caatttttgccctttttttaactttgcgggagtcacctgaaaaattttcagcttgcctgaaatacctactcaaaaatgtctcacagctcttggaccatttctttagcattttaagcacccaacaacgtctttttctatttctgcaatatttgtttccattttatgtttcttcgtctaatattagagcaatttttattaacgtttaatttcaacattgttcacgacacaaagcaacccacccgcggcaagcctttcgcagtgtgaattgtccggttccttgcacgtctaatgagaatcaggcttaattaattattataccaatgcgtttttaacaaaaagtaccttagatttttcaaatatattttagctttcgtttcaattaactctcaactgctcaagtcaatattttactttcatatggaacgagctttattagcagccttttgtagatccttctttttaaacatatggatatatttttgcgttacaccactaattcgatgcatctgtactcttgctagcgttttattagatataactgtgatatccaagccaagccaagatgaaaatttataagttttcttaggtagtaggtatgttaaatcagtgattcaaccaagattatttcaaaatacaacttgccacatgttaccatcaattatttgtaccttatgcggggatagtttggtaatatcattaatttgnnnnnnnnnnnnnnnnnnngcattttactgttaagtagaaattgatatcccattagaactatttagggtaattatttattaagaaggtacttctcaaaaatgtctaattttttgggacaaggtaaagagaacctcaaaactccaaatgtgctggaaattagtaaaagtggccnnnnnnnnnnnnnnnnnnnnnnnnnnng

SEQ ID NO: 12769 - DNA, 760 bp, Diabrotica virgifera
  misc_feature (2)..(751): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgagaaac

SEQ ID NO: 12770 - DNA, 899 bp, Diabrotica virgifera
  misc_feature (746)..(766): n is a, c, g, or t
gcaatattattagctatggacgaggacatatccgaaaatatgtcggagccagagattgaagaggacgagtcacgatcaaaaaggtttagattaccgagaaaagcaactatcgaatacacaaaaaaactatgtgccaaagaggagagaattgcaactgtaaaaaaaattacatttatacttcaaaaaattgatagtgatagaagtataacagataaaaaactattgaatcaatataaagatatagtagaagaaattcgtgagagatggaggaaaagggaagaggctaaaaagaggttggaggaattggaagaccctgaagatgttattgataataaatgtcatatacttgcccaagcaatagcccaatcacaatatttggtagcttatactggtgctgggataagcacagctgcagaaatacccgactataggggaacaaatggtatatggactagattgcaacaagggaaagacatagggaattatgatctttccttggcagagccaacgtacactcacatggcattggcagaactgtaccgcaaaaacattctgaaacatgtagtttctcaaaattgtgatggacttcatttgcgatcaggtctacctagaaccgctttatcagaactacatggcaatatgtcagttgaagtttgtaagcaatgtaaaccacccagagagtactggagatactttgatgtcactgaaaatacagctaggttttctcataaaacgttcagaagatnnnnnnnnnnnnnnnnnnnnntgcatgacaccatagtgcatattggagaatggggaacttaacgtgtcctcttaactgctcaaggttttgtaaaaaaggaaaaaacgctacagatggtaaatgtttgggaatctaggttaattgaattataaaa

SEQ ID NO: 12771 - DNA, 736 bp, Diabrotica virgifera
  misc_feature (390)..(403): n is a, c, g, or t
  misc_feature (405)..(442): n is a, c, g, or t
  misc_feature (453)..(467): n is a, c, g, or t
  misc_feature (469)..(483): n is a, c, g, or t
cctacaaaaatacaagttcgatcatgagtcatcctctaatagagttaaacaaggtgaacgagcagtaatattaaaaaatactcttatgattagacagcttaacctaaatacgccagtatgacctcattaccagataggttatcttgccggaattacgaagaataatgacacttaaagataatttgaagctaacacagcctcctgaaggtactggattggaatggttttagctatataacactcccaagtatttaacgaaatacaatttgactcatgaatgaagaaaacatgcatcaagtaattattttgatattagtaatattatatactttcggggaagagattgaaggtaaggatttattaaaatttagttattaaatggaaatgaannnnnnnnnnnnnngnnnnnnnnnnnnnnnnnnnnnnnnnnnnnnnnnnnnnngatttttatgnnnnnnnnnnnnnnngnnnnnnnnnnnnnnngggagatttaattttagaaatgatgatcaatattaaaattagcaagtttgtatatttaatatggatatatgggcatagataatggaattcggaaatttgttttgcatggaatatgaagaatatagattgttgatgtaataccgatactcgccagcactgaaataattagcgagaacgggaatagaaaaagtgaaaacgtaaaatcatccgctgaacttagatagaatggaaggtgggatcgatgaatttcaag

SEQ ID NO: 12772 - DNA, 852 bp, Diabrotica virgifera
  misc_feature (825)..(825): n is a, c, g, or t
acactccagtgcctcggccgagacagaaaagaaataccaaagccatagcgggagtagacggcgatttcgtaagttacccagtgaccagtcgttttttttaaagtgccagtgaaccagtgtccgttgtttgcagaaaaatgacgtcggtcacagtcgttctcgacaaagaaaagaaacaccagtacaaggattacgtgaattttctaggaaactataaaaatggtaaaaaaagcgagagtgataccaattcgtcgctgaattcttctgttagcgacttgaacgaactcaacgaaatgccgacgaaaagcttcaacgagtatctcaaagactacaacacaaagaaattccaaccggttcagccagcgtttatcaagaaagaagaagcgccaaaaaatgtcaagactgaagtgttcatacagatcaacaacacgaaaaatacaaacaacagccagattcaagtcactttgccgaaaccaaaactagacgagactgatggcgaacaaatcaaaatatctgtcggcgaattatcacaaaaattctgcaacactagtgtccataataacaagacacagacgcatatattgaagagaagctccagcattacagaaaagacaaaaatcttcgaagaaaaccacgacgaaaacaaaaaagttataactaaaataaacaaagtcaaccacattcgaaaagtttcctaaaaaggtgcaagcagcaacaaaaaagcccaaccaaactttcatcgaaataaggaaacaagaactacagaacagccccaaaattaaatgacagtgtttctccaccacctgaaaaaatagatgtcgctanattcagcagtcaactttgacataccat

SEQ ID NO: 12773 - DNA, 812 bp, Diabrotica virgifera
  misc_feature (45)..(62): n is a, c, g, or t
  misc_feature (169)..(197): n is a, c, g, or t
  misc_feature (329)..(358): n is a, c, g, or t
  misc_feature (360)..(375): n is a, c, g, or t
  misc_feature (399)..(472): n is a, c, g, or t
  misc_feature (490)..(528): n is a, c, g, or t
  misc_feature (557)..(578): n is a, c, g, or t
  misc_feature (619)..(655): n is a, c, g, or t
  misc_feature (657)..(697): n is a, c, g, or t
  misc_feature (726)..(797): n is a, c, g, or t
acccaaatttcttccttggatagtgagagaagaattaggagaggnnnnnnnnnnnnnnnnnncgcaaaagaaaattctattacctgtagcatgcggaacggggattattaattaagaaactatataattattaatttcgaaaaaaatagagcttgaaaattgtaattgnnnnnnnnnnnnnnnnnnnnnnnnnnnnntattggaaaggaaatggtattcagatagaactaaatctaacgtactcagagataagttaaatataatcattaacgagatacttatagatacatatcttaatattattaatcgtaaatatgtctaggcatgannnnnnnnnnnnnnnnnnnnnnnnnnnnnngnnnnnnnnnnnnnnnncgattaacaattttcacattttgnnnnnnnnnnnnnnnnnnnnnnnnnnnnnnnnnnnnnnnnnnnnnnnnnnnnnnnnnnnnnnnnnnnnnnnnnnataatttaaattgagtgnnnnnnnnnnnnnnnnnnnnnnnnnnnnnnnnnnnnnnncaatagtatataggcttaataacggaaannnnnnnnnnnnnnnnnnnnnnattatgacgaacatgtctatttgtattaaagataaagccgnnnnnnnnnnnnnnnnnnnnnnnnnnnnnnnnnnnnngnnnnnnnnnnnnnnnnnnnnnnnnnnnnnnnnnnnnnnnnngagctgcaatggaggggccggatgaaagnnnnnnnnnnnnnnnnnnnnnnnnnnnnnnnnnnnnnnnnnnnnnnnnnnnnnnnnnnnnnnnnnnnnnnnnagcagacccctatag

SEQ ID NO: 12774 - DNA, 85 bp, Diabrotica virgifera
  misc_feature (2)..(29): n is a, c, g, or t
  misc_feature (39)..(57): n is a, c, g, or t
  misc_feature (69)..(84): n is a, c, g, or t
cnnnnnnnnnnnnnnnnnnnnnnnnnnnncttagtttannnnnnnnnnnnnnnnnnngaagggtgggannnnnnnnnnnnnnnnc

SEQ ID NO: 12775 - DNA, 671 bp, Diabrotica virgifera
  misc_feature (10)..(10): n is a, c, g, or t
  misc_feature (14)..(40): n is a, c, g, or t
  misc_feature (42)..(91): n is a, c, g, or t
  misc_feature (101)..(124): n is a, c, g, or t
  misc_feature (130)..(150): n is a, c, g, or t
ctttaggcgnccgnnnnnnnnnnnnnnnnnnnnnnnnnnncnnnnnnnnnnnnnnnnnnnnnnnnnnnnnnnnnnnnnnnnnnnnnnnnnnatgtaattgnnnnnnnnnnnnnnnnnnnnnnnnctagannnnnnnnnnnnnnnnnnnnnctatatagaaaatctttaaaatttataagataggtaaattgagattatgaccgaaatatgttatcaatacttacatctagcggttagtcataaccgaatagatgtctagtcttcagtatgtactgttgataggtatgtagaaaacagaacgtgccatttatttatgaaatgatttgagaggagttgacttatatcgtatcacaattttgacattcgctaactcgatcgcatggatgggatgattactcaaaaggaagtctagataagacattagcagttttgcataaaggttaaagtttactgtaagactgagagtaacagtacatgaatgaagaactaatactattcttatattaaatcattggggtactccggatcccctcacgagtgacgatcctttatagtttgcgctgcatgtattccaagtgtaatacgagcgggaacctgagcctcccgcttaactgctactctgatcgcacgacacttattatattctcttgtagtgcatattggacctatca

SEQ ID NO: 12776 - DNA, 77 bp, Diabrotica virgifera
  misc_feature (2)..(63): n is a, c, g, or t
gnnnnnnnnnnnnnnnnnnnnnnnnnnnnnnnnnnnnnnnnnnnnnnnnnnnnnnnnnnnnnntccattttttttga

SEQ ID NO: 12777 - DNA, 984 bp, Diabrotica virgifera
  misc_feature (894)..(931): n is a, c, g, or t
attaaaagtgagctaaaaaaatttgacctcggaattccggttttagggttgtaaccggaagtactgttttaaagacgccgaaatagtacaagcgatatattatttgtcgctccttagcaagacgagaacatatgaatcgcttatttatgaaaggatagaagtcactattttaggtaaattgagattatgacaaaaatttgttttcaatacttatatctagcggttagtcataaaagaatataagtctagtcttcagtaggtactgttgataggtaagtagtaaacagaacgttccatttatttatgaaaagatataagtgtcattgacttatatcgtttcataaatttgccaaacgcaaactcaatcgcatggataagctgaatactccaatggaagtttttgaagcaatctgtagttctgcaaagaggcagaaatttactgtacgaatggtaagaacggtacgaatttacagaactaatgacattttgaattttaaaaattggtggtccaaatattacaaaaaacgtgccattttgtagaaacttccgctacatgtattcaacgttcacaaggggagtcattcgccgtttccagctttatggagttccgctacaatcacaatacaaaaaaggacttgttgaagcattgaagtttatcgatggagcactaaccagttcttttgttctaaaaagtcataacaaccaaaatgttcaacttccaaaggaacgagcttatcctatggaaaaaattccaattaacataaaaatcattgatattcaaaagattactaggtgtcttccagaatattattaagaattttatgaggaaataattggttggccaaccactgaagtggaaagtactgaacgtatgagtatcttataaaaaactgnnnnnnnnnnnnnnnnnnnnnnnnnnnnnnnnnnnnnngtgtggttaataactgggtaataaagtttggccaataaaactttttctttttt

SEQ ID NO: 12778 - DNA, 388 bp, Diabrotica virgifera
  misc_feature (356)..(356): n is a, c, g, or t
  misc_feature (358)..(361): n is a, c, g, or t
agttctaaaaacagcacatgttttcaagaagtaaactataataaattatgggcatagaggattctgaagtgaacaaattatacattcgtctaccagttaaaagacgagaattagacgaatttgtcattcgagacttgcatccaaatataatcaaagtctttcttcctagacaaaaatctgcaaattggtgtatagttcactttgagaatagtgaaaaattaaaggaagcattacccattttaaaggagaaaaagatacaggaacaaactcatcaaaatcaaaagttgcaagcagagtaacaaacaaaagaaagaaaaagcacagaaatcactatccttaattctttgagagttgtngnnnnttgaatcaaaagtaaggaactgctcca

SEQ ID NO: 12779 - DNA, 222 bp, Diabrotica virgifera; identical to SEQ ID NO: 7599
  misc_feature (6)..(28): n is a, c, g, or t

SEQ ID NO: 12780 - DNA, 128 bp, Diabrotica virgifera
  misc_feature (2)..(120): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 12781 - DNA, 66 bp, Diabrotica virgifera
actcgttcttttatcaagaccactttaaatatatatatttaaagtggtcttgataaaagaacgagt

SEQ ID NO: 12782 - DNA, 268 bp, Diabrotica virgifera
  misc_feature (4)..(46): n is a, c, g, or t
  misc_feature (52)..(74): n is a, c, g, or t
ttcnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttataatc

SEQ ID NO: 12783 - DNA, 974 bp, Diabrotica virgifera
  misc_feature (213)..(241): n is a, c, g, or t
  misc_feature (254)..(274): n is a, c, g, or t
  misc_feature (681)..(703): n is a, c, g, or t
aaggaatagaagacgaagataaaataataaaggaagtatgccaaaagtggctatgtaataaaatttagaagatggatagaccaagaaacggtgtctacggaacaagacaaactcgtataaaagtgtatgaaacttcagatacacctaggaggaacgatatgcagggaagcatgtatatttataagaacattagaacaaattacaaaaccttcnnnnnnnnnnnnnnnnnnnnnnnnnnnnntatcttctgtgtnnnnnnnnnnnnnnnnnnnnnccccaattgtgtgctattagtgaaagggttacattaaaaaatagaacgttttcgctctaaatagagcatcatcagagagtgttctaagtctaaaataagtataaccataattagtgaagacaagagtaaaaaatttaaaggttgaccaagataaaaaattaggttgtactcacaagctctacatgctaagccaccaaaaataaatgggttaaaacacttaaaatgcagaccaaaagtcttacattggcgtgttatatattaaaccctggcgatgggtgaaatttaaacaagatatacctcaaagcatcatatgactataccacgagcatgtgggtgggttgagttgatttctctgtctttacaaagagaaaggtgaaagccaactgattacaggtgacaggtgtgannnnnnnnnnnnnnnnnnnnnnnacgagacagacggtgttttgacggtgtgttgacggtgaacatgaagttttgtgaactgatatgtagttaggtacactagccaatagttaaaaaaaatttatttgtggtaaaattcgataataacaacaaacatcgtgtgctgggattacaagtgttgactattaagctaacaagaataatatacggagtgaaaataacgttatttaaaaccaatggaaaaatatttttcctcaattttctacaaaccaaaaatcttttttttttcaatttt

SEQ ID NO: 12784 - DNA, 922 bp, Diabrotica virgifera
  misc_feature (771)..(771): n is a, c, g, or t
catcactacgtgtaaggttagaaacagagaaactgtttcaaattaaatgaaatggtttttgtgacggccaatttcaaaaagtggagtgttgtttgtgctttgctctgtattttaaattttgctgatggattaaccgtaggtgtgcttctcggagattatccctcccaggaacagcggctactgaatagcaccatttccagaaaatttaacaaaggggagatatcgttttcggcgaatgtgcagcatgtttccgaaattgatagttttggtgccagcgaaactttgtgcaacgtacttaaagccgatcttggtgtagcagcaatttttggtcctcgatatacaccagcgactgcaattcttgaatccatttgcctggaatttgaaattccgtatatttcaacatcatggcgaccgacgtcgataaagaattcgggattctttttaaacttctttccagagacagactattattctaaagctttggcagagatcattcagagttttggttggaaaattttcgttgttgtatacgaaaacgacgacaccttattaaaatttaaggatgttttgaaattccagaagtataacgagaacgacaaaaggaatagaatatatttcgagaagctaggaacaggtcctatttttacgaatgttttcgaaaaaatacaaaaaacagcatccacgaacattatccttgactgcaagactgaactaattataccagtgttaaaccaagcacaagaagcaaataatgcttaatgtgtataacangctattttttgacaaatttggatgctgacaccctagactatagtgatttaaatacaacagcaaatataactaccattaggctattcaacgacaacgatgaatttttaaaagactctgcacggaaaaaaggcttagcagaattattcactac

SEQ ID NO: 12785 - DNA, 711 bp, Diabrotica virgifera
  misc_feature (2)..(111): n is a, c, g, or t
  misc_feature (121)..(587): n is a, c, g, or t
  misc_feature (589)..(710): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 12786 - DNA, 642 bp, Diabrotica virgifera
gatataaaatatataagatagaagtagtgaatggtgtggttagtattaatgaaaattatataagaagtagtatgaaggagtagaagtgatagaaaaagattggtaggaaaaaggggaagtggaaaagatatgttgtgagttgggtaaagaaaatgagaaaaagagtagaattataggatataaaaataatgaagaaggaaatggagggtaatagatgtgaaaggtgaatgagaatatatggttgtaaaataagtaggagatgtatgtaagatattggtatgtgattgtgaataataaagtggtttagatgatgagaattggattgtattattagtgtaagaatgatgaaagttaaaatttatgtatattatagaaggaaattgtaaatgtgtagaggatgtattagaggtgagaagatgataaggttaaagtgtataaggaaaagataggatggaaataatagtatatgataagaaggttaggagtatgtatggtgagaatggatattatatattgagagtgatggaggtatgaaaatattagtgattataggagataaattgaaatgaagatgggagagggagttagaggttttgtgaaattagatatgaggggttggtaattgatattattaatttttga

SEQ ID NO: 12787 - DNA, 952 bp, Diabrotica virgifera
  misc_feature (831)..(831): n is a, c, g, or t
tccgtttatatacgtctactgattccgaaatgagtgtatgagcccagtatacataaaagaacaaattcacgtttttcccagtcaatattaattgcataaaaatccggatatatccgtcctcacttctactggaaacaagtgtataggatttgacatggttgtgtaaggttcattttttaactgtgtaaattttacgatctcctcacttattactttgtcgacgtatatatccgtttatatacgtctactgattccgaaatgagtgtacgagcccggtatacataaaagaacaaattcacgttttctcccagtcaatattaattgcatagaaatcaggatatatccgtcctcacttctactggagacaagtgtataggatttgacatggttgtgtaaggtcagcatgaagtagtacgttatttttccattcagtgtaagtttaatacaagtgtgataaaggttacaataatctactttaatgttagaactttgtatggatatatcagtcatcaaatttagtggaaacaaaggatctgatatccactgacaaaaagttatgatatcattaaatttaacaattgtacttatgttatcgatgtaaaatattcaaacataaagagtgcattaaacaagttgatgacgtataaatccggaaaactctaatttctctatgaatcagtggagtttcaatcgagatcagtattcgttatgaaattgtaacgttacatactcctaccacccaccagaaaaattttgaacacaagtgagaaatttttctcaaagaaaacaggaacgttacaaaattagtaagatttaactatacaattttanaatatgtatgttacaataatctgctttaatgttagaactttttatggatacatcagtcatcaaatttagtggaaacaaaggatctgatatccgccgacaaaaagtatgatatcattaaaac

SEQ ID NO: 12788 - DNA, 901 bp, Diabrotica virgifera
  misc_feature (52)..(69): n is a, c, g, or t
  misc_feature (72)..(88): n is a, c, g, or t
  misc_feature (98)..(200): n is a, c, g, or t
  misc_feature (749)..(749): n is a, c, g, or t
  misc_feature (878)..(896): n is a, c, g, or t
agtgatgtaagttatccttcctaacaataacatatcctggatcaatacattnnnnnnnnnnnnnnnnnncgnnnnnnnnnnnnnnnnngaaggtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagatcatataaaagacagttttagtagtttaagagattctgtacctgcattgaacggagaaaaggtggctagccgagctcaaatattaaaaaaggctgcagagtatattctttttatgaggaaaaagaatagttcacatcaacaggacattgaagatctaaagaggcaaaacaatttgttagaggctcaaatacgcaccttagaaaaggcgaaaacaacaggggatattaaagatgatgtatttattgaaacagagtcagatacctcagattttgaaggttctattcagcaaaggaggcccaagaagatgaaagttgtatcataccattcaattaataaggaatgacaaatgaaccatcaagagttgcaataatttctggaaatgaagttgtcacaaataagattgtcaaaggaaatatcactctttagaaatgttgagccgaatcaacatattggctgtcatctatttaagtgttatttaattttaataactagattttttatactttacaatgttcgtcagaacctctaacatggttatatacatnataattatatttgttttgggtaaatggtgtctctagttttatcacaaactatcattaagacttagcttatagtgaacattttttaataaaaatgagactggaatttgtcagttgtaaaaatgaatgtgnnnnnnnnnnnnnnnnnnnacaat

SEQ ID NO: 12789 - DNA, 441 bp, Diabrotica virgifera
  misc_feature (94)..(109): n is a, c, g, or t
cccttttaagcccccggtcatgaagagaccagacttgtattctcctttaataatcagctatgatttacaataattccttgaaatgattcgcttnnnnnnnnnnnnnnnnaatatggtaaactcaatcattgtataaatcacgagagaacttgtccacgaaggagtttgtggatcaaggattgtcaattagtcattataaattgattgacttgagagtgtaggatagctaataacgaaaaacttagtattggccaatgtatagctcgtagaaccctcgccggagatgcatggtactcatgatacagccatgttttgatttttactaggattgtccgatctaatgaattcatactagacgacacagaatattactttctatcttactgatatcaactgtttccctagggtgagctcatcagacaaaccatatagaatctcatc

SEQ ID NO: 12790 - DNA, 517 bp, Diabrotica virgifera
  misc_feature (278)..(298): n is a, c, g, or t
cagatattgaaaggatagcgacaactgtagttggatccactgaaaacatgaaagatgctaatgaacaaattagacaagcaattcagagaaatgctggacttagagtgtacattttattctttttactagttatgtcattttcactgttgtttttagattggtataatgattaaatgtatgtgaaattattttagaatggcttgggctatgcacagagtgattttcttgtcaggtttttaaaatggatttgatcctgcaagggtaatgtggatattgcnnnnnnnnnnnnnnnnnnnnncagatttgaagattttagaaaagaaaaccaaactgaacgaaaatatattatggtgtgttaatgcataatgatgctatctctacaggtgactttcttggacggccttagtagtatctctagcctaaagaagaattctgtatattgactagaattctttctagccaagaagatgcctcagtatacgtttctatcggagcaatacgataaatatagtagcct

SEQ ID NO: 12791 - DNA, 135 bp, Diabrotica virgifera
  misc_feature (2)..(113): n is a, c, g, or t
  misc_feature (116)..(134): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnc

SEQ ID NO: 12792 - DNA, 955 bp, Diabrotica virgifera
  misc_feature (44)..(73): n is a, c, g, or t
  misc_feature (645)..(676): n is a, c, g, or t
  misc_feature (693)..(710): n is a, c, g, or t
  misc_feature (718)..(738): n is a, c, g, or t
cgtgtttggcgttttcataatattttataattgttgaaaaaggnnnnnnnnnnnnnnnnnnnnnnnnnnnnnnctataattgtgatggctgcacgcaaaggtggaatttcttgtgtggttcgtggatgccagactagatctggggaacaaataagtcttttttcaataccacgagatcgtagcagagctgaattatggctaaaagctgcaattagggaagatttactttcaaaggatgtcaatgaattgcacaaaaattatagaatgtgtgagaaacactttcaaccacattttatatcgaaggggggaaacgtaagaaaaaatttatttatacaagctcatcctacgatattcccatacaaccaagatgtacaatctgcagatgaacccttaagaaaaatcataagacttgaaacacagattgaagataaaactgaaatagatattatgcagccagttgccaacaaaactgatgccagtcatagtatgcacagtatacctgatactttgatggaagaatctgtggaaacagatgttgatgtcaataccgaagtatctaccagaccccatactccagcacacacagtttcaactcaaactccccccaaattatctagtagctcaccaaggaaagtaaaattacgnnnnnnnnnnnnnnnnnnnnnnnnnnnnnnnnggaaatgcaaatcctcnnnnnnnnnnnnnnnnnntgataacnnnnnnnnnnnnnnnnnnnnncaaatgtgtgacaaactattaaacaagcctttagcacaaatagtaaaagctcaagcattattaaaaagtaaacctccaaaaagtaggaggtattctgatgaatataaacaattttgcattaacactaatattttttgggtcctagagcatatgcttttatgaaaaaaatattgtatttggccttcaaaacgaagtctttcaaaaattactgaaaatt

SEQ ID NO: 12793 - DNA, 757 bp, Diabrotica virgifera
  misc_feature (84)..(101): n is a, c, g, or t
  misc_feature (303)..(318): n is a, c, g, or t
  misc_feature (320)..(342): n is a, c, g, or t
  misc_feature (422)..(497): n is a, c, g, or t
  misc_feature (500)..(512): n is a, c, g, or t
  misc_feature (551)..(574): n is a, c, g, or t
  misc_feature (591)..(632): n is a, c, g, or t
  misc_feature (677)..(699): n is a, c, g, or t
  misc_feature (701)..(734): n is a, c, g, or t
gttattcatccatcatcccatctcatatttctttattgaagtataactattttttttattaagtgatcactaactcctgtgtgnnnnnnnnnnnnnnnnnncactatttcttgtttttccgtcctggtgcatcaaggattattatgtactaaatatagattgattatgtttccacttcaaaaaatgtcgaacatgaaaccgctcttgttatgtattaagccccttgaagtgtactctgctgaaaagtgattccatatatgcttatcttgctgtttatttactaaaatagatcctcctattgcnnnnnnnnnnnnnnnngnnnnnnnnnnnnnnnnnnnnnnngatatttttacggatgaactgaataccccaattttattatcatctaatttgtagataaatattaggattacaagttttcnnnnnnnnnnnnnnnnnnnnnnnnnnnnnnnnnnnnnnnnnnnnnnnnnnnnnnnnnnnnnnnnnnnnnnnnnnnntgnnnnnnnnnnnnnctataagcaatgatgatactattagcatgaaaaacttgnnnnnnnnnnnnnnnnnnnnnnnngtattacaggaattccnnnnnnnnnnnnnnnnnnnnnnnnnnnnnnnnnnnnnnnnnncattaaatatatagatctccctgcccactgaataatttgaatgtnnnnnnnnnnnnnnnnnnnnnnncnnnnnnnnnnnnnnnnnnnnnnnnnnnnnnnnnncagtgaatgcttgaatgatccaa

SEQ ID NO: 12794 - DNA, 714 bp, Diabrotica virgifera
  misc_feature (45)..(63): n is a, c, g, or t
  misc_feature (399)..(413): n is a, c, g, or t
gatggttatggtatggttatttatttatgtatactggtgttgagnnnnnnnnnnnnnnnnnnncgttactcattgtaaatgttaccaatgaaaacaggaaaatttaatctttttttgctaaattcacttctaattgagtattttaatgcttacccttggcactccttagtaaataatagaagataattcagttgattcagccatggaaataaacactgaaactaaaaaggagttaattgagggtgaccaacaatatatgggctatccacttccctagatctggaagttttgaagaataaacaaaagactcaggtgagagaaatagtaaaaatgtataaggatggcttagcgtgaaaacctcgtatctcattaaattacaattttacaggagaggcaaannnnnnnnnnnnnnnataatataacctaaaaacaaaatctacccttacgtatttttaatttgagcacattgagacaaatatctgatattggcccagagctgaaagtgttaaatgttgctattaaatttgaaatacaaatattaactatgaaaaacacgtaaaaatccttgcagtatatattctatattcacaatcaagatgcagtagaagtaaacaaaccgagacacgttaaccattacaaggagcactcctgaatcatgatttacaatgtataacatttgtaaattctaatatgtgatttacaatgtatatacat

SEQ ID NO: 12795 - DNA, 800 bp, Diabrotica virgifera
gtgattacatatcgccgataaacagtgtacaaatcaataaaaaccttaattttgcgcataaaactaaaatatatattacactttgagtaaaaacatcaatcatatctctccaaactatggcgcgttcggattcatttttcagacggacaaaccggccttttggcgacatctttgcattaaagctctgagcatgaactgtttcctggacaaggttcgcacttgtctcaaaaacacctctaaatcgatgactccacatctcaatgcctctcccatgtaataaatagtgtcttctaaggcagcttcttcagcgaatgcattcaataattgtttatataaaggagctgtcgttgttaccgcatcatctacatctatagattcttgattacttattcgttctatggccttagttagttcttgttctttgtcttgtagcattgtaatatttttgtctagatcattcttttctttttctaatcggctcaatataccgtccaacttcaattttccttgcttcaactcctcctgtgtcctcttgagcgtctctagttcagcttgattctgctggaattgttccttcattcttctaagcagcttctcttccaaagctgtcatcagagattccctgatatgttcttcttttatagtacctgttccggcctgaggtccaggggggaaattaaatggatactgcggttgcgaagaagggtagggtggatatccttggaaagaattgttgctggttggaggatatggagggtacccgccgaaacctcctgatggctggtggcgtagggggtagg

SEQ ID NO: 12796 - DNA, 438 bp, Diabrotica virgifera
cccctacagggcccccgcagcttaaaaggcaaacggagaacccccttacgttcgacggaagaatcagatagttagcaggattcaactggtaacttgtaagaagagtgtaaatattgcgatgacgtatataactgctgtagatagcgaaaggcggataattacaccacagagttataggactctaattttcgattttaaattatctatcagcaggatatgcgtattgaaaaacaaatatgataactagctcgtgcgtagagcagggatatccggctctggatataggccaaacttgttgaaagatcaagtggactcagacatcaacatagtaataatgatgagagaatttcataactattaatagataaatatttctctagcaagaagttaccacccgaattgtcttgtagcagctgctttaaataacggatctagctc

SEQ ID NO: 12797 - DNA, 1028 bp, Diabrotica virgifera
  misc_feature (210)..(230): n is a, c, g, or t
  misc_feature (255)..(276): n is a, c, g, or t
  misc_feature (682)..(701): n is a, c, g, or t
  misc_feature (848)..(869): n is a, c, g, or t
catcgatcggccgatcgttgggtaccaacggctcgcctcgtctacctaaattgagattgaggttagtattttctgatctttgcacagtgattgtaattccagaaatggataaactggataaacacaaattaattagttgtgtgtttatgcgcgaaccaatttggaacaaggaaaacaaatttcacacccacagtttggttctatcaaaannnnnnnnnnnnnnnnnnnnngaatgtggaacaacagtgataattnnnnnnnnnnnnnnnnnnnnnnttagggagcagttcctaagaaagattgaagatacaccaataaatcatttcggagatagatttgaagaagaacatctaagctggcaatatttcgaatctctattgtttttaaaggatcagcgcatagtaagaagaggtaaaagaaatttcccaacggaagacgaagcagaagtcgaaaattcaacatggttattggaaggtcgtgatgatgagggtgatcaacgcatagtaaaaagaagtaaggaagatttttctacacaaggagacgaaacctcaacgttgttatcagaaggtcgtgatgatgagggtgaggcgccaaatccggatgaattttttttcgccgaaactacatcagatgttttaagagaagtttcacctgcacacacatcttcatttgcgtcatttcnnnnnnnnnnnnnnnnnnnnacagaaatagacgaagatgaagcattttttaacagcactttaccgcatttaaaaacattgactccaaaacaaagttgaagtttcgtattaacggaatgcaattattagataacgaaatcccgtcaaccacaaaacctaactggcccnnnnnnnnnnnnnnnnnnnnnnggctaatccataccattgaaaatgggggatggctaatcccatgaaaagttcccggaagcgaatattgcaaactccttccccaaacttttgcccccacaccccgctttttccctttttaagaaatgcccaaatttttttaaagggattgccccccttgac

SEQ ID NO: 12798 - DNA, 704 bp, Diabrotica virgifera
ccgaggccccgtaatcggaatgagtacactctaaaccctttaacgaggatcaattggagggcaagtctggtgccagcagtcgcggtaattccagctccaatagcgtatattaaagttgttgcggttaaaaagctcgtagtcgaatctgtgtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgccaaaaacgctttcattgatcaagaacgaaagttagaggttcgaaggcgatcagataccgccctagttctaaccataaacgatgccagctagcgattcgccgacgttcctccgatgactcggcgagcagcttccgggaaaccaaagcttttgggttccgggggaagtatggttgcaaagctgaaacttaaaggaattgacggaa

SEQ ID NO: 12799 - DNA, 732 bp, Diabrotica virgifera
  misc_feature (360)..(378): n is a, c, g, or t
atctaggggcccgaaagtgtgtagagtaataaaagtgtctcctttagatgtaaaaatagagagagttgagaagtattaatttgtgagagtgggagagtagtgtagaaattggatccactgtgataagttgatgaaagatgttgagtgtgtataaattaaacaagaaataaagtagaaaaattatctaaagttatttataaagagaaatgattatgtggtgggaagaagtaatggaaaggggataagagggatatttgctagaaaaggatgtaaaagggtaagaaaaaaaagcagtgaaagaggaagatgatgtcgagataccgttactgtaagaagctagttcgaaatctgaagcccacnnnnnnnnnnnnnnnnnnnattgcactagctcacgtcatgtagaagcaacgacgaactacagatctctttacaaaagagaagggagcaagtattccatactaagatcacccatgccctgtgcaatcgaattcacaagtacaaagtgcccccccagcagacgaccggtgacaaagaatcttcccagaagagcagtacatcattctggcaggaggaatagattcaatgctaaactaaaaaagcccagaaccagcagtacaggaatctccaggaccaccagctacaaccttctacaacaggaagaagatttggtgggtagatcgtttattagttttctcttttatagtccttagatctcccccagtttccctaatg

SEQ ID NO: 12800 - DNA, 1043 bp, Diabrotica virgifera
  misc_feature (2)..(913): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaataagaataaaattacctttagggataaaagggggaattttttttggagaagttcaagatcggaaaaaaaaggatgggggaccccccactggttgggtatttaaaggtttttttaatatggggggggg

SEQ ID NO: 12801 - DNA, 1112 bp, Diabrotica virgifera
  misc_feature (58)..(76): n is a, c, g, or t
  misc_feature (540)..(560): n is a, c, g, or t
  misc_feature (682)..(705): n is a, c, g, or t
  misc_feature (732)..(732): n is a, c, g, or t
  misc_feature (960)..(978): n is a, c, g, or t
  misc_feature (1019)..(1041): n is a, c, g, or t
  misc_feature (1087)..(1104): n is a, c, g, or t
aaatttattaacagaaagacagaatttaataagtttgtttttttgtgaatttcagaannnnnnnnnnnnnnnnnnnaattttgtagatacacacaacacacatacatatatttatattgaactggacttacaaattactaacatactttttaaatatgtctttatatgatgattatgatgtaaaaaccacagcaacagaaaaagtacaaggttggtcatctggcattaaattacttcaatcacaattacaacttaaaaaagctactgtaactcaacctaaaagagatcaacttcgtaagtctgtaagtttagctccagtgatagatttaaaatccaaacgagatgatgatgaacttaaatccctagcaaaacctaagtcagatccttggccgccaattttaagttcagctggcgatgacttaaatatagtaaatgaatataatccatcctggccaaatgagtttgagaaaaaagttaaagaattaagagaacatagtagagaccgtgaaaatagagaacctagggacagagatagaactnnnnnnnnnnnnnnnnnnnnngagaaaaaacgtaaaagtagatttggtgatccagaagaaagtatgtcgccaccatcaatagttaactcgacacctcagatgagtcagccacaaattggtagtggcttttcaggtagatggannnnnnnnnnnnnnnnnnnnnnnnctccaaaacagcctcgtcctttctggnaggtgctgccatagcacctccaccaagtcttcaagaaccatcagatccagttcctattattcctactaaacctcaaccagcttctagttatggtggttcagttgctgcaaaaattatggcaagatacggatttaaagaaggaacaaggtctgcgtaaaaagaaacaaaggaatggccaggggcttaaaaggaaaaaaaacttcccagaaaaggagggaagattaaacnnnnnnnnnnnnnnnnnnnccccctcctaaaaaaaatcaagtaaacccaccctcctaatnnnnnnnnnnnnnnnnnnnnnnncctaaagaaagggtggggctcctaaaaaataaatgggccggccccnnnnnnnnnnnnnnnnnnccaacccc

SEQ ID NO: 12802 - DNA, 502 bp, Diabrotica virgifera
  misc_feature (6)..(145): n is a, c, g, or t
  misc_feature (182)..(208): n is a, c, g, or t
cctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaatcctataatattattagatacagatatagcacnnnnnnnnnnnnnnnnnnnnnnnnnnnctataagaattggggggatagtaaattgacttgtagcctaaataggatccacctcccaacatatcttagatttataagaaaaaatattctatttatgataagaacaatacatatctatatggatatgtttagactaccaataatacttatttctagttatccgcccacaaacaaaattcccctaagatcacctgttgacatgaaacttactgataaacattctcccattgcaatccgtcaaaatccttgtttctacacagcatcttttatgattcgctacaggctttcgataac

SEQ ID NO: 12803 - DNA, 524 bp, Diabrotica virgifera
  misc_feature (26)..(26): n is a, c, g, or t
cccttaggggcccccccacacccccnaaaacggagaccccccttttcagccagagagaacagagagggaagataagagaacccaaaaagtgccgggaaaaaaaaacacgaggaaagcccggaaccagttggggttttggaccaaagctatcatgagatcattaattccacaatgcacgcattataaattttcaaagatttattgctatatttattggagtgaatacgacattgactcgaaaccttaacatgatttttgtccggacatagtattatctttgcaaaaaatattatacatcgttaggaagtacattacatatattcatgaactgtttagataacataaaatactctttataaaattcctcttcacccattatttaagtcccgagcgttatcctgtggacttcttaatctaattacaattattacccacatccaatggtcaaaatccttcctattacagaaatacgttattacctattttgatattccattataacaacagttcatatatgcctgaat

SEQ ID NO: 12804 - DNA, 479 bp, Diabrotica virgifera
ctcctttagcgcgcccggacttatttaatattagtaagtactccctttaaacaatttaatatttcttaaattaatttcattttttgctataagacatgtttacatatatataatcatgtctgcaaatgatagtaccgtgcttgccgaggtacacgtaataaagaggaaagtgataagtattaacaaacaggaaagaactacaaaggcataaaaaaaagagaatgataaggattgaaagtaatgaacatggaacgaaatgatattcatagtcatatctatcgatttgttaaagggaaagagataagttcgcaagaaacgaaaatatgtgtcggacttgtacgtttatatatattagtgaaatatatgttcacgtatgagctcaaaacgatataatatatgacgaccacaccaccaaaaaggaataaagatcaggaatctccttctcttcgcatatgaaagaaaaatttttcgtatatcat

SEQ ID NO: 12805 - DNA, 93 bp, Diabrotica virgifera
  misc_feature (20)..(70): n is a, c, g, or t
agggataatgagttgggggnnnnnnnnnnnnnnnnnnnnnnnnnnnnnnnnnnnnnnnnnnnnnnnnnnngcggtggcggggggtctatatat

SEQ ID NO: 12806 - DNA, 662 bp, Diabrotica virgifera
  misc_feature (159)..(180): n is a, c, g, or t
  misc_feature (292)..(311): n is a, c, g, or t
  misc_feature (349)..(370): n is a, c, g, or t
  misc_feature (387)..(418): n is a, c, g, or t
  misc_feature (431)..(448): n is a, c, g, or t
  misc_feature (459)..(478): n is a, c, g, or t
  misc_feature (480)..(492): n is a, c, g, or t
ctttacgcgtccgtgcttattggcagcttcggacatcacccttactaatgaaatatcagtcttttgatcagtaattaattctgggggagaacgtcagatattgttatctgattctctaaatattgtaccttgggaaacaggggatattaatgaataagnnnnnnnnnnnnnnnnnnnnnnttaaaagagctagaaaattaaaacctttattgtaggatatttattttaactaatgtttttgcaatgaaatgttattcggatgtagatatattaaataggataagaaatagannnnnnnnnnnnnnnnnnnngatatattgtatcaattatgtatattgttatatatagnnnnnnnnnnnnnnnnnnnnnngtatgagctttagagannnnnnnnnnnnnnnnnnnnnnnnnnnnnnnnggaataaggatgnnnnnnnnnnnnnnnnnngaatatgctgnnnnnnnnnnnnnnnnnnnngnnnnnnnnnnnnngtatacaaatgatgaggaagaataattttgccgtactctagtctataaatggtgatgaaaaagagcatcaccttgttgtatgttgaatataaatatatatagatgaatacaggaattccccagacatatttattaacatgtttatgaccgacatgccttgttgaattaaa

SEQ ID NO: 12807 - DNA, 244 bp, Diabrotica virgifera
  misc_feature (2)..(211): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgatgtgatgttatacgttttaaaataagtct

SEQ ID NO: 12808 - DNA, 299 bp, Diabrotica virgifera
  misc_feature (5)..(100): n is a, c, g, or t
  misc_feature (107)..(144): n is a, c, g, or t
  misc_feature (164)..(177): n is a, c, g, or t
  misc_feature (180)..(202): n is a, c, g, or t
  misc_feature (210)..(232): n is a, c, g, or t
  misc_feature (262)..(293): n is a, c, g, or t
ccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12809 - DNA, 68 bp, Diabrotica virgifera
  misc_feature (2)..(67): n is a, c, g, or t
gnnnnnnnnnnnnnnnnnnnnnnnnnnnnnnnnnnnnnnnnnnnnnnnnnnnnnnnnnnnnnnnnnng

SEQ ID NO: 12810 - DNA, 715 bp, Diabrotica virgifera
  misc_feature (379)..(402): n is a, c, g, or t
  misc_feature (680)..(704): n is a, c, g, or t
ttcggtttttcaattgcaaataaacaaaacgtactcaggttttatagattttaatcaaaatgggagatattacaaatcctccaatatctaatgaagatattttaaaattatgtaaaccagccactgaagaaactaaggattttattatgcaacaaacaatgtacagaattaagaatccaaaaatatcaatacccttttatacggaagtgttaggtatgcaactgttaactaagttggattttccaagtatgaaattttcactttactttatgggatatgaagatccaaaagacttggcaggagggctaagttcccaggagagagttacatggacatttggcagaaaagcgacaatagagcttacacacaattggggaannnnnnnnnnnnnnnnnnnnnnnnctcataatggtaatcaggatcctagaggttttggacatattggtgtcatggttccagatgtatataaagcttgtgaaagattcgaaaaacttaatgttaattttgtaaaaagaccagatgatggaaaaatgaaaggattagcttttattacagatcctgatggctactggattgaaatctttaataacaaaagtgtaggggatacagtctcctcttaaatttgcagtaattatttcctgaagacatatattatttgttttaagtgtactatttaatgnnnnnnnnnnnnnnnnnnnnnnnnncgaatccccct

SEQ ID NO: 12811 - DNA, 851 bp, Diabrotica virgifera
  misc_feature (557)..(579): n is a, c, g, or t
  misc_feature (612)..(627): n is a, c, g, or t
  misc_feature (814)..(814): n is a, c, g, or t
  misc_feature (819)..(819): n is a, c, g, or t
  misc_feature (826)..(827): n is a, c, g, or t
  misc_feature (836)..(836): n is a, c, g, or t
ggtgtaactacatagtgatactattcaaaaaattatgttgcctcgcagatttaaaatgcctttatctctaaaacggttgagtttaccgagatgaatgtagtataccttttttaagtgggaatattgggagaatggaagttttgattcaaaaagtatgtagagtgggtaataaacaaaattgaacctattaaatgagcgctggggggcgtatgtggcgccctctcggtgatgcatcgtttttggtggcgaatttagatttctcgtcccaaaaaaacccccgcttaccggatgtcgtgttattatctcatgcctgttaggaaatgttcgggaatagatggaatggaatcttaactttgacaccctgtgtttcggttattatcggctttcgtactaaggtgggttagcttagatcgatctatgttgacctcagaaatatatgaggttgagctatggcccgttctttaccaaacaccctgtatacagctgccattcttttcttatttcgttctcatttacttacaataattttgttgttattctcaacgagtacagagttnnnnnnnnnnnnnnnnnnnnnnngaaacgatttccgcagtggaagtcgaaacgtcnnnnnnnnnnnnnnnntgaaaatgtgattaccgttacaacgaactgtggctaatccaatacaaacataatctgtaacttgcatgccacaagaaagcagtttcatttcagaacatttttgaaattggttccacatatataaagaattctcaagttttcatggtaagttttaactaggcacagtttttatttaattcccgcttanatatntgattannaagtaatanagggaatctgcgagt

SEQ ID NO: 12812 - DNA, 86 bp, Diabrotica virgifera
tggtagcagtttatcaaagtggtgattgtggaaagacagggaggaagcaagaatagatgtcttgcagaaagacggcattactactt

SEQ ID NO: 12813 - DNA, 843 bp, Diabrotica virgifera
  misc_feature (58)..(75): n is a, c, g, or t
tgtatgtacatagggatagggattaaagtgtattctgcttttttgaactcaaaaaatnnnnnnnnnnnnnnnnnngtatgcttgaactgtggaatgaatgataaagatcttaattagaccgaattaaaatttcaagtgtaagcaatacaattagttagttttatacatatatgtaactaagctcaacattaaaaaaaatgacttccaaaatatttaaatctgtgatattaggtgccccaggttctggaaaaggtacaatttccagtcgaattttaaatgcatttaatttaggatacttgtccagtggggatcaactgagacaacatattcagaagaaatctgctattggtttagaagctgaaaaatgcattaacaatggaaaacttgttggtgatgacattatgattaaatttatattgtctgaacttcatggtttgtcaagtaatacctggctacttgatggttttccaaggacattatctcaagccaaagcattctgggaagtcgaaaagttagacctagctataaatttagttgtaccacctgaagtgatagtcagcagggtgacaggaagatgggtacatttaccaagtggtcgagtttataatgatacatttaataaacctaaagttcctggtaaagatgatatcactggcgaacctttaacaaaaaggggcgacgacacaccggaaatagttaagaagagattagaattatacgatgcattaactagacctgtaatagattctatacagagaagggaattttaagagacttcgctggacaccttctgatgaatgtctccaaagtgatagtacttacgcgagttttagaacagcacaa

SEQ ID NO: 12814 - DNA, 163 bp, Diabrotica virgifera
  misc_feature (13)..(155): n is a, c, g, or t
aacccctatagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttt

SEQ ID NO: 12815 - DNA, 547 bp, Diabrotica virgifera
  misc_feature (13)..(30): n is a, c, g, or t
  misc_feature (62)..(88): n is a, c, g, or t
  misc_feature (93)..(141): n is a, c, g, or t
  misc_feature (169)..(191): n is a, c, g, or t
  misc_feature (208)..(227): n is a, c, g, or t
tcactaggggtcnnnnnnnnnnnnnnnnnngaagggtaaatcctttttgaggaaaagtgagnnnnnnnnnnnnnnnnnnnnnnnnnnngaggnnnnnnnnnnnnnnnnnnnnnnnnnnnnnnnnnnnnnnnnnnnnnnnnntattgaggataaggaattattaattagnnnnnnnnnnnnnnnnnnnnnnnaattgagaagagataannnnnnnnnnnnnnnnnnnntataaaagagattttaaataagtttttagatgtgaaatgatattagattgtagatgaatcttatgtatttgtgtagatgggtagatttagaataatagtgagatatatatatttatatagttataggagaataatgtgaagaagagtgaggggagggattgagttataaataaaaattaatgttaatttagtgaagagataataagtaggattaaaatattaatgttatagtaggtgtgattatattatataggatattattagtatgatttttgaggaatgtttaattaagagaagagtattgtattttatgatgataa

SEQ ID NO: 12816 - DNA, 318 bp, Diabrotica virgifera
  misc_feature (44)..(44): n is a, c, g, or t
  misc_feature (70)..(95): n is a, c, g, or t
  misc_feature (148)..(165): n is a, c, g, or t
tctcaccggcccggattataggtaaaaatgatccttaagtgtgngaaaaaaagaatggggtgataagggnnnnnnnnnnnnnnnnnnnnnnnnnnagtgataaagtgggttggtaagtttatttggagagggtaaggaaaaatgatgnnnnnnnnnnnnnnnnnnttgatattgaagtgaaaaaagatagatatattaatgttaattagtaagagagattagatgaaatgatatgaggaatgaaggagagtgattgggtaatagagagttaaaaatgtgtaagatagaatggagtgggtatagaaatatgattgtagg

SEQ ID NO: 12817 - DNA, 921 bp, Diabrotica virgifera
  misc_feature (19)..(37): n is a, c, g, or t
  misc_feature (39)..(55): n is a, c, g, or t
  misc_feature (60)..(81): n is a, c, g, or t
  misc_feature (833)..(833): n is a, c, g, or t
cacttgggttaattttggnnnnnnnnnnnnnnnnnnngnnnnnnnnnnnnnnnnnttgannnnnnnnnnnnnnnnnnnnnntagcctttcgtcgatgccggcgctgcccgctttcaacttttcaagaagtttattttattctccaaacctaccgaaaagtgttccctagtttataatatgtatttttgctttcatctctaaaatgaatgtgaaggaattcgtaaaaaaccgtatagaatttccacgaaaagaaggtcctattcgttgtatatttttttgtgaatttcatcccaccgctggtcctataatatcatgccaagttcctgaaaactatatatctaaagaactatttgatagtattagtgtttacattataacaaaagcggaattgcaaagaagtgtcataacagtaacacttcaagactacaaaatccttggatttcccgttagaattgatgataaagacaaatacgttagaaatgcttttcatttcaatttatgttttgtctgtgacagtgatgctaggacagtacagtatgaatcagttgttcagaaattttcagattatttagtggccagggaaatggaaagtaattttttgtcacaaggaaaagttattataaagctgactccaatactgacccacgttaaggaggaactaaacaccaaagggagagtgtgctttgactgaaggagccacaacgacccatctaaaagtatgtagaataaggcttgatccatctccagtaatggatcaccaagttccaatattcataagagaacttccagagcaacaatgggatctgactactcagcaagtacccattatattngatggatttaatcacgtagcaaaatagctacactttcagatgtggagaatatctagtcaaagcttgtgttcagaatttggttattatg

SEQ ID NO: 12818 - DNA, 679 bp, Diabrotica virgifera
ttcgcgtccggtaatccgcttgtgtcgatacttgtgagatatgtgttctttgtctttgcatccatgcatccataaataatcgctcttaccgaatttagcctgttttaactactaaatttcaagtgaattctgactaaatcttcttaaaaatggacgatgaccaaaataaactattgaaattaacattagttatcctatctattggtgatgcatctccaaaccatgtagacaatttggacaccaatgacctgaaagagctaagaatatatatattaaaagaactgaaaaacctaaaaaaacagaaaacgacatgaataagactggaccctgtgaaatacaaagaattgatatacgaaacaatgattaatctacctcatcaagaattctgagagtgctatcatacatttctataaagattcaaccctctcatgcaaaattgtacacaatcatctaaagattcttgcatcctatcacatcgaacaccaactttactatattacatgctcgactattgcaccgtaaattataatgagaaattgttagtaataacgactaccctctataggtcttatccacaatgtcgtgatgtaatgcactactgcactgaacagatatctgtatgacccagtcatatctgcacctatcatacaagcgtgatattacctattacacttgataa

SEQ ID NO: 12819 - DNA, 271 bp, Diabrotica virgifera
  misc_feature (50)..(124): n is a, c, g, or t
  misc_feature (207)..(253): n is a, c, g, or t
  misc_feature (255)..(270): n is a, c, g, or t
gattattttcttgattagtattttctactcctatttttatttgtcttccnnnnnnnnnnnnnnnnnnnnnnnnnnnnnnnnnnnnnnnnnnnnnnnnnnnnnnnnnnnnnnnnnnnnnnnnnnnggatgatttgaatattatggaagttcaggtgtaataaaacaattaaataatagaatatttttacagttattttctcttaatcnnnnnnnnnnnnnnnnnnnnnnnnnnnnnnnnnnnnnnnnnnnnnnncnnnnnnnnnnnnnnnng

SEQ ID NO: 12820 - DNA, 935 bp, Diabrotica virgifera
  misc_feature (8)..(866): n is a, c, g, or t
  misc_feature (868)..(933): n is a, c, g, or t
cacttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnngg

SEQ ID NO: 12821 - DNA, 914 bp, Diabrotica virgifera
  misc_feature (14)..(810): n is a, c, g, or t
  misc_feature (853)..(909): n is a, c, g, or t
cctttcgacgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaaaaagcttacattttttacagacgagagatcctatagagnnnnnnnnnnnnnnnnnnnnnnnnnnnnnnnnnnnnnnnnnnnnnnnnnnnnnnnnngcggt

SEQ ID NO: 12822 - DNA, 124 bp, Diabrotica virgifera
  misc_feature (2)..(17): n is a, c, g, or t
  misc_feature (26)..(26): n is a, c, g, or t
  misc_feature (40)..(65): n is a, c, g, or t
  misc_feature (67)..(67): n is a, c, g, or t
cnnnnnnnnnnnnnnnngcttaattnttttacagacgagnnnnnnnnnnnnnnnnnnnnnnnnnncnaatagttttttagtattcaatttattatatcactaattattttactcggcggtgatc

SEQ ID NO: 12823 - DNA, 456 bp, Diabrotica virgifera
tccacccagcgtccgggttgatataattactaacaaactagaccatactgttttggtttatgatcacatctgtagagacgtacagactaaaaatattgttactaaagagcgtgtttcaaaaacataccgcatggactataacaaacgtagaccgttacctgaatataataacataatagaaacggtaccctgggggttctaataatattctgcttttatcacctagcctatttatttatcgttttttttgttcttgtagataatgaccggaaggcctgctcgtgtgtgtggggattgttgttgtacaaaccagtcgtctgtgtctggagacgagtgttgggatgacaagtggaatgaatcacccctgccacacatcgaacgacgatacatgtatctacacctgacgaggtgtgacgatgatctcgaataggctcatcagagaataaaagaggggat

SEQ ID NO: 12824 - DNA, 549 bp, Diabrotica virgifera
ccgcacataaaaattttcataaaatccatatctaatcaaatcagtatatttaaccaaatggctaatattgattattggactactcattaaagaatatgatcttgaccaagggtaacagaaaccccaaaaattgaaaccatgatctgaatggatttgactaacataacaacatgattactttttaaataggcaatgaaataagtaatcacattctagtgacagggtcggaaaagacaaaaataagttttacagctttcatgccatgcactttattcaaattttgtgattgtgaaatagacgtacatacagcaactatgtagcagcccttaactatcttagcttttacgctatgtcagtgttgtgaagagacttgtttattctttaggtcgaaagtcattccgatcacctaataaattactgcttctctttagtataacatgtgtagctttacacttttggacatacggttttcgctgtaatgtttatgctaccgaagtggactcaccatctgtggaacaaaatattgtcgccaagtactcgatatatgac

SEQ ID NO: 12825 - DNA, 633 bp, Diabrotica virgifera
atttaatgatcaggtattcactattgtgagagaatatctaatgttcataaaagtcgaatttatgttttgagccttgtgtatcgcggatgataagtcaagaattatgtctttattgtgtgctaattgaaaacagctacgaaaccagaatatcgattgaaaaacaaatattctaattaatttgattgtgaagaaatgacatacctttctctggatctctaatgtttgaaaaactaattgtatttcactgttcctacaatatatatatccttagatattttcatattataaatctcacagatttctagggaagagcttaatcataggactcttttccagactgatttgtaaaccaaaatccggattaagagaattccgtattcgaaaatatgatattatccatgcttatacattatgattatgaatgtgatatataatctttgatagaatatcgattaacattaatttaatgtcagggatgaggagaatatgcttcttcaatagatgtctatgaacggaacaagatacaggtgtactggaggaattcggcaacagttatttcacctgaggactaaaaacatgtcctcgctgtattcaacctaaagtctcgcctggccactgagtaattcgtatggc

SEQ ID NO: 12826 - DNA, 583 bp, Diabrotica virgifera
  misc_feature (2)..(54): n is a, c, g, or t
  misc_feature (79)..(120): n is a, c, g, or t
  misc_feature (143)..(156): n is a, c, g, or t
  misc_feature (159)..(173): n is a, c, g, or t
  misc_feature (268)..(293): n is a, c, g, or t
  misc_feature (391)..(413): n is a, c, g, or t
  misc_feature (537)..(549): n is a, c, g, or t
  misc_feature (551)..(580): n is a, c, g, or t
gnnnnnnnnnnnnnnnnnnnnnnnnnnnnnnnnnnnnnnnnnnnnnnnnnnnnngaaattaaatatattataaggatgnnnnnnnnnnnnnnnnnnnnnnnnnnnnnnnnnnnnnnnnnnctaaatatagtaatgaagatacnnnnnnnnnnnnnngcnnnnnnnnnnnnnnncaatatataagtataataaaggaattagggaaaatgtttttcacctgcttattaacaacatgtcgctgtgcattaaatatgaaggctcgcctgannnnnnnnnnnnnnnnnnnnnnnnnngattttgacagcgctaaagaagcataatccttatattttttattgataactggaatgaaaggctggatgaaacaatcaactagaaccttatttcattnnnnnnnnnnnnnnnnnnnnnnncacaaaagattaaattttttcaaaagtcgaaaagaccctatagagttctctaaaactattaaatatgctatcttaagtatttaacttattttctatacaaaaattttgatttaatttggggggnnnnnnnnnnnnnannnnnnnnnnnnnnnnnnnnnnnnnnnnnnttt

SEQ ID NO: 12827 - DNA, 182 bp, Diabrotica virgifera
  misc_feature (2)..(26): n is a, c, g, or t
  misc_feature (31)..(75): n is a, c, g, or t
  misc_feature (81)..(105): n is a, c, g, or t
  misc_feature (109)..(154): n is a, c, g, or t
gnnnnnnnnnnnnnnnnnnnnnnnnncgagnnnnnnnnnnnnnnnnnnnnnnnnnnnnnnnnnnnnnnnnnnnnnaattcnnnnnnnnnnnnnnnnnnnnnnnnnggcnnnnnnnnnnnnnnnnnnnnnnnnnnnnnnnnnnnnnnnnnnnnnncaataaatttttcgatccaaattttttt

SEQ ID NO: 12828 - DNA, 914 bp, Diabrotica virgifera
  misc_feature (177)..(203): n is a, c, g, or t
  misc_feature (687)..(706): n is a, c, g, or t
ccacgcgtccggataatgtgtatttgtctattttgaactatacgatagtaaaaatgactcatggcacacggcggcagagcgacgttcaatatctcggattatcggaaacaacaggcacctgtattcctttatttatttcaaactgtcttagcattgttcaaaaaagactaaaagacnnnnnnnnnnnnnnnnnnnnnnnnnnnggtcttagtctccactgttcttaaataacttatcattgtttcgattgttaccgtattgtgtgtagtacagtcctatttttcgcttccgttctgtaatcgtgcttctgatagttttgtgtttgcgtgttttttgtctatgcatgagtgtttttaccaagaaatgaataatactctctacaactttacgtaatttagatgtgtactctcgatatatatttcatgttatttcaattataacggtgtttatctgtaagtatacgtattttccataacccggatcggccgcggtcccgattaatccgagttatcgaggttccactgtacatttaaatctaaatcatttaagccgacaaaataatatgcgacgtgaccaaagatacaaaatcaaatatttgtttatagtcgagcataactttacaaaaggtcaacaagcattggtttatctgttatgttgtctagaagcgaccataatacaaaacagtgnnnnnnnnnnnnnnnnnnnngcttagaaaggaaacaatatattgaccattgcaggtcgtgaattaattaaccatcaggtatacaagaactgagaggatgaatatacagttacgatcattgaatagtttacaggcttacgtatctaggagccgatttttttaattacacctcgtttaacatacttttacgtcaaagtgacgttaccagtggtgtacctagaataggttg

SEQ ID NO: 12829 - DNA, 831 bp, Diabrotica virgifera
  misc_feature (8)..(28): n is a, c, g, or t
  misc_feature (649)..(675): n is a, c, g, or t
acgaagtnnnnnnnnnnnnnnnnnnnnncctaaaacattagcagtttcagaaaccgctaaattgacattatttatccgatcaaatacccctagttgatggtatagaatatagaaaataacttatatttcaataataactttgaaatttcatgtttcagggtctctattagtcccaatcactgcagcagtggaactgtttttattttcacggtgcaatgctcatgcaaattttcaaaacaattggtacagttctttttattttagaaagtaaaaaaagtatgtgaatttcgtacttttacacgcgaacaattccaaattcagctgtattccaacatatgactgattctgaccatcctaatagtcgtaaggacttctcaatcattggtcatgcaagttctccaaaggaactcagcatcaaggaggcattatccatatttcttttgaagccacccttaaacacgcaacaagacatggcgtgtttgaaattattgacttaacccaatgattgtcaatgtcatttttacgttttcattaattattgtttgttcctttaaaattattttaaagcatccgctcaagaaacttattattctgacgatgattaaagtaataattgaaacgtcaccatgaattttaatttagttatggnnnnnnnnnnnnnnnnnnnnnnnnnnncaagctgaatggtgtgtccttatctacatataataatacattaccaaaatattttaaaatcagtcttctttaacaactgactttaatagaaagccgtcttatgtggtctacgaatatttaacattcctcatataaatttcgtattatataacattc

SEQ ID NO: 12830 - DNA, 864 bp, Diabrotica virgifera
  misc_feature (8)..(570): n is a, c, g, or t
  misc_feature (572)..(848): n is a, c, g, or t
tttctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatagagtttataaaa

SEQ ID NO: 12831 - DNA, 411 bp, Diabrotica virgifera
ccccccccccagtcaaatcatatgcatctttctttccctcataccatgaggaagaacacttggacataaagtcaaagtgaaaaaagatttattcggtgagataaggttaattaaatctaaccagcacttaattggaaaactgaagatcgcctataattgatctcgtgcatccctggctgtaaacgcagcaggacaaggacggatatgattagatcgaaaagatgcgcggagaagagtcaatacttcgtcgctgatacggagtctctgaggatgtttaagaaaaagaggctgatggtgaacatcatgtacagtgtagggggctgccgaataagatgtggatgagaagtaataagtcgggcacggcaagcgcagagaactttacttgatggactaactccgtgaagagactcg

SEQ ID NO: 12832 - DNA, 1039 bp, Diabrotica virgifera
  misc_feature (666)..(687): n is a, c, g, or t
  misc_feature (799)..(818): n is a, c, g, or t
  misc_feature (841)..(872): n is a, c, g, or t
cgttaatagtaccgcacaatgaacaacattaattattcaatagtacttttatctacattagtaatattcgcacgttgtgaccaatcagctgtggacgttatccaggatatctacagttcttgccttaaggattttagtgtttcatgtgtgcaacctaaatctcttcaatggttagacaatgtttctggtagcagctttattaagatcactgatgatttggcgattcagaggaagtacgatgctgaaactgagacaacgaaaggtctacaaaaagatgttttagatcagtttgaagacttcttgcaatctcacaatatcgttgctagggcgcctgcaattctaaagcccaatggtccattaggacaatatattccaagaagttttcagccagcagatttaactgtacctcttgcagcaacagggcgttcatcaaaattggtcaaaaggataatcttcccattcctactaggacttaaatttaaaaccgcagttttggttccatttgctctagctcttattgcattaaaaacctggaaagcactgacattaggattactgtcattggtactatcgggagctattgccatattctcaaaacttatgggaccaaagacacaagcctacgaagtagtacatgttccgcaacacctagatcaccatgttggnnnnnnnnnnnnnnnnnnnnnncttcctgcaccagccgtgccagttgctcaaccagtctacctggctagaagtttaaatgctcaagaattagcatacagtgcacaccgacaataatcttcccaaccatttgtcnnnnnnnnnnnnnnnnnnnntatttattgcacagaaaaaaacnnnnnnnnnnnnnnnnnnnnnnnnnnnnnnnngcttctaaaggaatccaagttttaagaacccgtgattgggaaatcatatctcctttattgggccccctaaattcatttccttggcccggcgtttttcaacctcgtgaaggggaaaaaacctggggggttaccccaaatttaattccccttggaaaaactcccccccc

SEQ ID NO: 12833 - DNA, 271 bp, Diabrotica virgifera
  misc_feature (6)..(72): n is a, c, g, or t
  misc_feature (79)..(116): n is a, c, g, or t
  misc_feature (136)..(149): n is a, c, g, or t
  misc_feature (152)..(174): n is a, c, g, or t
  misc_feature (182)..(204): n is a, c, g, or t
  misc_feature (234)..(265): n is a, c, g, or t
cctctnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 12834 - DNA, 807 bp, Diabrotica virgifera
  misc_feature (640)..(657): n is a, c, g, or t
atccgaccttccgacgatttttcgatacacaaactcttttacaaatacgattttgtatgatatcggagtgttctgttagtaattggacaatgaaagatcattggtttcgtgtaatcatgtaaagtggtgtggaaggaggacttggtgccgtatggtaccttgaagatggtgactttaatgccttgcaattatcttaacgcacaaaataggtgcacaatgatcgacaagatgtgtgaaccaaaggtgaagcggtccagggaagatggtgattctccaacagaaaaagaaaggttaatatgcgattctgcctcgagccctcaaagtggccggtcttcgtcaacatgtgggtctcctacgcctattacggcggcgacaaccgtgatacaccctgcgccaacggatcccctttcgtcatcgtcgccccccgcgtcgctaccaaccgccaacttcacccctgcctggtcgctactggatacccaaggagtcaagacagagatcagaagtcccggcttagcagaatctgattgtgtagcatctacgcaggattctgcttctttttttatcacttctatagacttatgcaatctttacgacaaagattaccatcagacatattcagcagcacattcttattacaatnnnnnnnnnnnnnnnnnngagatcgtcgggcgccacaactccgtacatcaactctgcatgcgtcgttatacaataactcctcgcatccgtactctggactaactctgtcagagtttcaatacagtctgtaagcaagcgcaggatacattacgacttcgtactcaacgc

SEQ ID NO: 12835 - DNA, 523 bp, Diabrotica virgifera
  misc_feature (116)..(133): n is a, c, g, or t
  misc_feature (237)..(256): n is a, c, g, or t
  misc_feature (298)..(321): n is a, c, g, or t
  misc_feature (323)..(337): n is a, c, g, or t
  misc_feature (416)..(434): n is a, c, g, or t
  misc_feature (470)..(490): n is a, c, g, or t
attatattaaaccccaatgcatggtatgaagtgtgtggatcatcggatgactatgataatgaatatatatatttattgttttccaattttaaatagtaatgaaatctagaatttcnnnnnnnnnnnnnnnnnnctaatcctccttattattatgaaatgatatacctttcgtacgtatatctaaacttttaaaaaatatgttatgtttatttattgactatatatatatccttacgnnnnnnnnnnnnnnnnnnnncagctatttctaaggaagagcttaatcatagaacttttttcnnnnnnnnnnnnnnnnnnnnnnnncnnnnnnnnnnnnnnngtattggaaaaaatgatattatttatgcttatatattatcattctatatgtgttatagaacttattattagaaaatcgnnnnnnnnnnnnnnnnnnncataatggtgataatatgctaatttcataattgtcnnnnnnnnnnnnnnnnnnnnnggtgtactaaaggaattaggaaacatttatttc

SEQ ID NO: 12836 - DNA, 874 bp, Diabrotica virgifera
ctcctcgacgtccgcgcagaataactgctaccatcatttgataaaaacgtgacagtagatattatgtagagacatgttgttagtgatataaaacatattaagccaggtactaataaagatgaccaacaatggcttgcccctatttgtaccggacccgattttatattgcctatgtggctaaatcatttttagtctgcataatgacaattattatattcttttttgttcgccatatcttatactcacggggcatccttttaaaaataaagatgtcgaagcaccatgcagaatcacgaattaaggcattttcctcagttctcgagacagatatcgatgcctactcagatgaaaaagctttgtccgacgaacagttaaaattagttatcgagaaaattttacccagtttaccaaaaattaaaaaggattggaaatcggatgcaaaaaggggatacaatcaaacttgtgctaagtttgtactacctctaaacattgagtaccgcaattcatactggcaatctcagaaaactagcaacggtacgtttctgttatacaatgcatatttggatactagatcggaaaatacacttggtcctactgtaagaattgtcggaatgatagatatacacaaaattaattcaactacatattgtcatctttggtttaacggtacaaacaacccagtaatcgtaaaaacctttgaacatagaagtatctggtggttcggaaaaccacaaaaaggttattttataccgtatctaatatcatgcgtttggccaaagaagtttagcaaacgaattccggaatctattttccttggtgaggaaagagagtgtgataatgcaactaatcgctttaagagtctatacgacaaccc

SEQ ID NO: 12837 - DNA, 895 bp, Diabrotica virgifera
  misc_feature (863)..(880): n is a, c, g, or t
attacattacatattacatgaaaacacataataccgaatgtgcaaaataaatatcaacattatttggatatacagtagaaccccaattatccgtacgcgtattatccgtgctgtgattttccattagtcaaattcaatttgtgagggtttatcgaaatagcttcaccataaatcactctaaggaaactatatacgtcgtgagggagacgcataatgcaatatcgatagcaacagtgctcagggaaataatgtcatctgcctgttgctgacttccaaaatagcaataactacagtgaaacacaaagagttattttaacaactgaacaaaagctacgagattttaaatagaagtgaaaagggttaacatgttgcatctttatcacgaatctatgaagttggcgggcaaacaataccgcatctcaataaatctctatgagtttacaaacattttaatctcagtttgacagttttaaaaacatatcttaaaaacataaagatcgacttttcaacaagtcgataaagccctttacaaccaagtggtttctacaggaaagaacggagagcgtaacaatctatggaccaatgtttgctaagcaagctgattttcacgaacacttgaaaatcaaagaaccttttaaactgattcatctgaaaatggaagtcgagacgaaaaaacgatgtgacggtagcgatctaaacagcaattaattaggaggatgaggaagctgccaatattatatactagactattttgagtaacgagaaccttcagaccttggtgatattttgaacttacgaaaaatatggcaaaggacaaaaaaatctaagatttttaacacaggccaaactgactgttccaaccnnnnnnnnnnnnnnnnnntggtatgttttaatg

SEQ ID NO: 12838 - DNA, 893 bp, Diabrotica virgifera
  misc_feature (574)..(597): n is a, c, g, or t
  misc_feature (717)..(737): n is a, c, g, or t
ctcaatttttgccgtagaaaattttttttcaaactaagttcttgggaattaaataatctacaatttcatattaaaacattttttcgtatctctgatgctaatctttttattctgaagtaaatggcattttttaccaaactacaaaaattcgttatttttttctaactccagtttttttaaaaactgataattctaagccagtcaaacttctgacatctattactaatacataaataaagaagtataaatatggctatatgactaaaaacatcgctaacttacattattatgcttctaattggatttctccttttttttttcccgtaactcttttatttcttatcctagaaagtttggtaaaaataattttgtaggtttcaaccagatctataaggctattaatattaaatccttttaaaatcctcagtcgcaaaaagaggtgactgtaaaagggttggtaaggtggtttttgcatgttattacaagttttaattgtcaatagctcactcaatttttgccattgccatagaaaaaatttttgctgacgccgttcttaggaattaagtaagctacnnnnnnnnnnnnnnnnnnnnnnnngtatatctgatgctaatctttctattccgaagaaaatgacattttttaccaaactacaaaaattagttattggcttttaactaaactaatcattttaagcccttcaaacctctagaaccnnnnnnnnnnnnnnnnnnnnngaaggacaaataaggtcaatgactaattttaatcagggtggtaagtagaaggaagcttccgatcactttttcgctgaaaaaaatagggcatgacattcttttcataatagtcacttaatttgtgagctagatacttttttttatttctgtagatag

SEQ ID NO: 12839 - DNA, 423 bp, Diabrotica virgifera
  misc_feature (69)..(69): n is a, c, g, or t
cctcccacagcgcccgttcactgtggtggagggtatggttacgcctttccccacaccggaggctatggncatggaggatacagccaccacacagaacaacatgtagattcgtatggaccccacacaccatggctgggtatggttctctccatgaatatgaccatcaggttgttgaaactgtccatggatatggcggacatcacaatgatcacggtatatggagggcatcatgatgctcgtgttgtctgaaagaggatacggaggtggtggagatgatgatgtaacatatttgcgaagatggggatgtcctggaggggcgagcgaggggatgcttgatgaaatgttgttgttatgtttggggtgagacgcgtgcaagtgaggagaacttaaaatgacggtccaaatctggagagaggattcgag

SEQ ID NO: 12840 - DNA, 914 bp, Diabrotica virgifera
  misc_feature (562)..(651): n is a, c, g, or t
cctgccagtagtcatatgcttgtctcaacgattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaccccgagggaatgatt

SEQ ID NO: 12841 - DNA, 738 bp, Diabrotica virgifera
  misc_feature (21)..(45): n is a, c, g, or t
  misc_feature (213)..(240): n is a, c, g, or t
gtcctaacatacgtccgttgnnnnnnnnnnnnnnnnnnnnnnnnncttatatatttagatatatataaatgggcgagtggaaaatagtgatatatagaaccgacacaagacaccatatcacgcaaaacataaactgtacattatcagagcattactaaattaaactataagccttatcataaaaaccctaaatgtaaatatttgacaagttcnnnnnnnnnnnnnnnnnnnnnnnnnnnncatactgtactcagcaatacattgttatatatatctgcgcatacaaataatgtaacaatgataaaatggagtgataacagaactcatctattcaacctccctaaatttatctgataaaatatgtaaaactaaaaatggtacactatgataaacattagaaaaacatgcccattgagataatacattagctaaaaatactgactacattttaaaagataaagcatttgatcccattaaagattctaataaatacacattaatgccatacaagaaaaaatctcacaactttgccctcaaactatactatgaagtaacaaaatctattagagaaagattaaaatcggactctgatgatttcacattatgtctttgaaatcctgataaagacaagaagcctttacctatgataacaggtcaccaacaattaaacaatgacgtgaaattttcacctaatgtgagaaaattagcttgagcatctttcgataaatcaatcgaatt

SEQ ID NO: 12842 - DNA, 175 bp, Diabrotica virgifera
  misc_feature (57)..(75): n is a, c, g, or t
ctctacgcgtccgatattatcatttataatgatatatattaaaatatatgttaagcnnnnnnnnnnnnnnnnnnnaaatgtcaaagttttctctttatttttattgatacaataataatggtaagaaaattatgtttttgcactaaacaattaataaaaaattgatattttttct

SEQ ID NO: 12843 - DNA, 856 bp, Diabrotica virgifera
  misc_feature (2)..(566): n is a, c, g, or t
  misc_feature (573)..(610): n is a, c, g, or t
  misc_feature (630)..(643): n is a, c, g, or t
  misc_feature (646)..(668): n is a, c, g, or t
  misc_feature (676)..(698): n is a, c, g, or t
  misc_feature (716)..(716): n is a, c, g, or t
  misc_feature (728)..(759): n is a, c, g, or t
  misc_feature (766)..(837): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtganccaggttggttnnnnnnnnnnnnnnnnnnnnnnnnnnnnnnnngaaaggnnnnnnnnnnnnnnnnnnnnnnnnnnnnnnnnnnnnnnnnnnnnnnnnnnnnnnnnnnnnnnnnnnnnnnnnccaaccaaaatattttcgg

SEQ ID NO: 12844 - DNA, 527 bp, Diabrotica virgifera
agctcttacagaataagcataacattaagatctttaatatatcggatgacaggccggtctaatgtaaaacggagaggatttttccgaacatgactcaacagagcatcgaaatggatcaggtgatgctccaaccgatagcgtaagtgcacaaccgcccggccgagacgatgatatacaaatatttgatgttgtactcgattgttattaccactggaacgccgatctgacaccttctcctgcagaatgaaccgctattttgaacttgtgtactaacatacccacagactgggacattttgggaattgcacttcaaaacttctacgcatgttttttttatgaagaagtagaagttgtatcgcgtccatgatgtactagtgaataaggtgactacattgaagatattgttgggaatgtaaaataaattcctagtgatattatctcctaaatatttgataacaatatgtgtgatgaattctataattatgtagaaaattgaataatcgataagagaatacaagaatttaaat

SEQ ID NO: 12845 - DNA, 776 bp, Diabrotica virgifera
  misc_feature (22)..(53): n is a, c, g, or t
  misc_feature (60)..(78): n is a, c, g, or t
  misc_feature (96)..(120): n is a, c, g, or t
  misc_feature (220)..(241): n is a, c, g, or t
  misc_feature (248)..(277): n is a, c, g, or t
  misc_feature (294)..(327): n is a, c, g, or t
  misc_feature (383)..(402): n is a, c, g, or t
  misc_feature (502)..(534): n is a, c, g, or t
ctcctcgcgtccgatattcacnnnnnnnnnnnnnnnnnnnnnnnnnnnnnnnnccattcnnnnnnnnnnnnnnnnnnnttaaattatttagattgnnnnnnnnnnnnnnnnnnnnnnnnncaccacttgtatattgatgaagaatatatacgtatagtaaaggaattcggcgacattcttttcgcctgctcattaaacccatgcctttttgaattaaacnnnnnnnnnnnnnnnnnnnnnncttaccnnnnnnnnnnnnnnnnnnnnnnnnnnnnnncgggagcataatcattnnnnnnnnnnnnnnnnnnnnnnnnnnnnnnnnnnctgaaacaacaactgcctttatttactttataacgaattttatttctgagataacnnnnnnnnnnnnnnnnnnnncaccagaacaccctatatagctctatacaactattactaagttgttgtactattacatgtatgtatatcatacatttatgtaatctgcgtgatctaaagnnnnnnnnnnnnnnnnnnnnnnnnnnnnnnnnncttaataattcttttgatcccattcttttgattatcagaataaattaccttaaggataacagcgtaatttgattgcagagttcaaaccaataataaagattgcgacctctatgctgaattaacgtttatcctcggtgtagcggctatattattcagtctgtacgactttgatactttacatgatctgagtctacaccggcgtgagccacgctgctttctatctatactctattactatattt

SEQ ID NO: 12846 - DNA, 970 bp, Diabrotica virgifera
  misc_feature (345)..(388): n is a, c, g, or t
  misc_feature (446)..(467): n is a, c, g, or t
  misc_feature (533)..(556): n is a, c, g, or t
  misc_feature (598)..(634): n is a, c, g, or t
  misc_feature (919)..(919): n is a, c, g, or t
  misc_feature (942)..(943): n is a, c, g, or t
ctttctcgcgtccggaaaaacctcacaagtgtgagatttgttttaagcagtttagtacagcacagtgtttaaaataccatctagggaacacacagtggagaaatgcctttcaagtgtggaatttgttataagcagttttctcagaaagggcatttggatagtcatcatttaatcgtgcacactgtagaaaaaccttacaagtgcgaaatttgttttaagcagtttcaatcaacaaatcacttgaaaaggcatttgagagtgcacactggtgaaaaaccttacaagtgcaagatttgttctaagcaatttagtgaatcaaattctctgaaaagacatttgagagtnnnnnnnnnnnnnnnnnnnnnnnnnnnnnnnnnnnnnnnnnnnncatttactcaagatgcagatctaacaagacatttaaggatacacattgaagacaaccnnnnnnnnnnnnnnnnnnnnnngaagcagtttagtcaatatggaaatttgaaaagccacatgaaagtgcacactggagaaaagcctcnnnnnnnnnnnnnnnnnnnnnnnngttttagtgcagcagttagtttgagaaagcatttaaggatannnnnnnnnnnnnnnnnnnnnnnnnnnnnnnnnnnnnctaagcagtttgctcgattagataatatgaaaaatcatatgaatacacaccggagaaaaaagttacaagtgtaaaatttattttaattctttcagtcccactttttttacttaacccgcgattacacgcgctatcagggaatacctcaccatatttgtttataaccaataaaattgtcttaatcttagatatataatgctctagattgcgccctgtcattttaacaggttcactgtcccagttttagagtggaaattcctcataagtccagttatgtttttgtanaaattgatatcttctggctttannataataataatattgtaaaatatataa

SEQ ID NO: 12847 - DNA, 795 bp, Diabrotica virgifera
  misc_feature (8)..(794): n is a, c, g, or t
ctcctcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnc

SEQ ID NO: 12848 - DNA, 891 bp, Diabrotica virgifera
  misc_feature (7)..(28): n is a, c, g, or t
  misc_feature (662)..(688): n is a, c, g, or t
ctcctannnnnnnnnnnnnnnnnnnnnnaattccaatgatgcttccgagatcaccttgacgatttgtttaagacgatttgatcttttccttatttggcacggcaagtgtgatccctaattttcggtttaacaacatcattatcatattatgtttttggacatatcggttcgtgtaggatattattttatagatttgtgtatttgtgatagtttaataatccagattaggaagttatctcagttgcaacagtgacagaggtcgtctttctacttgtttcctctaaatttttatttatggactccgaacagacatattttcatttatcctcaaataaaaatttcattcctaatctctgtagattttgtgtatttgttaatgttgtttaacaattggcgcccaacgtggagccttaactcacgaccctaagactcctaaccttacagtatggtaaactcctagttttgaaagactgacaagccgccagactgagatccagtaacgttacgctatcattaacatgtaccgacagcaacaacgcttgattcaactctcctttcagagctgtggggatcgagaaacacgtttagaccgctacgttttatgtctagctagattatgtgacgtcaccggatctcagtctggtggattatagtcttactcnnnnnnnnnnnnnnnnnnnnnnnnnnnttaacactaatttttcctataagatttaattataggaatctgcagattatttgcacaatgctgcatatcatcgcctgtaggtagtagcacaagactttcgcagaggatatattagtttgttcttaattctggcctggattttgtttctgatgtatatgttgccaattgtgaatgggatttgatggtgcattttgcttatatag

SEQ ID NO: 12849 - DNA, 103 bp, Diabrotica virgifera
  misc_feature (11)..(11): n is a, c, g, or t
  misc_feature (15)..(15): n is a, c, g, or t
  misc_feature (25)..(25): n is a, c, g, or t
  misc_feature (29)..(29): n is a, c, g, or t
  misc_feature (35)..(78): n is a, c, g, or t
  misc_feature (80)..(94): n is a, c, g, or t
ttatttttaangttnaaaagcttanattntttttnnnnnnnnnnnnnnnnnnnnnnnnnnnnnnnnnnnnnnnnnnnngnnnnnnnnnnnnnnnattattata

SEQ ID NO: 12850 - DNA, 87 bp, Diabrotica virgifera
  misc_feature (2)..(27): n is a, c, g, or t
  misc_feature (40)..(60): n is a, c, g, or t
cnnnnnnnnnnnnnnnnnnnnnnnnnntccttcaaatgcnnnnnnnnnnnnnnnnnnnnnatcgggaggaagaacgcaatatctatc

SEQ ID NO: 12851 - DNA, 973 bp, Diabrotica virgifera
  misc_feature (14)..(972): n is a, c, g, or t
catttcgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnna

SEQ ID NO: 12852 - DNA, 319 bp, Diabrotica virgifera
  misc_feature (8)..(88): n is a, c, g, or t
  misc_feature (186)..(204): n is a, c, g, or t
  misc_feature (283)..(306): n is a, c, g, or t
cggtgatnnnnnnnnnnnnnnnnnnnnnnnnnnnnnnnnnnnnnnnnnnnnnnnnnnnnnnnnnnnnnnnnnnnnnnnnnnnnnnnnnattacctttaaggataacagcgtaatttttatttgaagagttcaaatcgataataaagattgcgaacctcgatgttgggattaaagtttataattggnnnnnnnnnnnnnnnnnnntaagtctggtccaactttttaaatttttacttgatcctgagttaaaaccgggtaggagcccaggttgggtttcctatcnnnnnnnnnnnnnnnnnnnnnnnngaacgaaagggac

SEQ ID NO: 12853 - DNA, 911 bp, Diabrotica virgifera
  misc_feature (16)..(747): n is a, c, g, or t
  misc_feature (749)..(763): n is a, c, g, or t
  misc_feature (765)..(799): n is a, c, g, or t
  misc_feature (801)..(827): n is a, c, g, or t
  misc_feature (842)..(842): n is a, c, g, or t
cttacactgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnnnnnnnnnnnnnnnnnnnnnnnncnnnnnnnnnnnnnnnnnnnnnnnnnnngaataattaccttanggatacagcgtaattttattgagagtcaatcgataataagattgcgacctcgatgtgattaagtttata

SEQ ID NO: 12854 - DNA, 974 bp, Diabrotica virgifera
  misc_feature (835)..(835): n is a, c, g, or t
  misc_feature (875)..(875): n is a, c, g, or t
gtccatccccgacgtccgacatgattacatattattttagccgttaataataaaacatgtatcctaaaagatagtataattcatatagaaaatttaatataccaaaaaaatgttatcaagaatagttataagaaattttgacaagtcgcatttgctcaggaggaaacaattgtgtagtgtaacaatatttaattctagttttactaatcccatagaagatgaagcaccaccaaaacctactttagttgcaaaattagtatcaaactctccaaaatcgatacagccctatttaaaattggtaagatttgatcgacccatagggacctttctattattttggccatgcagttggagtattgcctcggctgcagctcctggagctctacccgatccctacatgctggcattgtttgcaacaggtgcattagttatgcgaggagctggttgtaccataaatgatatgtgggataaggacattgacggaaaagttgaaagaactaaggaacgacccctggtgaatggtgatatatctatgaaacaagccctagtgtttcttagtggacaattaagtgttggtttggcgattctattacagctgaattggccaagtgtattccttggggcaagctctttagcattagtgatcagttatccacttatgaaaagaattacttattggccacaactagttttaggatttacgtttaactggggtgctcttttaggatatagtgccattcatggatatgttgatttgccagtttgcttgcctttatatatggctgggtgtttgttggactattatttacgacaccatatatgcacatcaggatanaacagatgatttaagagtaggtatcaagtcaactgctctntaatttgacgaagataccaaattatggttgagtggctttgcatcgacaatgataggaagccttgtgatatcgggaggaatgaactcgcaaacctggcca

SEQ ID NO: 12855 - DNA, 893 bp, Diabrotica virgifera
  misc_feature (14)..(881): n is a, c, g, or t
  misc_feature (885)..(885): n is a, c, g, or t
ctttctcgcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaangtttttta

SEQ ID NO: 12856 - DNA, 547 bp, Diabrotica virgifera
  misc_feature (55)..(55): n is a, c, g, or t
  misc_feature (149)..(169): n is a, c, g, or t
  misc_feature (319)..(356): n is a, c, g, or t
  misc_feature (359)..(377): n is a, c, g, or t
  misc_feature (386)..(410): n is a, c, g, or t
gcccccccgggtccgctgtttataagatactatcatggattacttatatgagatnagaagaaaatattgtggatggaggtagattagtggtaaaatattgagattttagtagttattgtgtaagagttggaatattgagatgaagatgnnnnnnnnnnnnnnnnnnnnnatattgagattgggagggtatgtattgaagttggataagagattgtatattttatagtaaaatatagattttaaataattatatgggaatgaggtgttattatatatttatatgaatataattttggaagatgaaatttgagattaatgnnnnnnnnnnnnnnnnnnnnnnnnnnnnnnnnnnnnnnttnnnnnnnnnnnnnnnnnnngggatgagnnnnnnnnnnnnnnnnnnnnnnnnnggagtgtttgaataagtattatgatgataaattgaaatattttatgatatgttagtatttatttttatatgttattatagagtattaattataagttttttattaatttatagatttgaattatgtaagtttatgag

SEQ ID NO: 12857 - DNA, 156 bp, Diabrotica virgifera
  misc_feature (31)..(71): n is a, c, g, or t
cgggatcttgacccggcaaaggaagataatnnnnnnnnnnnnnnnnnnnnnnnnnnnnnnnnnnnnnnnnntgaaaaacactgtttttttttcatttataaagattttttccttcccgtgcaaatgctttatttttcagataccaaagaaactccc

SEQ ID NO: 12858 - DNA, 611 bp, Diabrotica virgifera
  misc_feature (441)..(459): n is a, c, g, or t
gccaacctcgggtccgacttgaataacctcacttattttttagacattacaaaatacaaataaacaaaaatatgtaaaatgagttctaacaataaaaggacagtatatgtaggcggtttagctgaagaagtcgatgaacaggtacttaatgcagcatttattcctttcggcgatatcatagatgttcaaatacctttggattatgaatctgaaaagcatagaggttttgcttttatcgaatttgaaagtgccgaagatgcaggagctgctatcgataatatgaatgactcggaactgtttggcagaacgatacgagtaaatctagccaaaccgcaaaggattaaagagggttcgactagacctgtgtggtccgaagatacatggctacaacaacatgcaggtgaaaccataggaaaaaaattaggaactggagaaaaaacnnnnnnnnnnnnnnnnnnnagcgaagctacatcaaatgaatcaaaaaaagttaaaaatccacaagtatacttcgatatcaaaataggaaagagcgaaataggcaggataacgatgatgttgagggatgatgttgcaccaaaaagagttgagaaatttcatagaggatgtac

SEQ ID NO: 12859 - DNA, 695 bp, Diabrotica virgifera
  misc_feature (19)..(39): n is a, c, g, or t
  misc_feature (61)..(62): n is a, c, g, or t
  misc_feature (68)..(88): n is a, c, g, or t
  misc_feature (107)..(107): n is a, c, g, or t
  misc_feature (340)..(364): n is a, c, g, or t
cggcttcacccctagtccnnnnnnnnnnnnnnnnnnnnnatgtgctgcttttagagaaagnnatgagnnnnnnnnnnnnnnnnnnnnnaggtaaagtgggagagaanaggaaaaaggaactcccagagaaaggaggaagaggataagagagaaaaaagtattatgaagaataaatttaatgaaaaatttattgtagttaaaagtctaataaagattgataattaagtaataaaataaagatataagaacaggtataaagagatagaagtcatatatatactagatgaagataattttaaatgatgaaatatgagactaaactatgaaatatttaagaacnnnnnnnnnnnnnnnnnnnnnnnnntaggatatatttgtaagagaagatattcaaaatgaaatgatattaaaatggaatgagtgaagtaaaataagttagtataactgaaaatattttatgataagattgtacttatacttatatgaattataacaggttaacaataagttatttatgagtatatagaattatatgccgaatggcaagtagttttattaatttgtatatttatgataggatagagagaaaataatggatttcggagcatattatcgccctgtaaattacatgtacgcagtaatgattataaaatggtgtgataaggttctgaatgtctttacggatagacctagga

SEQ ID NO: 12860 - DNA, 904 bp, Diabrotica virgifera
  misc_feature (267)..(284): n is a, c, g, or t
ttaaaatatattagtaagaatgcctgtagatataaaggaacttactgaaggatggctggaactggaaagtgatcctggtctttttacgcttcttttagaagactttggcgtgaaaggagttcaagttgaagaaatatatgatcttaacaaacctttagatagtcctgtatatggctttatttttctatttagatgggttgaagaacgccggtcacgacgcaaggtcgtggaacaaaatgaaacgttcgttaaagatgaagatattgnnnnnnnnnnnnnnnnnnctcagcagatggtacctaacagttgtgccacccatgcactgatttcaattttgttaaattgtccaactatacacttgggagagactttaaccagattgaaagcacatacacaaggaatgagtccagacaataaagggtgggcaattggaaacacccctgaattagcttgtgcacataattcacatgccatgccacaggctaaaagaaggctagaaaaaggtagtggggtatcaactggtagatttacaggtgaagcatttcattttgtaagctttgttcctattggtggtagactttttgaattggatggattaaaaccatttccgatagaccatgggccatgtaacgatatggaatggactgacaagtttcgtagtgtcattaccgatagactaggaattacagctgatgaatataacgaaattagatttaacttgatggctgttgtgcctgacagaagattagctattcaacataagttaaaaatgttaagaactaataagcaaatagttttagatgcattgcaacatttagttaaaatcaaagataaaggaggcggtactaagttagaaaatcaaggagagcatgtcaagatttcatatctaacagtgctgaagagc

SEQ ID NO: 12861 - DNA, 894 bp, Diabrotica virgifera
  misc_feature (203)..(223): n is a, c, g, or t
  misc_feature (457)..(475): n is a, c, g, or t
  misc_feature (648)..(676): n is a, c, g, or t
  misc_feature (724)..(724): n is a, c, g, or t
ggtttaaatttgatgacaacttcatgtaatgctttatacagtttagaccagcggttctcaatctgtggtacatgtaccactggtggtacatatcattatttgcggtggtacacaaaagcaaaactgtcaaaatcaccactattacagttaattagattacctatctattatagataggtagttatttcagttaggtggtaccnnnnnnnnnnnnnnnnnnnnngtggtacatgactcaaaaagattgagaaccactggtttagactctttacctcttcgagttattctacaacgatattatgcaaccactatttgacagtattttgaagttccgcaagattctgtttgagggcttttatctttttatcaagtttttttattgtgtttgtttttatcatttcatttatttgtttatattgaagtcctttataattgaaacaagacgacagtgaatggnnnnnnnnnnnnnnnnnnngggaggtccaaagtaacaataaatatttgaaatttctataattcgtgaaaataaagactttaaactgaattttactagcgtttttgagacatatttcttaaatataactcatttgatcaacttaagcgcataaatgaaatgaattatttggaattttaaaaatttatgaaacnnnnnnnnnnnnnnnnnnnnnnnnnnnnngaaaactgtatcctactacaaccagttgtaggacgtgttaaaagcttnaaaaataagttttttgtatatatattacctaagtataatttgcctttcgggaacatatcgtacaagttttttagccttgtttattctttttaaattttatgtagtatcttgtttttgtatatttgcaaatttttttattgaatttaattcatttaaagggctagggtggt

SEQ ID NO: 12862 - DNA, 697 bp, Diabrotica virgifera
  misc_feature (17)..(60): n is a, c, g, or t
  misc_feature (79)..(111): n is a, c, g, or t
  misc_feature (117)..(183): n is a, c, g, or t
  misc_feature (196)..(245): n is a, c, g, or t
  misc_feature (248)..(297): n is a, c, g, or t
  misc_feature (306)..(352): n is a, c, g, or t
  misc_feature (367)..(379): n is a, c, g, or t
  misc_feature (382)..(466): n is a, c, g, or t
  misc_feature (496)..(513): n is a, c, g, or t
ggaaagtaattaagaannnnnnnnnnnnnnnnnnnnnnnnnnnnnnnnnnnnnnnnnnnnggaacctggggaatcaggnnnnnnnnnnnnnnnnnnnnnnnnnnnnnnnnnccaaannnnnnnnnnnnnnnnnnnnnnnnnnnnnnnnnnnnnnnnnnnnnnnnnnnnnnnnnnnnnnnnnnngaaaggtaatccnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnggaaggagnnnnnnnnnnnnnnnnnnnnnnnnnnnnnnnnnnnnnnnnnnnnnnngataaaaaatttccnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnggaggataaaataagaataaaaaggtggannnnnnnnnnnnnnnnnntaggttaattaagggaatccggaaccattttttccaccggttaataaaaaactgggccttttggaataaaaaataaggccccgccggcccacggataaattggaagggccgcggaatttggaccgggctaaggaagcaatctcataagtttttttatggaaagcgggatgcagggggtggcatg

SEQ ID NO: 12863 - DNA, 205 bp, Diabrotica virgifera
  misc_feature (2)..(174): n is a, c, g, or t
  misc_feature (178)..(196): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnnnnnnnnnnnnnccttttttt

SEQ ID NO: 12864 - DNA, 113 bp, Diabrotica virgifera
  misc_feature (11)..(108): n is a, c, g, or t
gtaaaaagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggg

SEQ ID NO: 12865 - DNA, 184 bp, Diabrotica virgifera
  misc_feature (2)..(14): n is a, c, g, or t
  misc_feature (16)..(105): n is a, c, g, or t
  misc_feature (109)..(170): n is a, c, g, or t
gnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccnnnnnnnnnnnnnnnnnnnnnnnnnnnnnnnnnnnnnnnnnnnnnnnnnnnnnnnnnnnnnnccattttttttgat

SEQ ID NO: 12866 - DNA, 850 bp, Diabrotica virgifera
  misc_feature (42)..(64): n is a, c, g, or t
  misc_feature (83)..(96): n is a, c, g, or t
  misc_feature (98)..(110): n is a, c, g, or t
  misc_feature (121)..(138): n is a, c, g, or t
  misc_feature (347)..(359): n is a, c, g, or t
  misc_feature (361)..(373): n is a, c, g, or t
cctcattgttgttatattatgtttatttgtaaatatctgttnnnnnnnnnnnnnnnnnnnnnnnattacagcacgtattttcnnnnnnnnnnnnnncnnnnnnnnnnnnngtgtagatacnnnnnnnnnnnnnnnnnnaaataacataatataatagtctagggtcaaaaatcgagtcccaggagaggttaagtatgcaattttaagtaccttcggtatcttgatgttttttatatttttgctacgtagattagatttttcgatggtaccaggctgaaaagccgtcaaataatttgttgttgacagtttatttgtttaaattattgtatcttctaaaccattaaagnnnnnnnnnnnnncnnnnnnnnnnnnngttccttgtgaaaaaattaaaaaatagcgtctggtaaactttgatacgattgttagaaccggaattataacaaatttcatgaaaaacaattgcaaaataggcatttgatgtagtagtacgttctttaacggtaaaatattgcaaaacctctaaattttacagaacttcttggattgacattaaatttggaaaacacatagccaacaagtcgaagaaaaagtgatattgtgctggggtgggtttcaccccttcttgggggttaaaaagatatacgtacaaagtaagtccggaaatggataacctgattaattttaagtaacttttgttttatagagttttttcattaaggcaatacttttcgagtaatttacgagtgaatatgttcattttccaccaaaaaaccacggttttagacagatgttcgccaataactcaaaaagtggctattttttgaaaaaaccagtttggagcaaaata

SEQ ID NO: 12867 - DNA, 581 bp, Diabrotica virgifera
  misc_feature (12)..(45): n is a, c, g, or t
  misc_feature (67)..(67): n is a, c, g, or t
  misc_feature (316)..(348): n is a, c, g, or t
  misc_feature (433)..(453): n is a, c, g, or t
tttttgggggcnnnnnnnnnnnnnnnnnnnnnnnnnnnnnnnnnnggattaattagatttttgtggntgtgttatcgtgggacattgactgcatctattgttacgagatatatattttttgttcctgtgctgtgcggaggatctattttaagagtaatggaattataattattctctatttgtctcagctcaaaaagaagatctcccttattgactacaaaatttcttatgtaatttttttctaatgcaatgcgattcctttatatacatatactgaattattgaagaaattgatgaaatctatttctaagctacnnnnnnnnnnnnnnnnnnnnnnnnnnnnnnnnncattaaatatgtcttagggatgaacttgaaaattacatgttattaccagtatatttatggagtatcagtagtgattagaaattgnnnnnnnnnnnnnnnnnnnnngatttattgttatctactattaatttgattttatataggtttttcactaggtgaatgcttaaattattgtgatttagtcctgatgtaatataaggattataagttgtgtatttgagtaaactattata

SEQ ID NO: 12868 - DNA, 886 bp, Diabrotica virgifera
  misc_feature (36)..(61): n is a, c, g, or t
  misc_feature (705)..(705): n is a, c, g, or t
cttctcgcgtccggaattatggggaaaatttattcnnnnnnnnnnnnnnnnnnnnnnnnnntttagggaggacgttacagcccattacaaatttattagaaaatatggaaatactgacgttcattattaaaaagttgctacaagcaagttactcattctacacctggccttcagcaccagttcttgcatggtttatctgggaaaatcgtgaagaattttgtggtaaaaaagttgttgaactaggagcgggtactgcccttcctggaatcgtcgctgctaagtgtggtgctgatgttatattgacagaatcagccacactaccaaaatctctatctcatactagaagaagttgccaagttaacaatctagtggttaatcaacacattaaagttattggactgacttggggattgtttttaggtaatttagatctgcttggtcctcttgattacatcattggttcagactgtttctttgaaccagcaacatttgaggatattcttgtcacagttgcatacttgctagatataaatattaacgctaaattcttctgtacttaccaagaaagaagttctgattggtctattgaacatttgctctcaaagtgggacttggagtgtattgtgcacaatataaacaatttagggaacagtataggtctcaacattcacgatttaattggagatcacagcattcacttgcttngaattttcagaaaatcataagtaatggctacgaatggtgttcgccaactctacagattgtatgtgagcaacattccttggaccgttggttcaaaagagttaagaccttatttcagtaagtttggacatctgcaacaagctactgttgtatttgatagaaaaaccggaatggctaaaaacta

SEQ ID NO: 12869 - DNA, 645 bp, Diabrotica virgifera
  misc_feature (508)..(522): n is a, c, g, or t
cttaggctaccgataatattacttttttcttttatcggcacacatggcagatcataatcggagaacagccagaatatttttctgaagatgactcaacatagcatcaaaatggatcaggagatgctccagccgatattggaagtgcaaaaacgcccggacgcgacaatgatataatattatttgctgaagaatggaactggaaaacccctgataccaagaaacctgaacattgtctccaggatgacaatttcccatcatttttagagaagataaagacctatactggataatagctacttttaatggtttctctgtaaaactagatgaaattgattataacaaaaaagttggtgggatgccctgtcatgaatgaggaaatttttcaccacgttaccccctaagcaaggattgggaaaatatttgtatgtcggatcacctctgaattgagtgatgatgacatctggaaatatttctcacaaattgtagagataaatgatattgaaatgcnnnnnnnnnnnnnnnaaaaccagaggaatggattcggcttcgtcccatttgaagcgaaacagatagcgaaagtgcaacacttgccacccatacaatccattgaagatcaagaggtcgatgtctggatagacaccccca

SEQ ID NO: 12870 - DNA, 202 bp, Diabrotica virgifera
  misc_feature (18)..(45): n is a, c, g, or t
  misc_feature (65)..(78): n is a, c, g, or t
  misc_feature (81)..(94): n is a, c, g, or t
  misc_feature (111)..(133): n is a, c, g, or t
  misc_feature (170)..(194): n is a, c, g, or t
taacagcgtaattttcannnnnnnnnnnnnnnnnnnnnnnnnnnntgcaacctcgatgttggatnnnnnnnnnnnnnnggnnnnnnnnnnnnnnaattaagtctgttcgannnnnnnnnnnnnnnnnnnnnnnagtttaaaccggtggaggccaggtttggtttctatcnnnnnnnnnnnnnnnnnnnnnnnnngaaaggac

SEQ ID NO: 12871 - DNA, 139 bp, Diabrotica virgifera
  misc_feature (9)..(32): n is a, c, g, or t
caaacatgnnnnnnnnnnnnnnnnnnnnnnnncattttgattgattatacattttttatctgaataaaaatgaaaattatgtaattgtagcaatgatgataatcttatgattgacaaattgtatatttaggaaaaatat

SEQ ID NO: 12872 - DNA, 876 bp, Diabrotica virgifera
gaggattatctgagtgctctattgttcaacttgatcatgaatgaaataatgaaaaagtaagaactaaaaaagataccaaatgagagaaaaacaacttaaattaatctcctatataaacaatgcaatattaatctctcaaagtgaagatgacttacaacataatatgctgcaccaattttaacataaccgccagaaaatttaacatgttaatttccccaaaaaagacaaaatgcatggttataacagcaaatcgactaagatgtaaattagagttggagggtcagataatagaacaagtgatagagtttaaatatctaggcgtcacactatctagctacggaaagctcgaaatagaagtggaagatcaaatgaatagagcaaagccgcaggttgccaaaagatagaatttacacaaaacagttatcagaccaataatttcatacgcgccagaaacacgacctgacacagacagaccaaaaagaatgctagaaacaacagagatgaaatcccttagaaaaatcgatggtaagacattatggtacagagctagaagttcagatatacgacggaagtgcaaggtggagatggagaacatcaagaacaggaaaagaaacagaaaagtataatggaacgatccaaatggaggtggatagaaaagttaccaaaacatgagcttcgttatattatgttacatttaacataaatattagaaaacaaaaactgcgaaaccgttttctttttagtctttctgtacatctagtttagaaatattattttgacatgtttattccatgtttctgagttcatgtgatctctagctagttttagaacattatcttattgttcttccattttaggaaacttgacctactctct

SEQ ID NO: 12873 - DNA, 494 bp, Diabrotica virgifera
  misc_feature (122)..(143): n is a, c, g, or t
  misc_feature (283)..(331): n is a, c, g, or t
cattacgcgtccgggcaattcagaatatctgtgttcagctggagggttaaattgtagtcattcaattgaagaagttattcttaaaggtcttaatctttttcgttgaaaagaaaaagcttctnnnnnnnnnnnnnnnnnnnnnnataccccaattaaagaaattagtgatccaatagaagatacaatatttcataatataaatacatcaggataatctgaatatcgtcgaggtattcctattaatcctaaaaaatgttgagggaagaaggttaaatttacaccnnnnnnnnnnnnnnnnnnnnnnnnnnnnnnnnnnnnnnnnnnnnnnnnnatacctgtaaataaaggaaatcattggataaatcccgctataatagcaaatacagctcctatagataatacataatgaaaatgtgcaacaacataataggtatcatgaagtacaatatcaattgaggagtttgctaaaactacccctgttaatcctccaactg

SEQ ID NO: 12874 - DNA, 122 bp, Diabrotica virgifera
  misc_feature (2)..(57): n is a, c, g, or t
  misc_feature (61)..(76): n is a, c, g, or t
  misc_feature (79)..(118): n is a, c, g, or t
cnnnnnnnnnnnnnnnnnnnnnnnnnnnnnnnnnnnnnnnnnnnnnnnnnnnnnnnncgcnnnnnnnnnnnnnnnncannnnnnnnnnnnnnnnnnnnnnnnnnnnnnnnnnnnnnnnctga

SEQ ID NO: 12875 - DNA, 570 bp, Diabrotica virgifera
caacttcaaacatttaagttgctaccttccttatgtttggagattgcttgctagtaggaaggtcacgtggtagataaaccccgcctattagaaagggatgcaagacctgctcgcatcttttttctctgtcgcacttggggaacaggtttaggtttccgtgcacagtctgggtattagttatgtccatggttttgacacccattacggttggtattaatcgttcttgtgatataagaataaatccaactcgagcaactcccccttgtgatagaatcataaacaatctttaagaatttcgtacacagacacaaatatatattcaacgaaaagttttcgtacggaatttttaaagcgcatcacagatgtaactctactttaagtgttagattagtttagtgagctattgcatatttactgtgatataccaggtgttggaagcacttactttattttgggaaagtatggaaaatgtaaaacaccgggtatagtatgcaattgaaaacgcatgtgtatttattttgtatattgtagtgcggttgtatgtatctcttttatagatcagtagactcg

SEQ ID NO: 12876 - DNA, 974 bp, Diabrotica virgifera
  misc_feature (777)..(796): n is a, c, g, or t
  misc_feature (953)..(953): n is a, c, g, or t
aattcggaaaggtccaaagtgtgatgcctggggaaatcgtagagaagaagatatgggactactgatgaggaggaaaaaacctccgaaaccggtagactcttcctgcactctccgatttaacccgagtattatgcagctgctgcattttcgtgttgcaaagaaactgaaaatatttgtatattttaaaaatggaacttgacagaaaacattacaacactccattctgaatagtccagtctctgtgatcattcgtaaatctcatcctgttagctcgataagctgttgttaatttagtgcatgctactgttatgagagcgtgaaccactttcatgtaggactcttcttacagttcgtgaagaaatataagttcctcgagcttgtaacgaacgaagaagaacttcatggttgaagaacttgcgagattggtatggggttgatacaagcatgctatcaaagtggcagtgaataaaattaagatagctatgatggtaaccaactttctgagaggacatagtacacgaagaaggagaggagctcctaacaaacgactagcgagaacagttgacgttaaagagcggttccgtaatgtggaaatcttttaaaaaacgttcatcgcgctgatctctgcacctttttctgcctgatcctggtcttctagtgttcttagcgctactagtagcgccatcaagttacctttcgtaaaagcttgtgacatctcccgtatatctaagacaaacttaaaagtaaacttaacatacttaagtactttttcgtacnnnnnnnnnnnnnnnnnnnncttattatacatggtgagaaaaatatttagtctgtacattgattcgtttttgtattgtttggcatcttgaaatgaatttacatatttgtaaatatttgcaacatcatcagtattcttgccaatttgttgtaaatagaagatgttttcactttatatnttgtaagattaaactactttt

SEQ ID NO: 12877 - DNA, 293 bp, Diabrotica virgifera
cgtacatgagggtcgtggcctgggatcccctgtcggatcatacaataggtgtttagccaatcagcaaagtgaacgtgtatttaacgataggcagttacaattgagatagaatctattatttctatcaaagaaatacacatcatcataaccccgtggatcggggattcttagtttctaactattacagcattattgcccatgtaggagaaggctgaagctctggagctttagtgagacaccaagatttccgagaatcatattgtacctgaatggctttccactactgagacatc

SEQ ID NO: 12878 - DNA, 239 bp, Diabrotica virgifera
  misc_feature (17)..(37): n is a, c, g, or t
  misc_feature (54)..(76): n is a, c, g, or t
  misc_feature (85)..(120): n is a, c, g, or t
  misc_feature (123)..(124): n is a, c, g, or t
  misc_feature (128)..(152): n is a, c, g, or t
  misc_feature (154)..(236): n is a, c, g, or t
atgaaggggtggatcgnnnnnnnnnnnnnnnnnnnnncttatcaagaattctcnnnnnnnnnnnnnnnnnnnnnnnctttttacnnnnnnnnnnnnnnnnnnnnnnnnnnnnnnnnnnnnaanntagnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnngat

SEQ ID NO: 12879 - DNA, 164 bp, Diabrotica virgifera
  misc_feature (13)..(33): n is a, c, g, or t
ccttaagggtccnnnnnnnnnnnnnnnnnnnnngagaggccctttaaggggctctaccaaaagtcatggggagaagaggagaagtgacacaagatggaactgtatctctcttcccctctagaggatacccactccgaatcctcaagagtgtgaccgataccaga

SEQ ID NO: 12880 - DNA, 599 bp, Diabrotica virgifera
  misc_feature (548)..(592): n is a, c, g, or t
tcttttcaaaatgcgtttaagtcattcaacgttcaacaaatgagatactcaacaattgtaccgaaaaatgaaatatctccaattatgactaacagaaatcctagaaatttggaacgattaaggataggttacaaaccagacggataccatttagatgcccccggtaaacgttattggcataagttgcttataaatgtttccgggaaatatattagagcatcaattcagcattttcaaaatggtgaaattatttcagcaagtacatctgaatggtccataaaaaaacaactctataggacaatagacacatgtgcttatacaaatcttggaagggttttagcccagagatgtctacaagctggattaatagaaataagttgtttcataaaacctaatagccctgatgataaaattgctttatttttaaaagctttagaagaagggggcatatctttaactgaacaaccacagtataaagcaagtatgccttgggacctagatcggccagaaaaaccttgggaagttacagaatagtttttattgctaannnnnnnnnnnnnnnnnnnnnnnnnnnnnnnnnnnnnnnnnnnnnataagtc

SEQ ID NO: 12881 - DNA, 99 bp, Diabrotica virgifera
  misc_feature (2)..(35): n is a, c, g, or t
  misc_feature (45)..(96): n is a, c, g, or t
cnnnnnnnnnnnnnnnnnnnnnnnnnnnnnnnnnncatacagggnnnnnnnnnnnnnnnnnnnnnnnnnnnnnnnnnnnnnnnnnnnnnnnnnnnntat

SEQ ID NO: 12882 - DNA, 155 bp, Diabrotica virgifera
  misc_feature (7)..(44): n is a, c, g, or t
taaccgnnnnnnnnnnnnnnnnnnnnnnnnnnnnnnnnnnnnnntgcgacctcgatgtgggattaaaagttataaattgccgagcagctatatttttttagccttgttcgactttaaaaatttttcccgctctggtttttttttccggccgggag

SEQ ID NO: 12883 - DNA, 72 bp, Diabrotica virgifera
  misc_feature (4)..(71): n is a, c, g, or t
aagnnnnnnnnnnnnnnnnnnnnnnnnnnnnnnnnnnnnnnnnnnnnnnnnnnnnnnnnnnnnnnnnnnnng

SEQ ID NO: 12884 - DNA, 896 bp, Diabrotica virgifera
  misc_feature (511)..(529): n is a, c, g, or t
acccacgcgtccgattctttggctcctaggagaacattcacaaaaggtgccacaagttgcaccagatgtgttgcggaaaatggctaaaacttttccagatgaggatgacattgttaagcttcaagtgatgaacctggctatcaaattgtacataacaaatcccgagcaaacctctttgctgtgccagtatgtttgtaacctcgccaaatatgatcagaactatgatatacgggataaagcaagattattcaaacaatttgtgcccaatcaagacggcaaaattaaaactcaagctcttaaaatattcttggctcaaaagccggctcctgatttaaacgtccaacttacgggtcatgaagagttacaattaggctccctgtctcattacattaagcaacgagctaatggatatgaagatttacctccttttcctgctaatccacctactggggatgttaggaacgtagaaccactatcaggggaggaggataaagttcataagagtacggannnnnnnnnnnnnnnnnnntttaactctggatctggaatgtggggaagctgggagtctgaagctagttctggaggcaatagtagtgactatggttctagtaccagttcttcgagtgagagcgacgacatgaatgaggaagatacaagtgaagaagaatcttccgaagaagaaacttctaaaaagggatctgaatctgaagaatcacaatcatccagcgaagaatctagctcagcggatgaagctcctgctaagcaaaaccaaagtcttaattctactaacaataccaccaccgaatctgtagcaaatagcaagaaatccaatttagaccctctcctagaccttgacgacatcgataatccagcaccagttatgaccccttctctag

SEQ ID NO: 12885 - DNA, 801 bp, Diabrotica virgifera
  misc_feature (63)..(100): n is a, c, g, or t
  misc_feature (114)..(151): n is a, c, g, or t
  misc_feature (159)..(329): n is a, c, g, or t
  misc_feature (331)..(345): n is a, c, g, or t
  misc_feature (349)..(367): n is a, c, g, or t
  misc_feature (397)..(416): n is a, c, g, or t
  misc_feature (433)..(481): n is a, c, g, or t
  misc_feature (535)..(558): n is a, c, g, or t
  misc_feature (560)..(573): n is a, c, g, or t
  misc_feature (642)..(663): n is a, c, g, or t
  misc_feature (666)..(678): n is a, c, g, or t
  misc_feature (752)..(787): n is a, c, g, or t
aggtgtccttgaatgcatctattgatttctatttcttgctacttaattccgtatcgtgagagnnnnnnnnnnnnnnnnnnnnnnnnnnnnnnnnnnnnnngccttgcgaatcannnnnnnnnnnnnnnnnnnnnnnnnnnnnnnnnnnnnnaatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnttgnnnnnnnnnnnnnnnnnnngtaattgttaagtaagaattaccgattagnnnnnnnnnnnnnnnnnnnnctgttattagttattgnnnnnnnnnnnnnnnnnnnnnnnnnnnnnnnnnnnnnnnnnnnnnnnnnctctactgtattgagatttacgaatgatgaaaatattagtataaataaaatggnnnnnnnnnnnnnnnnnnnnnnnncnnnnnnnnnnnnnnccagcattttttttcgcctgtttatttataacatggcttttgtgtatgatggataaagtctcgtctgannnnnnnnnnnnnnnnnnnnnnaannnnnnnnnnnnncgctaaggtaacctaatcatttagtgtttttattgcatggtggcaatgaagggttggtagataaaaaaaatgcnnnnnnnnnnnnnnnnnnnnnnnnnnnnnnnnnnnncccaccaaacctta

SEQ ID NO: 12886 - DNA, 489 bp, Diabrotica virgifera
ccaagctaagcacggtgtggtgtggtgttgtgtgttcccgaggctctgtcccagttgtaaaccgctagtttcaaatatttcttgttgcgggaaattgaatctttctgtggtttttaacgtttgttgtgataaaaactgtgtgtatcaaagtgattgcttatcttccaggaatttgttggtatcctgaatattggtttgttggaagaggaaacttttgattctactctctgtaagtagatggtctaaaactaaattacctcactgccgatattcttgcctaaaaatgaccaccatgctggagctggaaagctggataatttatcaatacttcgcaacagaatgtaataattgtctatgaatgtttgtattcgctgattttgtcattgtgtgactgatttatatgatgaatttcattatgactggaatatcttataaagattgttatttttttcttattcaccaaaagaattattgatatcaatatgctca

SEQ ID NO: 12887 - DNA, 831 bp, Diabrotica virgifera
  misc_feature (84)..(99): n is a, c, g, or t
  misc_feature (102)..(137): n is a, c, g, or t
  misc_feature (157)..(212): n is a, c, g, or t
  misc_feature (232)..(249): n is a, c, g, or t
  misc_feature (251)..(317): n is a, c, g, or t
  misc_feature (320)..(379): n is a, c, g, or t
  misc_feature (381)..(776): n is a, c, g, or t
  misc_feature (778)..(830): n is a, c, g, or t
aagtatgaccgagctttagttactgatacattattattattgtgggaaaatattttgtttgtatggaagaaaaatttattgtcnnnnnnnnnnnnnnnnagnnnnnnnnnnnnnnnnnnnnnnnnnnnnnnnnnnnnaatttcaaaaagatcctatnnnnnnnnnnnnnnnnnnnnnnnnnnnnnnnnnnnnnnnnnnnnnnnnnnnnnnnnatattcttttttagatatgnnnnnnnnnnnnnnnnnncnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnng

SEQ ID NO: 12888 - DNA, 367 bp, Diabrotica virgifera
  misc_feature (345)..(363): n is a, c, g, or t
cccacgcgtccgtttttagttgtgagacgtttcaagtaccttcttacggttgttttaattttcatctgaattagaatcaaatgataaaataagtcagacgaagtaatgccataatctaaaagaatgctaagattactatttcgggtagtacatcgttagtaaactccaaattgcctttttgtatgaaaaattcactgtaaagtattagatattattcaataggtattgtataagtcatatgttgatttgcgctgctctgtggtagaaaaatattacaaaatataaatgtcataccaattttctagtaataaaaagaacacatctgtaataaaatctgtctctagnnnnnnnnnnnnnnnnnnnctga

SEQ ID NO: 12889 - DNA, 985 bp, Diabrotica virgifera
  misc_feature (919)..(919): n is a, c, g, or t
  misc_feature (934)..(934): n is a, c, g, or t
aaccgtatcgataccatgttcgtattattattctgtgcagcaatcgtttcggggattttgtggctaatatattctcacagaaactttgtaaacagacgaaaaaagtacttgcagaatgtgccgggaccaaagccgaatcccatttttgggaatatgttggagtttgctggcccctcttacaaaatattggacaccatgaaaaaatttttaacaaatcacggtccgatttgccatatttaccttggaccactgagtgatgctgtgttagtgtcagatgagaaatttatagaatttatccttagttccagtaagattattgataaagctagtcaatacgactatcttcatagttggttgggaacaggacttttaactagcacagggcaaaagtggaaacagagaagaagaacgataactccagcgtttcatttttcaattttggataattttgtagatgtttttaacgatgtaggagaaatatttgttcaaaaacttgaagagcatgtaggcgaagaaaattttaatatctatcctatggtttcattgtgtactttggatattatttgccaagccgcaatggggagtgtccgttaatgcacaaactgatggcaactcagaatacgttaggaatgtaaaggagatgtgcagaattctaaccgatagaaacttttctccactggatccaagtctctacccatttactataaattactataaagaattaaaagctattaaagttcttcatgatcatactgattcagtagttaatagaaaaatagaagagttgaaaaaatccgaggagaaaatcaaaattatgttgacgatgatggcgtaaaaagaaagtttggctttttgggatttgctgttaaagagcacaattaatggaaagccactaagtaaatcagatatcccgagaggnaaagtgacacatttnatgtttgaaggacacgataccacatcatccgctatatcttttgctttatta

SEQ ID NO: 12890 - DNA, 452 bp, Diabrotica virgifera
  misc_feature (20)..(99): n is a, c, g, or t
gcgtatattaaagttgttgnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttaaagcaggccaaaacttcgcctgaatactgtgtgcatggaataatggaataggacctcggttctattttgttggttttcggaaccccgaggtaatgattaataggaacggatgggggcattcgtattgcgacgttagaggtgaaattcttggatcgtcgcaagacggacagaagcgaaagcatttgcc

SEQ ID NO: 12891 - DNA, 882 bp, Diabrotica virgifera
  misc_feature (5)..(767): n is a, c, g, or t
  misc_feature (774)..(810): n is a, c, g, or t
  misc_feature (830)..(843): n is a, c, g, or t
  misc_feature (846)..(861): n is a, c, g, or t
ctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnntgcgacctcgatgttggatnnnnnnnnnnnnnnggnnnnnnnnnnnnnnnnataaagcctgttcgacttttt

SEQ ID NO: 12892 - DNA, 103 bp, Diabrotica virgifera
  misc_feature (2)..(39): n is a, c, g, or t
  misc_feature (44)..(70): n is a, c, g, or t
tnnnnnnnnnnnnnnnnnnnnnnnnnnnnnnnnnnnnnncaagnnnnnnnnnnnnnnnnnnnnnnnnnnncattattttaaaagacgagcataccctatagag

SEQ ID NO: 12893 - DNA, 689 bp, Diabrotica virgifera
  misc_feature (6)..(28): n is a, c, g, or t
  misc_feature (219)..(292): n is a, c, g, or t
  misc_feature (297)..(363): n is a, c, g, or t
  misc_feature (381)..(400): n is a, c, g, or t
  misc_feature (409)..(423): n is a, c, g, or t
  misc_feature (425)..(441): n is a, c, g, or t
  misc_feature (444)..(463): n is a, c, g, or t
  misc_feature (478)..(498): n is a, c, g, or t
  misc_feature (636)..(685): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnnctttttaannnnnnnnnnnnnnncnnnnnnnnnnnnnnnnngannnnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 12894 - DNA, 137 bp, Diabrotica virgifera
  misc_feature (24)..(26): n is a, c, g, or t
  misc_feature (28)..(28): n is a, c, g, or t
  misc_feature (39)..(39): n is a, c, g, or t
  misc_feature (57)..(58): n is a, c, g, or t
  misc_feature (60)..(61): n is a, c, g, or t
  misc_feature (107)..(107): n is a, c, g, or t
cactacaggggccgggaattatannnanagaaaaggaanaggcctttaggggaaaannannggaggaaagaaaagagagagaaaggaggaaggaaggagaggaaaangggagagaccaagaggaaggggagagggaa

SEQ ID NO: 12895 - DNA, 922 bp, Diabrotica virgifera
  misc_feature (898)..(898): n is a, c, g, or t
cgctatctggttaatacaaaaaaagagagatcttggcagtgaacaaaatgtctgctacatttgcgccacagcgtggccctaagcctcctcctgatagtaaaagccttcaaaagctcctggacgaaaacggacatttgatccaagttatacaagaacaccaatcaaagggcaaatcgcaggaagctatacaaatgcagtcgcaattacacagaaatctggtgtacttggcaacgatagcagattctgctcaaaatgttacagctttactaccaatgattcagtcaacaggacctgcacctccccagcaacccaaccacaacccaccaccaaatgatcaacaacataatatgaacaattttaatcatcaacagcaaccagctgcccttaattacaggcaacaaccaggcccacctcaacgtccaggtggtcctccagctccacacccttaccaacaaagaggctatcctcaaggacaataccaaaatcagtatccaccacagggtcccaattatcctccacaaccaccatatggagctcctccaaatcaaccaccaggatatcctccaaatgctccacaaggcaattacggtcaaccaccaacaactgctgctccacataccaattatccacaacaaccaggttatggtactcctcctcccgctacaggaggtgcttctcagcccagtccagctccggctccatatcaacctccagcaaccccagctcaaaaccaaccagctcaatatggagctcctccaaatggtgggcattatcctgctggtaatcctccacaaaattatccaccacaaggttatccgaatccacagggttacgctcctccttctacaaaccagcctaatcctcctcagcctcaaaatattctgctagtaatactcangcgccacctttttcgtcgccccca

SEQ ID NO: 12896 - DNA, 654 bp, Diabrotica virgifera
  misc_feature (2)..(511): n is a, c, g, or t
  misc_feature (518)..(555): n is a, c, g, or t
  misc_feature (575)..(588): n is a, c, g, or t
  misc_feature (591)..(613): n is a, c, g, or t
  misc_feature (621)..(640): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnngtgagtttaaaccg

SEQ ID NO: 12897 - DNA, 852 bp, Diabrotica virgifera
  misc_feature (581)..(598): n is a, c, g, or t
ctatgtttatatttgtaatctccattgcctcccataactttaccaaagtgacactgtcgtatgcctttttcagatatatatacgaaatgaatctcttggtttaccactgttttcttttccatgacttgtgtgattgcaaaaaggtgatcaattgtagatcttccggctctaaatcctgcttgttcttctgcttccatttccttgtattcgtcttttattcagttttcaaaatccttccttatattttgctgattgttggtgtaacagaactacccctgtagttatcacattgttttcgatctcctttttttgtatattgctgacatatacgataatttccattcttgtgggacttctttgttgtcgatgtatctttgtagtagtttccttatgtgctcgtaaagtaaagtcgttaattaaagctacaatgtgtaaagttgtttgcaaagtcgaagtacagggccaacaatcacaggtgtttgaaatgcatgttgggctgcaacagggagatgcgttggcgtgtctccttttcaacataactctggaaaggcggtcagagatgcccgaatagacaacagagnnnnnnnnnnnnnnnnnncatcccaaattttggtacatatatgctgatgatgtggacctagtttcctgtacaacacacaaggtagaagaaatgtttaccaccttctcaaatgtctcaaaaatttggactgagtagacataggagaagcagaaacttctgggtaggccagaggtaggagtaggccaaaactcagatggaaggttggtgtagatgagaatggcagataaataggcgtaccaaactggtaacagtaggcagtggatagaactgac

SEQ ID NO: 12898 - DNA, 578 bp, Diabrotica virgifera
  misc_feature (15)..(15): n is a, c, g, or t
  misc_feature (19)..(19): n is a, c, g, or t
  misc_feature (21)..(21): n is a, c, g, or t
  misc_feature (32)..(32): n is a, c, g, or t
  misc_feature (34)..(35): n is a, c, g, or t
  misc_feature (59)..(59): n is a, c, g, or t
  misc_feature (62)..(63): n is a, c, g, or t
  misc_feature (65)..(65): n is a, c, g, or t
  misc_feature (77)..(77): n is a, c, g, or t
  misc_feature (84)..(85): n is a, c, g, or t
  misc_feature (101)..(101): n is a, c, g, or t
  misc_feature (109)..(110): n is a, c, g, or t
  misc_feature (113)..(113): n is a, c, g, or t
  misc_feature (115)..(115): n is a, c, g, or t
  misc_feature (468)..(506): n is a, c, g, or t
  misc_feature (522)..(522): n is a, c, g, or t
catttaaggggccgntcgntnagggaaaaagngnngaaaaagcttttaaaaaagagganagnngngaagaaaagganagagaannaggagaagagaggaanaaaaaagnnaananaagtcgagatgtggatatgatgaaaatggatgaagaaaggaaaggtaaatgtgatgaattggaagaaaaagttgatgaagtttgtgagaaaattgaaaaatgagttgatgatgttgaatttggatgagaaaatttgtggtgagttataaaaaagaagttggttaaatgtagtaaaattgatatagatgtaattgatttttgtttattagaagaatgtaaagagatttgagtaatgttagagaaaatgtttgatgatgttgtgaaaaaagattggagttttaaggttgaagaagttttggaattgatgaagggatgtgttgttgaaaaagattttgtttagtatttagattgtnnnnnnnnnnnnnnnnnnnnnnnnnnnnnnnnnnnnnnngtttgatggaagtgantaatgtgattaattatggtgaaggtaaggaaatgggttagagttgagattgaaggt

SEQ ID NO: 12899 - DNA, 56 bp, Diabrotica virgifera
  misc_feature (2)..(43): n is a, c, g, or t
cnnnnnnnnnnnnnnnnnnnnnnnnnnnnnnnnnnnnnnnnnngaatttataaaga

SEQ ID NO: 12900 - DNA, 446 bp, Diabrotica virgifera
  misc_feature (69)..(69): n is a, c, g, or t
cacttaaggggccgcaactttaaataatattcgcgataaagctttgcgatagataaaaacaacaatgtncgtctaaaaaaatgaattgggagtagtgcgtgcttcaactttggccagctatgagagttctccatgtcccatcggttctcctatccatcgttaatgggccccaacttggacgctaaaccttctgagctccccaatccccccaattcggatgtggcgctcagcgagtacgacgatgggtacaacaacggtggcttggacgtctgtagtaatgagttcgctgaagttgctaatcgtgagctaataaaccgggagttggttaacttaaaaaatgccgtggtcaacattgacaattcgaaatatgtgattattgtggctgtgactcagataaacgtgataggggatggtaggattggacgaaataagaatgataaaccatt

SEQ ID NO: 12901 - DNA, 140 bp, Diabrotica virgifera
  misc_feature (5)..(139): n is a, c, g, or t
cgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 12902 - DNA, 76 bp, Diabrotica virgifera
  misc_feature (11)..(48): n is a, c, g, or t
  misc_feature (60)..(60): n is a, c, g, or t
gacgagaaacnnnnnnnnnnnnnnnnnnnnnnnnnnnnnnnnnnnnnnagtattaaattnatttatatataaatta

SEQ ID NO: 12903 - DNA, 820 bp, Diabrotica virgifera
  misc_feature (108)..(126): n is a, c, g, or t
cattacgcgtccgatagatgtgtgtagatactattttacagggttaatcattgtttcaatttattattcactgttttttatttgcattacatcctatggagttagtcnnnnnnnnnnnnnnnnnnnttaagggattctagaaacaaataacaaataccaaagagattgtgggcggagagcagccagggacagataatttgagacgaatgctgggggaggctttgactgagcgccatagaagaagagagatcaccgatgacaagaaacatacataatttcattccccatcatccgcatccaagtatctatccctggcagacaccccactataggtcccctaagggatctgccattatccattattataatgtgatctgtcgaggacaatagttgtatttctgcataatttgctataaaggggtcagagttatactgacacatcgcacggctgacccgtattcaatacttaccaatgtctcacatatgtgttaacatttttagacagataccttaacatgattctttttataagcgaaataaatttatgaagtacgatatgtatgctagttgcggaaacaaagaaaaatatgatgccgtagaggtagatgtggctgcctatgatccaagcgaaggattacagatccctagcgaaattttctataccgttacagtaaacttgtgttcaacgtgatacgagctacagtatgacagatgcagccacggataaaattttaacataccttgtgaaaccccattgctcctgtttgcgcactttcgactattaattatttgatgataattaacggaataatatactgcc

SEQ ID NO: 12904 - DNA, 1001 bp, Diabrotica virgifera
  misc_feature (378)..(395): n is a, c, g, or t
  misc_feature (830)..(830): n is a, c, g, or t
  misc_feature (884)..(885): n is a, c, g, or t
catgggacaaggcggacaatgcatggcagatcaaacatcaatgtaaattcaagtgtcaatcagatgtcaaaatgtaagatatgtggaaataaacacaaaaatagttgtaaatataaagattacatttgtaatatatgtaaaaaaattgggcacttggctagggtctgtttggcacataaaaatagtgttaattttatagatagtgaggcggaagaggacatttatacattagacagcatagaatcaagaattgttgatctgtgccatgtacaagtcaaggtagataatccctttaaaatccaggtaaagattgaaggcaaaatatatgagatgatcattgatagtggcgctggtataagtgcaatcacaaaagaaacnnnnnnnnnnnnnnnnnntcattttaggctaaccagtgatgatctgttgctaaaaagttatgaaggtagtgtctcttcaccagagggatattttataatagatatgggctataaaagcaagaaaataccagtaaagctatacgttgttcaaaaaggttctgcaaatattctagggagagactggataaaggccttcaatattaggcttgaaatgatgaatcaaattgtaagtaatagtaaaattctagatctaataaacagtttttcaaacgtatttactagtaagttaggaaactttaatcataaggaaatttcaattaaagttgtggaaaatgctaaaccagttttttgcaagcacagagctgttcctttagcctatgcgaaagaggtagagttagagttagataggttagagaaagagggagtaatagaattaatagacaattcagattngggaacacctttagtctttgttcaaaaatcaatgggaaaatacgaatatggtgnngattacaaaacacaataaataaacatttaaaagatgtgaaatatccactcccaaaaattgatgaaattatggaataaactaaaaaaaagggcaacggttttccaaaaattgattta

SEQ ID NO: 12905 - DNA, 847 bp, Diabrotica virgifera
  misc_feature (4)..(46): n is a, c, g, or t
  misc_feature (52)..(74): n is a, c, g, or t
  misc_feature (265)..(338): n is a, c, g, or t
  misc_feature (343)..(408): n is a, c, g, or t
  misc_feature (426)..(444): n is a, c, g, or t
  misc_feature (453)..(467): n is a, c, g, or t
  misc_feature (469)..(485): n is a, c, g, or t
  misc_feature (488)..(506): n is a, c, g, or t
  misc_feature (521)..(541): n is a, c, g, or t
  misc_feature (679)..(728): n is a, c, g, or t
  misc_feature (733)..(841): n is a, c, g, or t
tttnnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctaat

SEQ ID NO: 12906 - DNA, 210 bp, Diabrotica virgifera
  misc_feature (2)..(84): n is a, c, g, or t
  misc_feature (90)..(115): n is a, c, g, or t
  misc_feature (117)..(159): n is a, c, g, or t
  misc_feature (165)..(197): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnngtggcnnnnnnnnnnnnnnnnnnnnnnnnnncnnnnnnnnnnnnnnnnnnnnnnnnnnnnnnnnnnnnnnnnnnncctatnnnnnnnnnnnnnnnnnnnnnnnnnnnnnnnnncttcaatttaatt

SEQ ID NO: 12907 - DNA, 245 bp, Diabrotica virgifera
  misc_feature (2)..(134): n is a, c, g, or t
  misc_feature (175)..(196): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgattaacaatatattgataattagatagatctatatannnnnnnnnnnnnnnnnnnnnngatgaggttaagagggttatttgagtacactttaacttatgactatacc

SEQ ID NO: 12908 - DNA, 888 bp, Diabrotica virgifera
  misc_feature (356)..(373): n is a, c, g, or t
  misc_feature (665)..(682): n is a, c, g, or t
  misc_feature (802)..(802): n is a, c, g, or t
attcattattatattgattcagagttttaaaacaatgtgattaaaataatttctgaatttaacagattaccacgtaaacaagaagtgtaataggtaacaggcagtatttcatattagaaaccagctttttgggacaaaaatgctggtgataagtttacctatctgaggtgaccaatttactggtcttcaaaggatgcaggtgatcaataatttgttatatctcgcagggtctaatacttttatagggggtataaagcaatgggatcttacataaccataaaaaaataatgaaaattagaaacgtttccagttaaactaaatatttcacttactatgtcgattaataaccaccaagnnnnnnnnnnnnnnnnnncaagtacaaacataattatattattaagacgacttgttaaaaggaaaattattgttgatagaatataaaaattggctaattatttataatacaccagtaagtatcaggtttccacatagaacattgaagaagtcaaagtcaatataaaggtattgaaaactcattggtatccacagtctcagttagtaaggaaattattttgctgatgtaaaatttttgggttctaaaaaattaagtatttgccagttatgctttactacacttaagtggaaattacaaataaattaaatgnnnnnnnnnnnnnnnnnntagaatacacatagtaaaagatcaatgatgttctaacctgtggaaatgttaactacctgtcctactagatagatgtgagtacctgatgatattcatattctacctctcacgctgtggtgntgggaagatttggctactttatatcatggtatttttggaaatggggtaggttttttgtacgtttagttgatatgaacatttatatt

SEQ ID NO: 12909 - DNA, 746 bp, Diabrotica virgifera
  misc_feature (670)..(689): n is a, c, g, or t
cgccccttcttagggtgaaaatcattttataaaaaataactgcacaaatcaataaaacgacaaattaattataagcaacatttgttacataaagttattaaaataagtcaatactttttaagttattaaagatcaaagattttaattattcgtgaaaaaaaatgcatgttttgaagcggtttttcgtaaatcactgaaaaactgtaagtttttacaaaaaaagttaatagtagtttaatttgtataccttatattctaagaataaactcttaaatcacgtgcatttcgactattgagctacaaccccttcgcaagaaaaccatcccatattcccggcttaagagagagttgtacttaatagttatttatgatatacataagtgttaaaagtacaattttaaggcccgcatgtgaaagttttttcacatgagtgcttaaaaatttactttttaacacgtataccatacaatgattttttttacaaacgttataaatttataaaatacaatatttttgttaattgctgaaaccatgaaacctatgacccgtaaaaggtagaactggttgtctacactcgaggggaatgtctaaaaattcttagcgaaaatattataccgctacataaacttgtttttttctacaaacgtgttaaaaatgcaataatgcagtnnnnnnnnnnnnnnnnnnnnccttttgaaccacctttttcaaattgcgcaatttgtactattaatattaatgttaat

SEQ ID NO: 12910 - DNA, 365 bp, Diabrotica virgifera
  misc_feature (2)..(62): n is a, c, g, or t
  misc_feature (85)..(124): n is a, c, g, or t
  misc_feature (129)..(207): n is a, c, g, or t
  misc_feature (210)..(266): n is a, c, g, or t
  misc_feature (271)..(299): n is a, c, g, or t
tnnnnnnnnnnnnnnnnnnnnnnnnnnnnnnnnnnnnnnnnnnnnnnnnnnnnnnnnnnnnnctgcctttatttaatcatcaagnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnncccannnnnnnnnnnnnnnnnnnnnnnnnnnnnttaagggaaacaccgggaatttttttttggggaggtccaaccccgaaaaaaaaaattggccccccc

SEQ ID NO: 12911 - DNA, 904 bp, Diabrotica virgifera
gtttcagagactgtaaaagaagtagtggccttgatatccggatcggtctgtcgccacattgatccggatatggcaggtttgactgtactcccaattaaggagcaactgagcaaaacgcattaaatccaaaatatataattttgagttatcaacaaaaaaataattgaattaaacctaattagaagtaaataaagtaagttgtcaatcgaagtagcacagaaaacgacaataaatattgttcccataccaccagattgactacaggtggaatactttctttggttacacctcctgagattttcaaaatttataaatcatacaggatgccgaggaaattaagatgagagaattttaaataattcacaactcgtctgctcagcgtggtaagagctccaacaagaaagattccttaatactccttaacaaaagagtaaatgaattaaaaatgtataaacattctcaatttctttgcaacacgaaaatgcagcagctgcataatactatggtcaaatctgagagtgcaggaagagtctataccggtttcggggtttgtttcccctcatcagtagtcccatatcctctctcagattcttccacggaccacactttaggcctttccgaattgcaaagaaagaaatgtcgcggatgaactagggccatctaccgaaaaaccaagtaagttatcaatcgaagtagcacagaaaacgacaataaatattgtctccataccaccagattgaccacaggtggaatactttgtttgggtacccttcctgaatttacaaaaattactaatcccaggatggcgaggaaattaagatgagagaatcgtaaaaaattcccaacctcttccgtccagggaggaaaaagctttcaccaagaaaaatttccttaatactccttc

SEQ ID NO: 12912 - DNA, 872 bp, Diabrotica virgifera
  misc_feature (11)..(38): n is a, c, g, or t
  misc_feature (53)..(90): n is a, c, g, or t
  misc_feature (614)..(642): n is a, c, g, or t
  misc_feature (697)..(725): n is a, c, g, or t
  misc_feature (739)..(739): n is a, c, g, or t
  misc_feature (746)..(746): n is a, c, g, or t
  misc_feature (819)..(821): n is a, c, g, or t
  misc_feature (847)..(847): n is a, c, g, or t
atgaatcagcnnnnnnnnnnnnnnnnnnnnnnnnnnnnaagagactcattcannnnnnnnnnnnnnnnnnnnnnnnnnnnnnnnnnnnnnttctcgttgacatctcaattagcagtcagagtgtgtggaatagtgtaaattataaggaataccttgatttaggaatgtccaatgaaagctcgaatgataatgcacctttatcatcatatgccttgatttttatgattgtatgcatcaatagttttttccaaaaacccattgccgattattttacaaattttctaacaactgagcaattagtaactcaaactaaatcaattatcactgaatgctttttgaatgacatcaatatttgcactacaactttcgttgggcctgcatcaaatgttattatgggagaagaacttagaactaatatttgactcatatgcttcattcaagtacttcaataaatatgagatttttataacttaagatacgtatcatatgttgaagttaatccgtaatcaaattgcatcatgatatataaccgataaggatgataaagttatatcttggtgctatattaattctttgcatcgtttacattaatcggaaaaatgcactctactacnnnnnnnnnnnnnnnnnnnnnnnnnnnnngcgaaaaaatgaaggtttttctggtggtgcagatgctctcgaattttgtgaattnnnnnnnnnnnnnnnnnnnnnnnnnnnnnctagtgcaacagcntcgattntgtttaattattgatcactatttttgatcgtttacacaataaatttgttgaacaacaaaccacctataactannnagtaatttagaagaaatgcatgtaanaatagaaagatacgtaatttatatt

SEQ ID NO: 12913 - DNA, 67 bp, Diabrotica virgifera
  misc_feature (4)..(55): n is a, c, g, or t
cgcnnnnnnnnnnnnnnnnnnnnnnnnnnnnnnnnnnnnnnnnnnnnnnnnnnnncattattaatac

SEQ ID NO: 12914 - DNA, 795 bp, Diabrotica virgifera
  misc_feature (2)..(487): n is a, c, g, or t
  misc_feature (494)..(531): n is a, c, g, or t
  misc_feature (566)..(588): n is a, c, g, or t
  misc_feature (596)..(617): n is a, c, g, or t
  misc_feature (647)..(675): n is a, c, g, or t
  misc_feature (693)..(753): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaacgttataattggnnnnnnnnnnnnnnnnnnnnnnntggtcgannnnnnnnnnnnnnnnnnnnnnagtttaaaccggtgtgagccaggttggttnnnnnnnnnnnnnnnnnnnnnnnnnnnnngaaccaaagggaccaaannnnnnnnnnnnnnnnnnnnnnnnnnnnnnnnnnnnnnnnnnnnnnnnnnnnnnnnnnnnngggccccctctaaaagggaccccggggttttaggttgggggg

SEQ ID NO: 12915 - DNA, 635 bp, Diabrotica virgifera
  misc_feature (2)..(381): n is a, c, g, or t
  misc_feature (388)..(425): n is a, c, g, or t
  misc_feature (445)..(458): n is a, c, g, or t
  misc_feature (461)..(483): n is a, c, g, or t
  misc_feature (491)..(513): n is a, c, g, or t
  misc_feature (543)..(574): n is a, c, g, or t
  misc_feature (581)..(617): n is a, c, g, or t
  misc_feature (623)..(627): n is a, c, g, or t
  misc_feature (629)..(630): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattccnnnnnanncaacc

SEQ ID NO: 12916 - DNA, 106 bp, Diabrotica virgifera
  misc_feature (6)..(40): n is a, c, g, or t
  misc_feature (53)..(80): n is a, c, g, or t
  misc_feature (97)..(97): n is a, c, g, or t
gaattnnnnnnnnnnnnnnnnnnnnnnnnnnnnnnnnnnnaagacgagagacnnnnnnnnnnnnnnnnnnnnnnnnnnnntaagttttttagtattnaattattat

SEQ ID NO: 12917 - DNA, 885 bp, Diabrotica virgifera
  misc_feature (777)..(777): n is a, c, g, or t
  misc_feature (852)..(852): n is a, c, g, or t
  misc_feature (875)..(875): n is a, c, g, or t
  misc_feature (877)..(878): n is a, c, g, or t
attaaatattgatgtcaatgtatgcagtaataatttaatagtttattttaaggggagtatctatctgcaagagtagaatttagatatcctaataaggttaagtacaatcaaaccaaagactgaaatattatgaaaattatgtacctattgctgaatttcatataatattgataaaacatacaataagaatatgaatatataacattttcgaaaacgtaggtattaaaattagattataaaaatgagcgatacagaagataaacaagaaaacaccgaacctaagccttctggaaccttactaaatcacttggaaatttcggtgtctgaatctgagaagcgtgtcactggttccttgaatttacgagatcattatactgtgtacctaatcgaaataaaagttactgatccagaatttcagaagaaagtcggcaaattgaccacagtatggagaagatatacggaattcgaacaacttcatgattatttagaagttacttatccatatttagttatacctcctcttcccgagaaaagagttttatatggctggcaaaaaatctctaatgatacatttgatccaaattttgtggatagaagaagagcaggattagaaaatttcttgctcagaattgctgcacatcccttattaacatgggacaaacatttcctagagtttttacaacacgaggaggattggagagagtcatataaagcaaatggatatttgcaattagtagaaaataagttaaaaagtctcagcgtgtcagtacgacttanaaaacccgatccagaatttgaatctatgaaggaatatggatcaactttagctagtaaccttaaacatcttcttanagctcgttctagagttgcggaananncatacat

SEQ ID NO: 12918 - DNA, 905 bp, Diabrotica virgifera
gcaagtttgggtcaatgtgaaacaccaggttgtttaaatccggcaaaattacaatgccctacttgcattaaactgggaatcccgggctccatattttgttcacaagaatgcttcaagagtaattggaaaactcacaaaattatccactctttagccaaaggagaaaatgtagatggaaagaaagaagattcctacaatccttggcccagttattcgtacacagggaagttgagaccttttccacaatcagccaaaagaactgtaccacctcagattcaaagaccagattatgcggatcacccacaaggatatcctcttagtgaacaagctgtcaaaggttctggactcattaaagtgttggatgatgaagaaattgagggcgttaaagtagctagcagactaggcagagaagtcatagatgaagctgcaagagtatgtgatgttggagtaactactgatgaaattgatagaatagtacatgaggcttgcattgaacgtgattgttatccatctcctctaaattattatgaattcccagcatcgtgctgtacgtctgtcaatgaagttatttgtcatggaattcctgatagtagaccacttgtggatggcgatttatgcaatgtagatgtcactgtttatcacagaggcttccatggtgacttgaatgagactttctttgtgggaaatgtcagtgagaagcataaaaacttagtaaaggttactcacgaatgtctaatgaaagctatagatattgttaaaccaggagaaaaatatagagaaataggtaatatcattcaaaagcatgcccaaagccatggctatcaggtgggtaggagctactgtggtcatgggatccataggttattccatacagcacccaatgtaccccattatgcaaaaaacag

SEQ ID NO: 12919 - DNA, 880 bp, Diabrotica virgifera
  misc_feature (31)..(70): n is a, c, g, or t
  misc_feature (170)..(193): n is a, c, g, or t
  misc_feature (409)..(432): n is a, c, g, or t
  misc_feature (445)..(462): n is a, c, g, or t
  misc_feature (496)..(518): n is a, c, g, or t
  misc_feature (742)..(742): n is a, c, g, or t
  misc_feature (745)..(762): n is a, c, g, or t
  misc_feature (828)..(828): n is a, c, g, or t
  misc_feature (835)..(835): n is a, c, g, or t
  misc_feature (844)..(863): n is a, c, g, or t
cctcgaataaataatataagattttgattgnnnnnnnnnnnnnnnnnnnnnnnnnnnnnnnnnnnnnnnntagaaaggggggttggtaccggatgaacagtttacccgcctcttcatcaaatattgcccatggaggtccatcagtagatttagctatttttagattacannnnnnnnnnnnnnnnnnnnnnnnaggtgcaattaattttattacaacagtaattaatatacgaccaataggaataacctttgatcgaatacccctatttgtttgagctgtcgtaattacagcaatccttcttctattatctttaccagttttagctggagctattacaatattattaacagatcgaaatttaaatacatcattttttgatccagctggtggaggggatccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttgggaatggatgttgatacccgagcttattttacctcagcaactataattattgctgtaccaactggaattaaagtatttagatgattagctacttatcatggaactactattacatatagtccagtaacctctgagcttntannnnnnnnnnnnnnnnnncagttggaggtttacagggggtagttttagcaaactcctcaattgatattgtacttcatgattacntattatngtgttgcannnnnnnnnnnnnnnnnnnntaataggagctgtattt

SEQ ID NO: 12920 - DNA, 322 bp, Diabrotica virgifera
  misc_feature (7)..(99): n is a, c, g, or t
  misc_feature (110)..(132): n is a, c, g, or t
gactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggaaatttattcttat

SEQ ID NO: 12921 - DNA, 840 bp, Diabrotica virgifera
  misc_feature (6)..(28): n is a, c, g, or t
  misc_feature (218)..(291): n is a, c, g, or t
  misc_feature (296)..(361): n is a, c, g, or t
  misc_feature (379)..(397): n is a, c, g, or t
  misc_feature (406)..(420): n is a, c, g, or t
  misc_feature (422)..(438): n is a, c, g, or t
  misc_feature (441)..(459): n is a, c, g, or t
  misc_feature (474)..(493): n is a, c, g, or t
  misc_feature (631)..(680): n is a, c, g, or t
  misc_feature (685)..(787): n is a, c, g, or t
  misc_feature (791)..(791): n is a, c, g, or t
  misc_feature (809)..(809): n is a, c, g, or t
  misc_feature (813)..(815): n is a, c, g, or t
  misc_feature (823)..(839): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttnaatctaatttttatttanaatnnnaatttatnnnnnnnnnnnnnnnnnc

SEQ ID NO: 12922 - DNA, 940 bp, Diabrotica virgifera
  misc_feature (20)..(41): n is a, c, g, or t
  misc_feature (625)..(625): n is a, c, g, or t
  misc_feature (644)..(689): n is a, c, g, or t
  misc_feature (824)..(824): n is a, c, g, or t
  misc_feature (923)..(923): n is a, c, g, or t
agagtggtgggtggatatgnnnnnnnnnnnnnnnnnnnnnngaagaattttcaggataaaagagcttctatagctttagcgaaaaattcaacagtaattaacgatgagatctttaaaaaacaattagaaaattgctttcaatttttaactgaaaggaaagagattcatgctacaaacaatctgtataattcaaaacctgatatcattaaagaattttatgcttcccttttaacagttactacagattttatcagacaaaatgttaatagagaagacattacattctttttacatgatgagtgtggtttatcttcggaacgaacaaacctttatataagcatgttggaggaaaagaaatgtcaactacagatagctttattaaatattggaagtgctttaccacacgttactgatataaagtggaaaatagactacatagtaaagtctagtgaagtggaatctgcggaagggcccctatttaggatatgtttgattggtgaacagtttgatatggaaaaggatagtaaagttttaaagcccattcatttcacctgcaactcagtagaattactagatttaatttataagtttaaagatgctcttagacactgtaactcagtaacancagagggttttctaatgtnnnnnnnnnnnnnnnnnnnnnnnnnnnnnnnnnnnnnnnnnnnnnnttttactatgtaaatatcaatattaaatttaagtgattacattgcattacattatagtaggggagcaaagtatgctaaatgtgcagtcactcgagcactttggggacctattgggttgtgaagagtaggtcctanaaccaaaaaaagttaagtaaagtttttcattttagtgggctcttacccatttttaatgtaattttccatttccccacatcattttttcagattatagcngcatctatctataattc

SEQ ID NO: 12923 - DNA, 683 bp, Diabrotica virgifera
  misc_feature (168)..(185): n is a, c, g, or t
  misc_feature (250)..(264): n is a, c, g, or t
  misc_feature (663)..(681): n is a, c, g, or t
cattacgcgtccgggtattcaaactcatcatcttcgttgcacttgttgcctacgtacacgcaggaatttacggcgaatctttaggaagtcttcccattgaaagtccagtaatatctgcatattcctcacctttgtccgtaagatctgtgctatcctctcaactgctgnnnnnnnnnnnnnnnnnnacttcacctttatacagcagatccttacctacattctcctatggcgcatcagttccagttatttnnnnnnnnnnnnnnngaactgtatctcctcttccagtagcatcacttccatcccttgtgtcagcgccagtattaacaagaggatacgctccatcggcttcccttatttcagctccagttctaagaagcgttccatctctacccttattaccagctccagttctttctagaagtctttcagtaagcccgttactaccaacagtgatttctaggagagtttctgtaactccacttttaccagctccagttatatctagaagtgtttctgtaagtccactagtgtctgctccagtattgtcaagttacgctgccagtgctcctttactatcggctccagtgtcttggtaggaaaattatatctgattttatgttaacactatattttttgtatagtatagaatatattttgttgtannnnnnnnnnnnnnnnnnnct

SEQ ID NO: 12924 - DNA, 151 bp, Diabrotica virgifera
  misc_feature (10)..(92): n is a, c, g, or t
  misc_feature (98)..(140): n is a, c, g, or t
gaagggttgnnnnnnnnnnnnnnnnnnnnnnnnnnnnnnnnnnnnnnnnnnnnnnnnnnnnnnnnnnnnnnnnnnnnnnnnnnnnnnnnnnngacccnnnnnnnnnnnnnnnnnnnnnnnnnnnnnnnnnnnnnnnnnnnaattatttata

SEQ ID NO: 12925 - DNA, 199 bp, Diabrotica virgifera; identical to SEQ ID NO: 8259
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t

SEQ ID NO: 12926 - DNA, 832 bp, Diabrotica virgifera
  misc_feature (722)..(722): n is a, c, g, or t
ccttacgcgtccggttttataaccactgtaccgatggggttcaatagtgattgtaacgtttaatcgaaccttagaaaatccgcatatgaacgaaattctaagttttagttgaatttaaaccagaggtcatcatgaaaacagtattaatcgcagcagtaatctgttgttggttttataataaggctctctgtggcgttcaagatgattggaacaactttaaaaccaagtacaacaaaacatataagaatgaagttgaagaaaatgagaaatttaccgttttcaaggataacctagaagaaatccgccgtcacaacagccgctatgaggatggtttagaaacgtataaaaaaggtattactgttttcgcagatttaagtaaaagacaatttgacaaaaagtatcagctaagcagacctggagtaacgagtataatatatccaaaaacctggaaaacccgtcaagtagatagaaatttaaccacggtctatgtagactggagaaaagtaggtgccgtcactccagtgaagaatcaaggaatatgtggagcatgttggatatttagtgcagttggaattttagagagctaccacttcagaaaaaccggaaagctaatatcccttagcgaacaaaatgtagtcgattgcatttctaagtattcgtgttctggaggaattccacaagacgcccttacttacatacaaaaaaatggtgtaggttacggnaagttgaatatccctatgaagataaacatatgggcttgtaaaccttcatctaataagacacacatcgattttaaatcgtatcagtttatcaatgagacagagcaacactt

SEQ ID NO: 12927 - DNA, 198 bp, Diabrotica virgifera
  misc_feature (7)..(44): n is a, c, g, or t
  misc_feature (107)..(128): n is a, c, g, or t
  misc_feature (162)..(186): n is a, c, g, or t
taacagnnnnnnnnnnnnnnnnnnnnnnnnnnnnnnnnnnnnnntgcgacctcgatgttggattaaagttataattgggtagcagtatattattaagtctgttcgannnnnnnnnnnnnnnnnnnnnnagtttaaacggtgtgaggccaggttggtttccannnnnnnnnnnnnnnnnnnnnnnnngacgaaaggacc

SEQ ID NO: 12928 - DNA, 60 bp, Diabrotica virgifera
  misc_feature (2)..(42): n is a, c, g, or t
gnnnnnnnnnnnnnnnnnnnnnnnnnnnnnnnnnnnnnnnnnttattgtgtagttaagag

SEQ ID NO: 12929 - DNA, 868 bp, Diabrotica virgifera
aagatatttatattttaaggaccttaacgaaacatatgtctcctcctgacgtagcggaaaagacaatcaccaaagaagcctcagaaaacatcaatgattccagcattttcgctagtttggaagaattaatctattacgaggaaaagaacgttatagatttgttaacagtcacgctgcaggcagctccagaaatgctgggacacgacggtgttagaaaatccaaaaattcaggtgtgaaaaaaatcagtccaaaggctagggaaaaagtactggaatactatgaacaaatcttatggggagaggttggtaattttttggaacacgttgtactctggtggtcagcatcgcctttatccgcaagaccgccccattcgagtcagcatttgagggaatggatagtacaatttattccgacagctgacgtatcccctgttgttctctcggctttggcaagtctcgcagacgcgctgggtgttcacgtagcttcaacgtcttgggatcagaattttcgattggctttggtttcttccaaagcaatttacaacccagaaactggcaaactttatgccaacgttttacaggatctagttgtgttgtgcaaccaatgcgagaccactcccgattggttcgttggagctccattggatgaactaccattggttgaacaaattcctgtgttgcatcgattagatcattctatacacacaactaggttgtggtccatcaacgaatgtaagaaactggtgaacgcttggaacgttagtgcatttttcacagtgattcatgataatattgtcgactgccttagtcaactccacaatttacgccttgctgatcacgccggcgagatcgagaagaaaaatttggg

SEQ ID NO: 12930 - DNA, 995 bp, Diabrotica virgifera
  misc_feature (776)..(796): n is a, c, g, or t
attatttatttgcacctactggtcatgagaacaaggaaactaagttcctttttttttatcagtgtttgtgtttcagttttcagtactaaattacgtgtagttgaagtgaggttacaaacgttttaaatttaaaagggttgaatgatagtacatacatatttcaatttgtgtacttaatacttcttaaggaaaactaaacaaagtattatctgcaattgcaacatggaccttacaaaactaaatattttaaaaagatcaaggataattcatttgtgtatggcaatcacattttttacatcaggagtgatagttaactttatgcagtgtattctttatttaagtcttagaccatttaacaaatggttatacagaaaaattaactggtatttgtcttatacaatttattcacaattagtatgcctaggtgactggtggtcccaaacagaaataattatctatgtagataaaaccgtttttgataaatattttggaaaagaacacgcctacttggtcatgaatcacacatacgagatagattggcttataggttggatgatatgtgaaagaatacacgtcttaaggaattgcaaagcttatgcaaagaaagtcattcaatatataccagttttgggttgggcttggaaatgctcagaattcgtatttctagagagaaattttgaccaagacaggaaagttatatataaaccaattaccgaatttccccgaaacatcctgatcctatatggctactactctttccaaaaggactcgctttnnnnnnnnnnnnnnnnnnnnnttgcgaatttgctgcaaaaatatttaccactataaaaaacctttgttcccccaaaaaagggtcctagctagttcccatcaatgaagggaaagaggctggtattttcatattgaagttgcgtttaaaaaaaatggccccttttaaccggcctttttttttcttttttcaaacgaaaccccacaaacctccctcttttttt

SEQ ID NO: 12931 - DNA, 694 bp, Diabrotica virgifera
  misc_feature (2)..(3): n is a, c, g, or t
  misc_feature (618)..(648): n is a, c, g, or t
cnnttaagggcccgcggaatctttttattataaagtgattccttttgagtagtaagagaattgtaattttatgtgtactgatagttagtgggggttgaagatccaatatataaatcccagaaatgagatatttaggccttagtaccgcgcagatgtagtgattagcaatgatcacatgagtaatttcagtttgctatcacctaaagctgcaaagtttacatctaaatgtacatgtacaaagggatctttttgtacggagaggagtatcgtttcgcgttgttcctaatattgtgaagaaatgacgaaacattcgctgtattaccaatatagtaaagattgaagatgttcacattatatagtattaagcatttacaaggatgagttgttgaggctaaaattttagtaggacttaatgtttaaatgagaattacgagtaaaaattcccagatcgcaaattatgcaattagttagtattatatattattacttttagttgacatgagttgctaattacgatataaaattatagttatctaagtagagtaacgataaaaatataaccatgaaaacattgcatatcgagttagactatataggattactaaaggaattcgagcnnnnnnnnnnnnnnnnnnnnnnnnnnnnnnnatcttttgtggttaagtgtatacactcggctgcccactgattaatt

SEQ ID NO: 12932 - DNA, 946 bp, Diabrotica virgifera
  misc_feature (720)..(737): n is a, c, g, or t
  misc_feature (793)..(793): n is a, c, g, or t
  misc_feature (863)..(863): n is a, c, g, or t
aataaaatgccgatttttgtctatgatggcacacttcagggtatccaatgatggcataggtatgcaatcatagaaagtccagaagaaaagcgtttataagcatccattattcactccaaaaatactaatgatgaaatatcttcgaactctgaaattaaaatgccaaaagttaatgtgcgtggaccttcatttgtacaaaaaataaggtccagtattgtaaaattataaacctcttttaaaccagaaaatgaaaaaagcgaaaacgtgagaagaacggtatgctcaattctaccccagacctgatttgagcttagacagaagtaagaagaaaaagcaatttaataaagaaaaatctgccaagaagggtcacgaagaaagttttcgtgaaaaaaatagcagttaagaagaagaacaacaagcggaattctggaatgatcttaaagacgacaacgctgatgtcgattgtttgcattataatgaactgtactgtctatctaaatcaaaataaatatggattccgtgtcagatatgccattcatggtgccatgcataatgtgcgatgtggaaaaaagtaaaacattagtagaaaattacgaatgtatgttttaatttttgttgttatttttcgtaataaaacataaaaaattaagttcttttgttttaaataaaatggtgtgccatcataggaaacgtgttacctatgatggcatacttgctaannnnnnnnnnnnnnnnnncttgcaaaaaacgttcaaaatcaatattatattgtacaaaacgtaaaatgtagctnaaagtcgaattacttggcccacaaaaatgcttagaaaattttaatacacttaaaaaattgagtaaaatangtagccatcataggcgacttcccctatattttccttctgttccctctgcataaattttaaacattctgtataatttgacggga

SEQ ID NO: 12933 - DNA, 979 bp, Diabrotica virgifera
  misc_feature (827)..(827): n is a, c, g, or t
ccttacgcgtccgcaaattattattgtagaagttgctcgactaaatgaactgtgttgttgcgctttaggtgattgtgaagtaaaagtgctaccaagaaagtgttttcaaatagtttcaaattaacgagcgttcaataaaattaaagaaatgccgatggttaagcgtgactacagtaacgaagaacttgaaaagtggttggacagggattttaccagtgtgtttagatcaggatatgtaaatgtgaaaggggtaacaatgccgaggaggtttgaggaattgcaaagtgatatttttaattggaatgtgagtgagagggacgtttggatatgtagctttccaaaaacaggaaccacttggacgcaagaaatggtctggatgatcatgaataacttggacatcataaaaggtcaggaaaatttgggcattcgatcgccatttttggaagtcactgctctattcgactacaggaaatttcaaaaggagaatacggatttccaacctcccccatttattgaagactctttgaaatttgtaagagagaaaagccagaaaggtcctttatgcctgaaaactcacttgccctgggtgctgataccgcaagaaatacaaaacaatacaaaacaaccaaagattatatacgttactagaaatccaaaagacacatgtatttcatattataaccattcaagattaatggaaggatacagagggagttttgaagaattttgtcagctatttttggccggaaaactaaccttcgcaccgtattggaatcacgtcctgccattttgggagaaacgaaaccagccaaatattttattcttanaatacgaaaagatgatccaggacctgccttccataataaaagaagtcgccgactttctcgaaacacccctcacccccgagcaaatcaccacgttatctgatcacctgagtttcgaaagtatgaggaaaatccagcggttaactaccaaatga

SEQ ID NO: 12934 - DNA, 211 bp, Diabrotica virgifera
  misc_feature (2)..(91): n is a, c, g, or t
  misc_feature (93)..(106): n is a, c, g, or t
  misc_feature (108)..(149): n is a, c, g, or t
  misc_feature (151)..(172): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnncnnnnnnnnnnnnnnnnnnnnnnnnnnnnnnnnnnnnnnnnnncnnnnnnnnnnnnnnnnnnnnnngaaaaaaagctgtcttcatttaattaataaggaatttta

SEQ ID NO: 12935 - DNA, 596 bp, Diabrotica virgifera
gctttatgcttggcaaatgataaaattataaatactgatatatcagtatacagagacttaaaaattcctctccggtgacctttttcacctctgcctctgtcgcgtcgtgtcgtgacttccttgtatctcccgaagtttaggaaaaattcaaatattcaagtgaaaaatgtctgagcaaaagactatccctaatgttttaaaattcgtgtttggagcttctgcaggaatgggagcgacctgcttcgtccaaccgctagatttagtaaagaaccgaatgcagttgagtggagttggtggaaaacccaaagaatacagaagtacattacatgcaatacaagtgatagttcaaaaagaaggcgttttctctctatacaatgacttatctgctggacttttaagacaattaacatacacaggcacaagattgggagtgtatacctaccttctcgacaacttcaaatctgccgacggaacaccacctggtttcgttggtaaaatgctgatgggaatggtggcgggaggttgcggcgcttttggtggtacaccggcagaggtatcccttattccgtatgacagcagatggacgtcttccattg

SEQ ID NO: 12936 - DNA, 337 bp, Diabrotica virgifera
  misc_feature (11)..(114): n is a, c, g, or t
  misc_feature (125)..(147): n is a, c, g, or t
atcgcgagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctttcgtannnnnnnnnnnnnnnnnnnnnnngataaaaaccaacctggctccccccggtttaaactcaaatcatgaaaaattttaaaagtcgaacagacttaataatatagctgctaccccaattataaactttaatccaacatcgagggcgcaatctttattatcgatttgaactccccaataaaattacgctgttatccctaagggaatttattcttat

SEQ ID NO: 12937 - DNA, 79 bp, Diabrotica virgifera
  misc_feature (3)..(78): n is a, c, g, or t
acnnnnnnnnnnnnnnnnnnnnnnnnnnnnnnnnnnnnnnnnnnnnnnnnnnnnnnnnnnnnnnnnnnnnnnnnnnnng

SEQ ID NO: 12938 - DNA, 623 bp, Diabrotica virgifera
  misc_feature (13)..(453): n is a, c, g, or t
cctccgcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgttagatgtccccttgtgtgttcatcttattattcaattttattatgctgctgagttactattataatagtggaactcagtgttgatatgtccgcttctgaagggttttctgggccgttttttctccgggttattaaccccatgtctttttgcagaacttttattt

SEQ ID NO: 12939 - DNA, 963 bp, Diabrotica virgifera
  misc_feature (590)..(679): n is a, c, g, or t
  misc_feature (845)..(845): n is a, c, g, or t
  misc_feature (904)..(905): n is a, c, g, or t
gtcccttctagcgtccgccacgcgtccgcctgccagtagtcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaagggcggtccaactcaatcccgccgcggtgctcttgactgagtgtcgaggtgggccggtacgtttactttgaacaaattagagtgcttnaagcaggccaaaacttcgcctgaatactgtgtgcatggaataatggaataggacctcgnntctatttttgtggtttttcgaaccccgaggtaatgattaataggaaacggatgggggc

SEQ ID NO: 12940 - DNA, 72 bp, Diabrotica virgifera
  misc_feature (2)..(32): n is a, c, g, or t
  misc_feature (43)..(62): n is a, c, g, or t
cnnnnnnnnnnnnnnnnnnnnnnnnnnnnnnncaaagacgagnnnnnnnnnnnnnnnnnnnncattattcac

SEQ ID NO: 12941 - DNA, 1046 bp, Diabrotica virgifera
  misc_feature (6)..(7): n is a, c, g, or t
  misc_feature (17)..(19): n is a, c, g, or t
  misc_feature (94)..(94): n is a, c, g, or t
  misc_feature (97)..(97): n is a, c, g, or t
  misc_feature (291)..(291): n is a, c, g, or t
  misc_feature (540)..(565): n is a, c, g, or t
ggtccnnggaattcccnnngggtcccactctctacgcggctccgatatattaaaatcaatgaaagatagtcttcttgcatatacactatgtacnaangaagaagagtctattcatattcaagtggagtgatgtatatatatatgaaatctagaagaagaagacataatgttacatttatattaatgaaataggagaaaaatctatagtatctcttatgtaacactatgaatgatatacaaggatatataatttaaatgtagaataaattgattattactcataatgtgatnttgtacgtagcttttaaaaataactctaagagaagataagaattattgtatctgaacaaaaaatatttaaagtatatttgtttgagatgaagtgggattcaggtttttctgtatctacctctttatactttaagataaattcctttattagacaaacatatacataaatatatatagcgatattaataccattcatcacttatggagatgaagctttgtgccttacttttattaatgattaatttctgnnnnnnnnnnnnnnnnnnnnnnnnnncatattacatgatccgatcttattaactaggatatatactaattctgatgaatcacgaaataataaatctaatgaaaggatgaagatatattgagattcattatgacacataaggataaaatgtattggccacatcctacaaagagaatctgatgcactaattaagcagataccaaattgtacgccactactaaacagacctagaggaacaccgaaaataagatgtgaagacccactgcgagaggatatatccaatatggaaattacaggctggagagaaaatatacagaataggaaagaatggaaacagattacagaaaaagcaaaaaaacacgaaaatctataaaggataatgaagaggaattatgcggaccaatccaccgcatgaaatggattaaaagagctcatgaacctgagcgacctatactctatactagagtgaccggtcaatatataaatggtgataatataaggctcgatt

SEQ ID NO: 12942 - DNA, 197 bp, Diabrotica virgifera
  misc_feature (17)..(17): n is a, c, g, or t
  misc_feature (22)..(22): n is a, c, g, or t
  misc_feature (33)..(68): n is a, c, g, or t
  misc_feature (70)..(116): n is a, c, g, or t
  misc_feature (124)..(182): n is a, c, g, or t
gttaaaagcttaaattnttttnaaagacgagannnnnnnnnnnnnnnnnnnnnnnnnnnnnnnnnnnngnnnnnnnnnnnnnnnnnnnnnnnnnnnnnnnnnnnnnnnnnnnnnnnggtgattnnnnnnnnnnnnnnnnnnnnnnnnnnnnnnnnnnnnnnnnnnnnnnnnnnnnnnnnnnnatccccatttttttt

SEQ ID NO: 12943 - DNA, 881 bp, Diabrotica virgifera
  misc_feature (744)..(744): n is a, c, g, or t
  misc_feature (781)..(781): n is a, c, g, or t
  misc_feature (821)..(821): n is a, c, g, or t
  misc_feature (874)..(875): n is a, c, g, or t
  misc_feature (877)..(880): n is a, c, g, or t
atattggataaagtgttaggtaacaataataatcgtcttaaaatgtatttaaggccacttttatcccaattggctcgcaataagcctttgcaaacatctctagtacaacatgccagccgaactctatcaaccgaagttgacagcaagacagaaactaggcccacagtaagaaaacccaatttagtagcaagatcatcactcaccgattttggtaaatatgtagctgaatgtctgccgaaatatgtggagagggtacaaataaccgctggagatgagttagaagttttgattgtgcctgagggaattttaccagtgctgcagtttttgaaagatcaccacaattcccaattctcaaacttggctgatattgctggtatggatgtaccatctaggccatatagatttgaaattatatacaacatcctgtccctcagattcaattcaaggattcgagtgaaaacttacacagacgagttaaccccagttgagtcctgtaatgacatttacaaagctgccaattggtatgaaagagaaatctgggacatgtacggtgtcttcttctcaaatcatccagatttaagaagaatcttgaccgattatggattcgaagggcatcccttcaggaaagacttccctctcagtggatatgtagaagtgaggtacgatgatgaaaagaaacgagtcgttgttgaacccttggaattagctcaagagtttagaaagtttgagctgagtgcaccttgngaacaattccctaattttagaaatgcaaatcccgctntcagaaagaaagtgatatatctaaggataagaaataaaanaattgtatttaattaattatctgtatatttcataatagacatataaaatattnnannnna

SEQ ID NO: 12944 - DNA, 1002 bp, Diabrotica virgifera
  misc_feature (17)..(971): n is a, c, g, or t
  misc_feature (973)..(996): n is a, c, g, or t
gtccattttagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnntttttt

SEQ ID NO: 12945 - DNA, 81 bp, Diabrotica virgifera
gaattaggtagttcttgtgagttatactttattttcagtgtaatactatttcttacgtaataaattagttaatattaactc

SEQ ID NO: 12946 - DNA, 195 bp, Diabrotica virgifera
taacagcgtaattttattggaaagttcaaatcaataaaaagattgcaaccccgatggtgggattaaaggttaaatttgggggaaccagctaaatttattaaggttgggtccaattttaaaaatttttcaagggatcggagttttaacccgggggggggcccccgtgtggggtctttttacctctttttttttatt

SEQ ID NO: 12947 - DNA, 264 bp, Diabrotica virgifera
  misc_feature (5)..(46): n is a, c, g, or t
  misc_feature (52)..(74): n is a, c, g, or t
tttgnnnnnnnnnnnnnnnnnnnnnnnnnnnnnnnnnnnnnnnnnntcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttat

SEQ ID NO: 12948 - DNA, 1174 bp, Diabrotica virgifera
  misc_feature (857)..(882): n is a, c, g, or t
  misc_feature (890)..(890): n is a, c, g, or t
  misc_feature (893)..(893): n is a, c, g, or t
  misc_feature (905)..(925): n is a, c, g, or t
  misc_feature (930)..(930): n is a, c, g, or t
  misc_feature (940)..(958): n is a, c, g, or t
  misc_feature (991)..(1011): n is a, c, g, or t
  misc_feature (1136)..(1159): n is a, c, g, or t
aaatattagagaaagtctaaaaaacaaatgtttaggaaacgaccaaataacatctgagatgttcaaatatggaataagcagcaagcatgaagagatacaaatgttaaaaatacatgaaatgaagaacaattaccaaaaaaatgttcggaagcaataatatgtcccattcacaaaaaaggagatcaaaatgaatgcaaaaaatacagtggcattgcattgctcaacgtcgcatacaaaatattggcaatgcatacaaaggatatactaaaaaaagaatggaagatataattgatgaacaccaggttgactttagacaaagaagaagcacaactgaacagattttcctgctgatagagatactagaggaaggggaaagcaagaacaataaatccaagaagaaagcaagaacaaggaaaatatttggaggaaaaaatggagaacggcgttgggatcagaaagataaattaagatctgagagttatatggggagtccaacatactgggctccagaacccaatgcctaagatgtctatgacacatacagaggatgccagacggtagactaccgaaaatgctactgtcaagtacactaggaggacgtcagagaaaagaccgacgcagaacaaggtggaaaaaatggatgtagaagcagatctaaaaaggctcgatgtaataaattgaaggatgaaagcaatggacaagaaggaatggagtagaatggtcaaccaagccttgggcataataattattacttattgtgaactctatttgttcgaactttaatatgtttacagtatatgtataataaacattagataaaaaaatctacgtgaaagcattcgaatcattttgtagcnnnnnnnnnnnnnnnnnnnnnnnnnncatatggnctntcattacctgcnnnnnnnnnnnnnnnnnnnnnataantaaaaaatannnnnnnnnnnnnnnnnnnagtgaaaagtgttaagatcaatttgcgaatacnnnnnnnnnnnnnnnnnnnnncttagaaacttcctagtaatatttattttctagattacttttaatggtttgcgatcccttttgataaattttccccaagtttttttctgtgcttgggtcccaatgaaaacccgaaatcaaatttnnnnnnnnnnnnnnnnnnnnnnnnctccgggatataggg

SEQ ID NO: 12949 - DNA, 990 bp, Diabrotica virgifera
  misc_feature (14)..(137): n is a, c, g, or t
  misc_feature (146)..(603): n is a, c, g, or t
  misc_feature (606)..(606): n is a, c, g, or t
  misc_feature (609)..(983): n is a, c, g, or t
tccccctaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattttt

SEQ ID NO: 12950 - DNA, 922 bp, Diabrotica virgifera
  misc_feature (746)..(746): n is a, c, g, or t
  misc_feature (819)..(819): n is a, c, g, or t
ctctacgcgtccgattgcaaatttaaaagtgatttaaatggaattttgcaaaaagtatgaaataaaagtgatatctacaagtaggcatttctgattaaaaaacagtattttaccgagtaaaataaaaattggacatggaacttccaaccgacagttattacagctcacaagcttgcaatgaaatcattaatgatatcgaagacttaatttctgcacaggatattacaccaaaagaaaggtacagtagccgtaaaaatgtaaaagttcaagccaaaagaaagaataaaattgaagttttacctcttatacctgtgggtgaaaacataccaggaactcaaaatatttatataggtacatggggatgtgcacataacagctcagattcggaatatatggccggacagttggctgcatatggttataagttgacagagaataagagtgaagctgatctaattttattgaatagttgtactgttaagagtccagcagaagatcatttcagaaatgagatagaatctgctaaaaaacaaggtaaacacttggtacttgctggatgtgtacctcaaggagctccaaaatcatcctttattcaaggtctaagcataataggtgtacaacaaattgatagggttgttgaagtagttgaagaaactcttaagggcaacacagtaaaattgcttggtaccaaaaaagaaaacggcaagaagaatgggaggtgcttctttgcttttaccaaaagttanggaggaatccactcatagaaattatagctataaataccggatgcctcaaccaatgtacctattgcaaaactanacatgccagaggggagatttaggtagttacccacccgaagaaatcgttgctagagcaaaacagttttttgaagaagggggtagttgaagatctggttgacctc

SEQ ID NO: 12951 - DNA, 1048 bp, Diabrotica virgifera
  misc_feature (2)..(132): n is a, c, g, or t
  misc_feature (134)..(362): n is a, c, g, or t
  misc_feature (366)..(423): n is a, c, g, or t
  misc_feature (664)..(694): n is a, c, g, or t
  misc_feature (704)..(730): n is a, c, g, or t
  misc_feature (935)..(952): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagannnnnnnnnnnnnnnnnnnnnnnnnnnnnnnnnnnnnnnnnnnnnnnnnnnnnnnnnncatttttgtgattatcataatagattaccttagggataacagcgtaattttattgcagaggtcgaatccatctttgagattgagacctcgatgttggatgaaagattcatcctcattgtcgatctgatatgagtaagtctggacgactctataaattctacatgatctgagatcaaaccggtgtgagccctgctggagactctctcttgtgtagtaaaatatttctagcacgaaaaggacnnnnnnnnnnnnnnnnnnnnnnnnnnnnnnngaataaatannnnnnnnnnnnnnnnnnnnnnnnnnnggccccccctccgaggattccaaggcttacgttacgcgaggattggaaaggtcctaagctccctctaataagggcaccctaaaatttaaaattcctgggcccgccggttttaccaacgggggtggactgggggaaaacccctgggggttaccccaattttaataccccttggccagaaattcccccccttttccccagtgtgggnnnnnnnnnnnnnnnnnnccccccccccaacccccccttccccaaccatttgggccaccccggaagggggggaagggggggggcgccccccccccctcgggggcccttattaac

SEQ ID NO: 12952 - DNA, 118 bp, Diabrotica virgifera
  misc_feature (6)..(32): n is a, c, g, or t
  misc_feature (39)..(80): n is a, c, g, or t
  misc_feature (82)..(95): n is a, c, g, or t
  misc_feature (109)..(109): n is a, c, g, or t
  misc_feature (113)..(113): n is a, c, g, or t
taatcnnnnnnnnnnnnnnnnnnnnnnnnnnnatgaagnnnnnnnnnnnnnnnnnnnnnnnnnnnnnnnnnnnnnnnnnngnnnnnnnnnnnnnnagtaaaaagcttanattntttta

SEQ ID NO: 12953 - DNA, 90 bp, Diabrotica virgifera
  misc_feature (2)..(55): n is a, c, g, or t
  misc_feature (68)..(68): n is a, c, g, or t
  misc_feature (78)..(78): n is a, c, g, or t
gnnnnnnnnnnnnnnnnnnnnnnnnnnnnnnnnnnnnnnnnnnnnnnnnnnnnnngttaaaagcttanatttttttanaagacgagagac

SEQ ID NO: 12954 - DNA, 227 bp, Diabrotica virgifera
  misc_feature (2)..(38): n is a, c, g, or t
  misc_feature (47)..(155): n is a, c, g, or t
  misc_feature (158)..(178): n is a, c, g, or t
annnnnnnnnnnnnnnnnnnnnnnnnnnnnnnnnnnnngttttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnncaagaattaaaattaacacaaaaggggataaacccgccggtagtttttt

SEQ ID NO: 12955 - DNA, 464 bp, Diabrotica virgifera
gtacttttataatatattacaattggtccacacgtgattcgagatattcaactctcagaaggagcatctgtggtatttcgaaatcagcaatagaaaattagtaggaagactttgattttggcaatcagaatggggaatgtcacgagtcacaattatatcgaggcagtagtactattgcacccagtaactatagatgtgcgctgcatattgacaacagagaagtcttagataattctttatttagataatggtaatgcgagttaagatatattataatcatataaaagatcattaatatctatgaccccaaaagtaaagtcatactttctgtgggatatagttatgagtgtcagaggctccggggatgaggaaaaggaagtctatatataagaatcgaaatttaccatagcacgaaaaaattttgctgactctgcttaaacttaagtaatagattatggttataa

SEQ ID NO: 12956 - DNA, 953 bp, Diabrotica virgifera
  misc_feature (134)..(154): n is a, c, g, or t
cttctagggtccggaatccgttctcatcgatgccagaaccctctccaacttcaagaaatcgataaacttcactattccgaaaaacgctgttgagggttcagaaaaagtagaagtctctgctgtgggaaccttcnnnnnnnnnnnnnnnnnnnnnctggacaacgtcattcggttgccgactgattgtggagaacagaatttggttcatttaatgtcgaacttagtaattttgcaatacttaagggtgagcaaccagcttactccaactatccaaaatgaggctgttaaaaatttggaaacaagctatcaacagcagcttacattcaagagaaaagatggatcgttttcgccttttgagtggagggattcaaaaggaagtgtttgggtcacagcttacactgttttagcgttgagccaagccaaaaacttcatttttattgacgaaagagttatagaaaactccacaaattggttaactgatgtccaaggcaagaatggtagtttttatgaaacaggcaacatcatccataccgaattacagaacaattctggaaacagtttagctttgactgctttcgtggttatggcactgcgtgaaagttctctgcgaaatgatccaacaattgagaacgtcatcaacaaaggtttagactacctggcaagaaatatagatgaatctgaatcaatctacactattgctctgtgcagctacgtgctgcagattacaggacatacatcccgacaaagtgcttttcatctaattggactccaaagcaccaaccaaagaaaaacctaaaatgctgggccgaacccttatcctaaaagtgaaaaacagaaaccccttgaaggaaaatacccaaggtccatccgacctagaaaaccactttccaattgcccttatgaacccttattaaaggaaaatctacctaaaaagaattctggggcctggtttt

SEQ ID NO: 12957 - DNA, 207 bp, Diabrotica virgifera
  misc_feature (7)..(30): n is a, c, g, or t
  misc_feature (82)..(101): n is a, c, g, or t
  misc_feature (109)..(128): n is a, c, g, or t
  misc_feature (164)..(196): n is a, c, g, or t
taacagnnnnnnnnnnnnnnnnnnnnnnnntcgattataaagattgcgacctcgatgttgaataaagtttataattgttgannnnnnnnnnnnnnnnnnnntgttcgannnnnnnnnnnnnnnnnnnnttgagtttaaaccggtggggagccgggttggtttcnnnnnnnnnnnnnnnnnnnnnnnnnnnnnnnnnccaaaagggac

SEQ ID NO: 12958 - DNA, 68 bp, Diabrotica virgifera
  misc_feature (2)..(58): n is a, c, g, or t
  misc_feature (63)..(63): n is a, c, g, or t
cnnnnnnnnnnnnnnnnnnnnnnnnnnnnnnnnnnnnnnnnnnnnnnnnnnnnnnnnncattnctttt

SEQ ID NO: 12959 - DNA, 1061 bp, Diabrotica virgifera
  misc_feature (6)..(881): n is a, c, g, or t
  misc_feature (883)..(935): n is a, c, g, or t
  misc_feature (937)..(1006): n is a, c, g, or t
  misc_feature (1009)..(1046): n is a, c, g, or t
cctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnntcnnnnnnnnnnnnnnnnnnnnnnnnnnnnnnnnnnnnnncccttaaaggggata

SEQ ID NO: 12960 - DNA, 788 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(759): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgaggctttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnncataataacatattttaccatatgaaaat

SEQ ID NO: 12961 - DNA, 301 bp, Diabrotica virgifera
  misc_feature (88)..(116): n is a, c, g, or t
cttcccagggtccgggcttgtagaagaagtcaagagacatttcctttattccgtagaccccaaagatgatagattcaaagaaatgctnnnnnnnnnnnnnnnnnnnnnnnnnnnnnctctaaaagaagagcgacgcaaacaaaaagaggcaaaattgatggataaactaattaaaaagagggatcctggtaatgaaaaagaaagcgaagataaagaagagtcgaataaaaataaaaacttaaaagaggaataaattgtgataaatatactttaattttgaaactaattatagttgttatac

SEQ ID NO: 12962 - DNA, 923 bp, Diabrotica virgifera
  misc_feature (204)..(233): n is a, c, g, or t
ctagttcatccgtgacatttctttctttcgtattcggaaaggcctaaagtgtggtacgtggaagaatctgagagaagaggatataggactactgatgaggggaaacaacccccgaaaccggtatagactcttcctgcactctcagatttgaccatggtattatgcagctgctgcattttcgtgttgcaaagaaattgagaatgnnnnnnnnnnnnnnnnnnnnnnnnnnnnnnctagtttattaaacgggatcaaaaaatacgcggtggcttgcggcttgtttagaccatactggaacaaacactttaactccaacacaaagacttctgcaataaaattgcacaataacttcacttaaaaaacttaaactaaaatttcaactcaactcttcagaaaccgctataagcggtctctgcccgaggctacaactacaactttagttcttgacggctcctacgtaactctttctcgatctccccaaactccaatcttcctaaaccaaacgcagaaatttagactcctattccagcaatcatcagatagtttatccaataaaaagaacccaatgttcctaagaacatcccataaacagttgtaaatcttcttcttaaccaataagaaaatactcattatcagtaagcagtttctcttggtgctcatcaaaaatgtcaagtcagctctatcaacgattgtcgactcaaaactacttgaaaaaccttatcgctattataaaatttattatgtaaacattcggctctagtggacagaattcagtctcaaaaaaacattaaattcttttgataactcgccgaagataaacaaatgctctactttctgggcaacgaaatataccaatgtgggaacgaggattacgcataccatacgtatgtgagaaacttatcccacttcagatataaatcatg

SEQ ID NO: 12963 - DNA, 127 bp, Diabrotica virgifera
  misc_feature (11)..(62): n is a, c, g, or t
  misc_feature (68)..(123): n is a, c, g, or t
cattattcacnnnnnnnnnnnnnnnnnnnnnnnnnnnnnnnnnnnnnnnnnnnnnnnnnnnnggtgcnnnnnnnnnnnnnnnnnnnnnnnnnnnnnnnnnnnnnnnnnnnnnnnnnnnnnnnncgat

SEQ ID NO: 12964 - DNA, 428 bp, Diabrotica virgifera
  misc_feature (13)..(13): n is a, c, g, or t
  misc_feature (79)..(79): n is a, c, g, or t
tcctaataagtgnggttacgccagaaaatgaaaaatttagagtctttagagaaaatcaaaagagaagaaagaaaggaanaaggggttttggaattgttgtttgttataaggtttgccccctcctactatgtcatgtaagtttttggtgataaatgtttggatgattgttggatgaggaaatacgttgtattgaattttgatatcttataatttgttttggagatgaattggagggaagaagagcaaactatttttctgtcttgaattggctaaagaaaaggatgtggtagttgtgagtgatagtgatgtagaattaataatggatgaatatggtattgttgttgtaatgtggaatgcgccgtagagtagagaaggaaaaagaatcgcaaaaaataaatgctgaaggtgatgatgaatagctgcaaatt

SEQ ID NO: 12965 - DNA, 475 bp, Diabrotica virgifera
  misc_feature (23)..(75): n is a, c, g, or t
  misc_feature (77)..(268): n is a, c, g, or t
  misc_feature (275)..(359): n is a, c, g, or t
  misc_feature (363)..(463): n is a, c, g, or t
caacaaaacaaaacagtccttgnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtgtgnnnnnnnnnnnnnnnnnnnnnnnnnnnnnnnnnnnnnnnnnnnnnnnnnnnnnnnnnnnnnnnnnnnnnnnnnnnnnnnnnnnnnccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacctctctct

SEQ ID NO: 12966 - DNA, 883 bp, Diabrotica virgifera
  misc_feature (2)..(21): n is a, c, g, or t
  misc_feature (211)..(242): n is a, c, g, or t
  misc_feature (458)..(481): n is a, c, g, or t
  misc_feature (855)..(878): n is a, c, g, or t
gnnnnnnnnnnnnnnnnnnnngaattatggctgatttcaaagttgttacatccgattttgtcaatttacaaatatcaacatctaaagatgacttatcttttaacgaaaaacgttttcctaaagatattactatatcagatttaaaagtgaagctggaattaattactggtggtagttgtaacacaatgcagcttcaagctttcaataaagnnnnnnnnnnnnnnnnnnnnnnnnnnnnnnnnactgctctactgggctcatatcctttagaagatggtatgagacttcatgtcattgataattttttaatgagaaatgaactggattttggaaatgttcccaaatttgaattatcacaggatgaatatgacaaaaagggtgatacagttagatcatttttaatgaaaaataagatgggtaaatataatcaagaaaatattcagaaaaaggaacagttnnnnnnnnnnnnnnnnnnnnnnnnagaaagcataaagataggatctagatgtaaagtgtccgttcaaaatgcttctgataaacttggtacagtaatgtacacaggacaagttgaagggctctctggatattggattggagttaaatatgacgaaccactgggaaaaaatgatggaagcttaaaaggaaaaaggtatttccaatgtccagaaaaatatggtgcatttgttaaaccacatagtataacttggcggagattttcctgaagaagactatgatttaaatgaagaaatttgattgccattccaaactacattttcttgtcgtaaaaattaatgctttactactatactactacattgtgatgcttattatattctttttatacataaattttannnnnnnnnnnnnnnnnnnnnnnntttgt

SEQ ID NO: 12967 - DNA, 496 bp, Diabrotica virgifera
  misc_feature (2)..(379): n is a, c, g, or t
  misc_feature (381)..(426): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnntattattatttctatttttcagaaaattttaattcaaatataaaactggattattctgagagggtaatgg

SEQ ID NO: 12968 - DNA, 946 bp, Diabrotica virgifera
  misc_feature (128)..(150): n is a, c, g, or t
  misc_feature (207)..(225): n is a, c, g, or t
  misc_feature (291)..(312): n is a, c, g, or t
  misc_feature (375)..(387): n is a, c, g, or t
  misc_feature (389)..(402): n is a, c, g, or t
  misc_feature (778)..(795): n is a, c, g, or t
  misc_feature (871)..(871): n is a, c, g, or t
  misc_feature (885)..(885): n is a, c, g, or t
cctctcgcgtccgtgagaatacatactaggagaaaaagcttacgagtgtgaagtttgttgtaagcaattttctcttaaacagtttttaaataatcatttgcgtattcacactggagaaaaaccgtatnnnnnnnnnnnnnnnnnnnnnnnatttgctcaagcaggtaatttgaccgaccatttgagagggcacactggggaaaaacnnnnnnnnnnnnnnnnnnnctttaagcagtttagacaaagaggaaatttgaaagtacatttgagggtgcacactaaagaaactcnnnnnnnnnnnnnnnnnnnnnngaaactgttttctcatgaaagttatttgaaaattcattcgcggcttcacactggacagaaacnnnnnnnnnnnnngnnnnnnnnnnnnnngttttctcaaacaactaacttgaaatctcatatgatgacacacactggagagaaacctcataagtgtgaagtttgttttaaggagtttactcaggcaaataatttgataacacatttgagagtgcacactagagaattgccttacaagtgtgaagtttgcttcaaaaatttttctaaccaaagttatttgaaagttcatatgcgtgttcactctggagagaaacctcatacgtgtgatatttgttcaaagcagttttctcaaacagctcacttgaaagctcatttgagaacacacactggacaaaaacctcacaattgcgatatttgttttaagcagtttgctcaaagaggtcaattgaagacacattcgagattnnnnnnnnnnnnnnnnnnttataagtgtgagatctgtttttaaggagtttgctcaggcatttaatttgaaaacacatttgagactgcacactanagaaactccttacnaagtgtgaatttgcctcaaaactttttctcagcatagtccacctgaagcccacatgcgtgt

SEQ ID NO: 12969 - DNA, 66 bp, Diabrotica virgifera
  misc_feature (25)..(25): n is a, c, g, or t
taacagcgtaaatttattgggagangtcaaatcgataataaagatggggaacctcgatgttgggat

SEQ ID NO: 12970 - DNA, 419 bp, Diabrotica virgifera
tagatgaagtggttggtgttttgttttttactaattgtgatggtatagatttactattgtgttggagatggaagggtgttgctaagaaggtttggaaatgtttggaactttattgtaatgagttggggatagtcttcgtaattgtccttggtgggaggatggtatgatggaaggttcctggacagattttgagaaaggatgatgaggaactaatggtccaatattatggtgagagtctttttagttggtagatcttagcgtggggaggggtgacatgcgattgtggtactggttgtacccgagagagttaggtggtacgggactggactagtttttgtatgatgtgggtttgtgggtgtttggttgggggtgtgcttgtgcaggagtattatatatgatgaaaattctttgtgcaatgg

SEQ ID NO: 12971 - DNA, 562 bp, Diabrotica virgifera
  misc_feature (254)..(271): n is a, c, g, or t
  misc_feature (516)..(535): n is a, c, g, or t
gcgattgtatatttcattcacataccgctacttcctagtccttgtctaattcagtataagactctgatagcgtatgtagcaatcatagactaattatgatgagcagaatacatgagcactttggcgattgataaatcctttagatgttcatatatgattgactaggtgagtggtgattgctgtatcaacacttaaaagatttcaatgaactgttaactatgaacttaatactagtaagtacaagattgatatannnnnnnnnnnnnnnnnngtatagactatcagatatgaacgacacaaatgagtattcggcgacgagttatcgaaaatggttgttaatattacgtattttagaatgagatatcatgactagccagagatcagtatatttggaatggacgcggatggtatgaccgagcaaagttagagtattcacacttagaaatagtggatagcaggagtagtaggttggtggatgattagtctgtactattatagaattaataaggagatccnnnnnnnnnnnnnnnnnnnngattgttatgcacatcgactctatgac

SEQ ID NO: 12972 - DNA, 877 bp, Diabrotica virgifera
caattcagtcatcagaattggattttacagtgcattccatcaattactgttataatgctattatagatagactggtagagtctcacagttactactttaagcagcagatgaaagcatacaaaagccttcaggcacataaaagccttcacaactggatttgttttgaaacatttgatgttttgatgatttttatattattgttggaaaggtgaagaattcccaaaaagctaatgccaaaccactagatgcttgggtgatagccagttccaatggcatagcaaatgcacattgtatgtgtattgccggtaatagtgaagtttgcagccatattgcagcaatcttatttgcagctgagtatgcccacagcaagacagaagaagaagaacccaatgcatgtacatatgttacagctatgtacattctctggtgaaaaactaatgagttttcaagctgttcagtcagagtgcttgttgctctctctaaacgaactgaaatataagacggctttggcttcatgttgcagcgatatgaaaatggttagtcatttttaattataatgtacttcttcatcatgagtatcaatggtatagggctttccatccagttcattttggttttcagattgctgacatgtgtcacataatattaatattatatctacgtcatacgttattggtatataccaatgatacacaccaaagacatatcgcgtagatatattaatattatgtgacacatggcacatgctcgaaacaaatgacagtcgataaaaagccctattagtcttttaagtgtgtattatcagataccacacgtaaattggttttatcattttaaatttggtcattacagtcccttaatcaaaaaatatattttt

SEQ ID NO: 12973 - DNA, 807 bp, Diabrotica virgifera
cggacgcgtgggcgacacacgtattccgccctttttgatatgcgaagagtagatctaccagctaatacaaattcacagacagattgtacttatgctcccacggatccctcctggtccctgaccaagtgtgtaacgactcgtgtccgagctcacgcaatacgtatgagatttatgataaacaaaaatctaacaactgtgggttttggaaacggctagatactgataagtatgtgaatgtgcaggaatggttattcctctaataacatatataagttttcgatagactcccacattgcatttaatattattatgtgcaaggtgagtagatctgagggatgtaacaggatggacttctagggcgcgagctggcatataatattgcccatggaggtgcatttgaaaagttatgttattattataattcttagtatgagatatcatgacatgtctgagcaattaattttattacacgagaaatgaatatacaacgaataggactaacctatgaactagtacccatatttgtatgaggtgtgtaagaacctcaatccatcgcctattaactataccaaaataagctgaagctaggacaacatgaatagctgattgacatgtacatgcatcaatgatcgatccagctggtgtaggagatcaatttgctatctacttatattgtgagtttgtggccatcctgaaggataaaggcaattctaccaggatatggatcaatttccccgattgcaaggaaagagagaaaataaaagacacttttggtagtttaggaaaaattcatgctataagaggatt

SEQ ID NO: 12974 - DNA, 113 bp, Diabrotica virgifera
  misc_feature (2)..(65): n is a, c, g, or t
  misc_feature (71)..(112): n is a, c, g, or t
cnnnnnnnnnnnnnnnnnnnnnnnnnnnnnnnnnnnnnnnnnnnnnnnnnnnnnnnnnnnnnnnnacgagnnnnnnnnnnnnnnnnnnnnnnnnnnnnnnnnnnnnnnnnnng

SEQ ID NO: 12975 - DNA, 100 bp, Diabrotica virgifera
aacaccggatttcacacgtgagcaataaataagtggctcgctggagggttgcaattagctgttacgggttaagtgaagccaagacggattgtttcgagta

SEQ ID NO: 12976 - DNA, 930 bp, Diabrotica virgifera
  misc_feature (7)..(48): n is a, c, g, or t
  misc_feature (50)..(927): n is a, c, g, or t
gtctctnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaa

SEQ ID NO: 12977 - DNA, 939 bp, Diabrotica virgifera
  misc_feature (787)..(787): n is a, c, g, or t
  misc_feature (834)..(834): n is a, c, g, or t
  misc_feature (897)..(897): n is a, c, g, or t
  misc_feature (899)..(899): n is a, c, g, or t
atgacgaatagtagtatagttttcatttgttggcataattaaagatattaaaacataattagggactatgttttctggggcttacaatttgttaaaaattactatagctcgtttttaaacttggaggagtaattcaagtttaccgcgctgtaatgcttgtttgtatggtccaaccgctggcaagtttactccactaacttatgaaattttgacactatcaagttttagtttgacatttatcaaattttgaccctaatgacatttgaaattgatagggtaattaagttgcgattttttgtgttttctgcgttattcctttaatttttatatgtttagtctgcatttatataatgcagacagttaaacagttgttttaagaactctttagcgacgtgttaatataatataatatttatggattaccgtcgaaggccgaccaaccaaaaaagaagatgaatctggtgattttttttagtgattattttgtaatgattttaacttccaatcgtatagtaagatatttgatcacgtgtttaattctgtccaatcagattaaaattatactgagaattatctactgtagaaaattaccgatagaattttttaagtagactgtttctgtttaatggcaagtttcctagttttgacaactgtcacatttaagaaaatatccataatatacgtattaaaaaataatcttacgaatatcacacgacagtgagaataaataagaaggtaatgcttcatttttattccaatttgttgtcattggtcaataaccactcgnaaccctgcgggctctcatgtctattgccagacaacaaattttcgaanaactggtcgcattgttttcaatttattctcactctcttgtgatatatacccgacaataattgngntgtgaatctgtcatttgagttactcctttctagttaaaaa

SEQ ID NO: 12978 - DNA, 955 bp, Diabrotica virgifera
  misc_feature (228)..(248): n is a, c, g, or t
  misc_feature (397)..(414): n is a, c, g, or t
  misc_feature (660)..(677): n is a, c, g, or t
cttctccatagatccctaccaaaagggcgttgacgactagtaaaccggtgtacacatacatatacagtcgaacccgcttattagaatccctgttataggaatatcccggtttatggaatataaattcaagttcccgaaacatttccatttactccttaataaatttatctgtttattggaataggatctaactagataataccgcttattagcatattttgcaggtcnnnnnnnnnnnnnnnnnnnnntttactaaaaatttaaattatgtttggtattatggtttgtcgtcaatggccggtagtgctggattagatattattagggtaataaatatttattactttgttaggaataccaattcgatctttagcatagccgacaaatgcatgggtcnnnnnnnnnnnnnnnnnngtctacacaaaggcaccgttgcctgttataaaattgttagaagcagtttagttagaattcactcagagagtactacctacttgtttgcaagatggaattatggctttgttaaattcgaaaagaagagaaaagaacaagaatgtaacaatccatttcttgacgccaataaaacttctattcaaccaatggattaaggatgaccacacggattaacaacgaaaaagctataattaccaataatttctnnnnnnnnnnnnnnnnnntttgttatataggtatgcattttaataagaaaatatttacatatctacatattgcatacatttcatattaattatataatgtattcattcacatacatgtaatgtaatttggtatttaacacatacatagataagtactagttacactactgtattattgacgtaaaaagacctaaaaccatttacatacactgaaatatgtaggtacatataatatgatatacatattgggcatagtatgtaataaaactacatattgggcatagtatgtaaaacta

SEQ ID NO: 12979 - DNA, 231 bp, Diabrotica virgifera
  misc_feature (5)..(84): n is a, c, g, or t
  misc_feature (89)..(221): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnnnncgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttga

SEQ ID NO: 12980 - DNA, 106 bp, Diabrotica virgifera
  misc_feature (3)..(99): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaaagc

SEQ ID NO: 12981 - DNA, 969 bp, Diabrotica virgifera
  misc_feature (544)..(544): n is a, c, g, or t
caaaatcctattcttgggtgaggtggattactcctctatttcatttatagcttgctgtgtttctttgctgctatcgtgactgttttccatttattcttcctgtccctgcactgaacttccattctttaacattaattgttcttatatcttcttctacatcatccagccaacttcttcttagccttcctctacacctgggccatagtggtatccagttcgttatccttccaaacatatctgagtgtgggcgtttctgtatatgtcctatccattttcagtattccagtaaacaaattttatgtatctgactttattcttcctttagttcttctttaatttcggcatttgttttcattcttctttctccctctcttgttacattgtggcccagtatcattctcattatttttctttcaaatttcagaaggagtctttcttgttaatcattgttgtttccatcccatatgtaacaacatgtcttatataggttcatctttgttctcttacttagaatcttgcttcttagcagatttctgttcatttnctgtttttttgtctttcagaattctttcctcagttctctcttttccggatttccctattgtaactcccaagtagctaaaggtgtggatacagtttcaaattttaaggttctgtgttaattagataatttctgggttgtcctggacatttagaaacgcaatatgttaataataatgaatgttttactatcttttcaattaaccaatgtaataggatataactataaaacaaattcaagtagaaaaaatcattgctttgccattcaaacaaaacatctgaaaattataaagaaaatattgtttcttgaattagtggtctatttatctctatttataatacacacttttttgtttgggtattttaagacttgtaataaatactaggtatacctacatatttaatatactttgttattttgttatctat

SEQ ID NO: 12982 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 12983 - DNA, 246 bp, Diabrotica virgifera
  misc_feature (2)..(144): n is a, c, g, or t
  misc_feature (146)..(188): n is a, c, g, or t
  misc_feature (190)..(203): n is a, c, g, or t
  misc_feature (210)..(245): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnncnnnnnnnnnnnnnncggtgannnnnnnnnnnnnnnnnnnnnnnnnnnnnnnnnnnnc

SEQ ID NO: 12984 - DNA, 224 bp, Diabrotica virgifera
  misc_feature (2)..(26): n is a, c, g, or t
  misc_feature (28)..(58): n is a, c, g, or t
  misc_feature (71)..(91): n is a, c, g, or t
  misc_feature (94)..(94): n is a, c, g, or t
  misc_feature (97)..(138): n is a, c, g, or t
  misc_feature (160)..(214): n is a, c, g, or t
cnnnnnnnnnnnnnnnnnnnnnnnnncnnnnnnnnnnnnnnnnnnnnnnnnnnnnnnncatttttttaccnnnnnnnnnnnnnnnnnnnnngtntcnnnnnnnnnnnnnnnnnnnnnnnnnnnnnnnnnnnnnnnnnncactaattatttactcgcggtnnnnnnnnnnnnnnnnnnnnnnnnnnnnnnnnnnnnnnnnnnnnnnnnnnnnnnnaatttttttg

SEQ ID NO: 12985 - DNA, 115 bp, Diabrotica virgifera
  misc_feature (29)..(29): n is a, c, g, or t
  misc_feature (81)..(100): n is a, c, g, or t
taacagcgtaattttattggagagttcanatcgataataaagattgcgacctcgatgttggatttaagttataatgggtgnnnnnnnnnnnnnnnnnnnntggtcgactttaaaa

SEQ ID NO: 12986 - DNA, 968 bp, Diabrotica virgifera
  misc_feature (18)..(41): n is a, c, g, or t
  misc_feature (87)..(105): n is a, c, g, or t
  misc_feature (208)..(228): n is a, c, g, or t
  misc_feature (417)..(435): n is a, c, g, or t
  misc_feature (614)..(637): n is a, c, g, or t
  misc_feature (659)..(660): n is a, c, g, or t
  misc_feature (692)..(692): n is a, c, g, or t
  misc_feature (738)..(738): n is a, c, g, or t
  misc_feature (752)..(752): n is a, c, g, or t
  misc_feature (870)..(870): n is a, c, g, or t
  misc_feature (924)..(924): n is a, c, g, or t
ttattagtaaacaataannnnnnnnnnnnnnnnnnnnnnnncattttatttatactaatattctaagcaaggtttaaatttagactnnnnnnnnnnnnnnnnnnngttttgactaagtttcaaaccaatatacataaatatatttacttaggtataatcatagatgaggaggtataatctttttaataattactaagttcaaagtccnnnnnnnnnnnnnnnnnnnnngagttcaaaaatggctcttctaaataagactttaaaacatttggtacattaccaaatgaaaaggggtatagcctccctaagtgccttaccagaaacacatcaaatgctacaaaaaacctgtagagactttgcggaaggtgaattaaaaccaattgcggcaaaaatagacagagagcatttatatccaannnnnnnnnnnnnnnnnnngggtgaactgggtttaatggcagtggctgtacccgaggagttaaatggtacaggactggactatttagcatatgctatcggaatggaggagatatctaggggatgtgcatctgcaggagtaattatgtctgttaataattctttgtacactggaccaatccagcaatggggaagtaaannnnnnnnnnnnnnnnnnnnnnnnccttttactaatggagataggnngtaggctgttttgcattatcagaaccaggaanacggttcagatgctggagcagcttctacaactgccagaattagatnggtgataaatttanttctgaatggtactaaatcttggataactaatggggtatgaaagtgaagctgccgttatattagctacaacggacaaagggctcaacataaggggaatttcggctataatcgtgccanaaccaactaatggattagaattaggtaaaaaagaagataactagggaataaggngttcttcacatgtaatttatattttgacattttgtctgtccaaa

SEQ ID NO: 12987 - DNA, 656 bp, Diabrotica virgifera
  misc_feature (241)..(259): n is a, c, g, or t
  misc_feature (431)..(449): n is a, c, g, or t
cgagtttagttcaagagagagagctatcgacaagttaagatcttgccggttgcctcgggctgcgatatgcggctaccggtaaaaattagcagtgcagttccagctaagttttgcaagtgtattgcagaagctttttgtgtttagttagtgttggtcctatcatggtctaagcaaagcgtagactaccgcgttctcgctgttttcaagcgaatcgccaagatgatttcataccacttttggnnnnnnnnnnnnnnnnnnncggtcagatccggaagtaggagttagaagtttcattttgcattactaagtttaacattacagtcaaatcatgaagtatattaatatatttcattttgatcccgtttaatattcaaaaggactattgagttctaaaatatttttgttcgagtagaaagctgaatttttctatnnnnnnnnnnnnnnnnnnnctatggataaaccttatgtactgttgctgtacctgtaaatattgtgaagtgactttcgcgtagtgaaatagcgtctgggacttacaaaccaaccaacaaccagaagaaaataggacagtgatacgtaagggtattatttttatggttgtagaactttttgtctgattattttttactcgataatctggatctcaatctgaaacaccg

SEQ ID NO: 12988 - DNA, 401 bp, Diabrotica virgifera
  misc_feature (89)..(122): n is a, c, g, or t
  misc_feature (364)..(387): n is a, c, g, or t
ggtaaaagttccagttagagtagaagtacctgtacctgttaaagtaggagtaccacagccttatactgtggaggtaccaaaacccgtannnnnnnnnnnnnnnnnnnnnnnnnnnnnnnnnnaacatgttccagtgccatctcctgtagttgttaaagaacaagttccagtgccatccccagtagtagtaaaagaacaggtaccagtaccatctcccgttgttgttaacgaacatgtacctgtacaacaacctatctatgtgagggaacaggttaatgtacctcaaccctatcttttgaaagaacatgttcctgttgaatctccagtgtcatttagacaacataatgtgcaccatcaaaatccnnnnnnnnnnnnnnnnnnnnnnnnctatgttagtattc

SEQ ID NO: 12989 - DNA, 576 bp, Diabrotica virgifera
ttgctccggctccttcctttacatggtaatactcgcttcattcttccatcgtctcatttatactacttaatgtgacatcgtcattgtagggagtgtctagctcttatattggcaccaactcttgtatcggctcaacagatccaaaaagtattattgacctaagagatttcatgtcgcgcagtgtcatgcatgtataggtggaacaatgtacaagaataaataacaatacttcgaaactgaagatacttgttgtagttgaaacaccttggaatattttatgaaatgataacatggagagtcttaaggccttctcttataaaaatgtctgatttggatgaagccgatgaaacgatgttctaggggatttaaagattaaatataatgacgtgctattaatgatgaacacagacgaacaggcaatttttctatcggttaccatgataaacgatgtgataaatgtgattatgtcttttatgaggagttcggattggatgcttgaaaaatgagaagaacttacactttgaatgtattgtacaattttttgtaatttttaagtaagcaaattgtaatctagta

SEQ ID NO: 12990 - DNA, 493 bp, Diabrotica virgifera
  misc_feature (13)..(44): n is a, c, g, or t
gtcctaacatggnnnnnnnnnnnnnnnnnnnnnnnnnnnnnnnncttttacttctttaggcgcgattgagattgagggtgaatttatattgatctgcgctcatgcgcataccgacagtatggtattagtcgttatacgggctctgattgggtgttgaaatgatctgtcaataataaataattgttcaatataaaggtaaacaaatgtataatatattagttttattgttgtgaggacagaaacaaaaaagtttataattgtagtgacttttaaataggttttaaagcaacaggtacgtaataattgtaaatgtgtcataagtacctacctatttgaacctaccgataaacatagtatgtaatacttttatttacataatttgcttaccatcgaaatgtctatcattagtcacctgacgtgttgtactcatactctatgatttgttgtattgtttcatttctaaatcgtatgtgattgttgatctaaagaatta

SEQ ID NO: 12991 - DNA, 859 bp, Diabrotica virgifera
  misc_feature (146)..(168): n is a, c, g, or t
  misc_feature (735)..(735): n is a, c, g, or t
  misc_feature (746)..(747): n is a, c, g, or t
cattgtatttcagcgtatttgaaatgtggttggtaaaggcagtgcctatgaatgttggtggtagtacacactcctgtttgacttctggtgttcaatttctgttgttcgaaaagccatttcaatttgacagcacttctcaggtgacnnnnnnnnnnnnnnnnnnnnnnngatacgaacacaatcagaataatagtatataatatagtatattttgtatcataattgggatatcctttattaaccgatatcttgagttgcgcttcattaatttttgtcattatccaggtctcaaaactacagattactaagggtctaataaatgttctatcgtaacacaattatctgattcaaaattatacagtgtgcataaaaagtaacgacaacatacaagtcacaaaaaaatttattacggttcgttaccatttataaagaaaacagatattaactcctctaagccaaagttaggagaatagaagatcatttttgtggtacatattcaaaagtatatatgttacggtaaaagtagataacctggtaattgtacataattaccggtaattgtatacaatcaccagagtagacctaaatgtaggaaatattctttgaaaaccctgtatttcccacttttacaggtaattgtatacatttcccagatgatcttagtaaaagtaagaaattcaaattataactatcgacacgcaagcctttttaaccttgtatgtaattagcacatanactttattggnntcagggaggtagaaacaagaatggttgaaagaagtacaacagaaggtatgctttttctcatgggccatctttcagtgcggtcacagttttttcgatttcattttctacgcgt

SEQ ID NO: 12992 - DNA, 823 bp, Diabrotica virgifera
  misc_feature (777)..(796): n is a, c, g, or t
caagtccctgtgtgatagcagtcataatctagagaagataaaattattaaatatcactatatcacgagtttcagtccaccataatccaggctgactatcatttatcaaataataatttcactgtacttgtattttgtttatgcctagttacaccaacagaacttaaagcacgacttaagcttaagatctgttcgtgcaaccagacattagtgtttcattaagggaaatattggtaattttcattggttttgtgggtatttctcactcgtacaagctatcctgccagtgaaataatatattttcctgatatagttaatcaaaaatacataattttgctgataagttttcaaatattttgtagattgtattcagtagagctattcctctacacttgtagcacatacttttgtcacttttttggtgaagtggacttaaccacgtcaagtttctactcgtttaataatttagttctttatatgtcttctcaagttgtcaggcaattctagctctccatcctttcaatactctgccctaatgccattttatcctattatttcgttgtctttagcttttgtatgtagttcagttgaaggtagtaatatatattctttggactttgcacattattccttttaatctgttgataaaatttcgattgtccttattaatcgacttccatgatctctaggtttcttttccagagttttttcttatgccgccagatatgtttcactttttaaaaatctgttgtatgtgtcgatacagatcgatttaccnnnnnnnnnnnnnnnnnnnnttacaaattagtaaaaagaagtcaaaa

SEQ ID NO: 12993 - DNA, 537 bp, Diabrotica virgifera
  misc_feature (2)..(19): n is a, c, g, or t
  misc_feature (21)..(96): n is a, c, g, or t
  misc_feature (99)..(128): n is a, c, g, or t
  misc_feature (171)..(171): n is a, c, g, or t
  misc_feature (202)..(245): n is a, c, g, or t
  misc_feature (254)..(271): n is a, c, g, or t
  misc_feature (290)..(353): n is a, c, g, or t
  misc_feature (360)..(418): n is a, c, g, or t
  misc_feature (422)..(448): n is a, c, g, or t
cnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnatnnnnnnnnnnnnnnnnnnnnnnnnnnnnnntgggcgcggtattttgacgtgctaagtagcataatcattattnttttattgaagctgcaatgaagggttgatgnnnnnnnnnnnnnnnnnnnnnnnnnnnnnnnnnnnnnnnnnnnngtaaaaagnnnnnnnnnnnnnnnnnncgaaaaaccccatagaggnnnnnnnnnnnnnnnnnnnnnnnnnnnnnnnnnnnnnnnnnnnnnnnnnnnnnnnnnnnnnnnnggggggnnnnnnnnnnnnnnnnnnnnnnnnnnnnnnnnnnnnnnnnnnnnnnnnnnnnnnnnnnnccannnnnnnnnnnnnnnnnnnnnnnnnnncccaggggaaaccgcggaatttttttgggggaattctaacccgaaaaataaagatggggccccccttttgggggttaaaggatttttta

SEQ ID NO: 12994 - DNA, 895 bp, Diabrotica virgifera
  misc_feature (69)..(83): n is a, c, g, or t
  misc_feature (86)..(100): n is a, c, g, or t
  misc_feature (175)..(194): n is a, c, g, or t
  misc_feature (204)..(222): n is a, c, g, or t
  misc_feature (230)..(254): n is a, c, g, or t
  misc_feature (776)..(776): n is a, c, g, or t
  misc_feature (830)..(830): n is a, c, g, or t
ctggaacagaagcaaaaagaaaaggaaatgaaaaagatggaaaaggacaaagaattggaacaaagacgnnnnnnnnnnnnnnngannnnnnnnnnnnnnngaaaggaaaaagaagaaagggaacaaaagcgaaaggaaaaggaggagaaagaagaacaaaagcggaaagaacgcnnnnnnnnnnnnnnnnnnnnctgcaggagnnnnnnnnnnnnnnnnnnnagaagttnnnnnnnnnnnnnnnnnnnnnnnnngcagctgcagcgtttgtcaacttctttgtagccaaaaagactgatgatgcacaagatgacaaaaaatcacaagaagaaaaaagaccacaaacttccaattttctacaatttgaagtaaaatcagacatgaagttacctttgccaagaagggaatttttaagcaatgaagaaaaggaaaaactagtgtgttatctagattctcaagattcggaagcttcatatttaaaagatctgtcatcaggaaagcttataggtaaaagtctaaaaacttggccatatgaagaatctcttgatgatgaaatcattcttgttgatttgggagaaactatttgcgaagacaaatctggccttcaaagacacaaagcgaagtttttgtacttccatgacaatcgtagacctgcatattatggcacatggaggaaaaaaagcaaatttgttaaaccaagaaaacctttggctgaagataaaaacattttaaattatgaggaggattcagatgatgattgcgaggaagaggaacanggtgagtctcttaatggttcagaagatgaagctgagaaggagaatgacgatgancaggatgattatgaagttgataatgaatttcttgttccacatgggcacttaagtgatgatgaggt

SEQ ID NO: 12995 - DNA, 942 bp, Diabrotica virgifera
  misc_feature (15)..(937): n is a, c, g, or t
cttccccgggtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggg

SEQ ID NO: 12996 - DNA, 313 bp, Diabrotica virgifera
  misc_feature (13)..(31): n is a, c, g, or t
  misc_feature (203)..(218): n is a, c, g, or t
  misc_feature (220)..(259): n is a, c, g, or t
  misc_feature (261)..(281): n is a, c, g, or t
gaatggaattcannnnnnnnnnnnnnnnnnnattattatagagatgactttttgcatctgataattaaaatcgtgtgtctatggattaattttaaaggccccgctgcccacgagcgtaatatggatagccaaggtattgtgaccgtagttaagtagcatcatcattagttggtttattgaaagccgggactgaaagggatttnnnnnnnnnnnnnnnnannnnnnnnnnnnnnnnnnnnnnnnnnnnnnnnnnnnnnnncnnnnnnnnnnnnnnnnnnnnngaaaccccatttcaggctataaatttttaaaa

SEQ ID NO: 12997 - DNA, 240 bp, Diabrotica virgifera
  misc_feature (4)..(42): n is a, c, g, or t
  misc_feature (44)..(74): n is a, c, g, or t
  misc_feature (90)..(130): n is a, c, g, or t
  misc_feature (139)..(221): n is a, c, g, or t
cagnnnnnnnnnnnnnnnnnnnnnnnnnnnnnnnnnnnnnnngnnnnnnnnnnnnnnnnnnnnnnnnnnnnnnncttttacaagacgagnnnnnnnnnnnnnnnnnnnnnnnnnnnnnnnnnnnnnnnnnattaattcnnnnnnnnnnnnnnnnnnnnnnnnnnnnnnnnnnnnnnnnnnnnnnnnnnnnnnnnnnnnnnnnnnnnnnnnnnnnnnnnnnncgaacccaattttttttga

SEQ ID NO: 12998 - DNA, 870 bp, Diabrotica virgifera
  misc_feature (13)..(13): n is a, c, g, or t
  misc_feature (21)..(669): n is a, c, g, or t
  misc_feature (676)..(713): n is a, c, g, or t
  misc_feature (733)..(746): n is a, c, g, or t
  misc_feature (749)..(771): n is a, c, g, or t
  misc_feature (779)..(801): n is a, c, g, or t
  misc_feature (808)..(808): n is a, c, g, or t
  misc_feature (831)..(862): n is a, c, g, or t
cggtcccttctangcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttanaccggtgtgagccaggttggttnnnnnnnnnnnnnnnnnnnnnnnnnnnnnnnngaaaggga

SEQ ID NO: 12999 - DNA, 954 bp, Diabrotica virgifera
  misc_feature (124)..(143): n is a, c, g, or t
  misc_feature (851)..(871): n is a, c, g, or t
  misc_feature (928)..(928): n is a, c, g, or t
tcttaccagcgtccgacaaattgtaataaatgtggttaaaggcctcatcgaataaataattgtccagcctttggtaaggtatgtaatttttgtaaattaccaaatcattttgcaacagtatgcnnnnnnnnnnnnnnnnnnnncaaaaaggttaatgaaataaatactgtaactaaaagtccaaaggtaacaagtagttgtaatgatttgttcgtagacaatgtactagaagttaatgcaggggaaaataatttcacaaatataacaagtagttgtaatgatttgttcataggcaatgtactagaagttaatgcaggggaaaataatttcacaaatatagcatggtttgcagatttaaatataaataaacataaaattactttcaaaatagattcaggtgcaatggcaaatgtattaccaatgagtaggtatttttgaaactttagaaaggattttctaacagggtaatcatgaaaacaaatacaaaactaaaatcttacactggaaataatcttaatgtggtaggtataggtaaatgcacattacactgtgaaagaaataaagttgaacatgacttttatattgtaaattctaaaactgaagcaattttaggcttaaattctagtattcaattaaatttaatatctaaagtaaatagtgtaggttatgattttgaagaatataatattttaattgaacaatttaaagatattttttcaggcataggatgcattaataaaaggtatgctataaaaattgataataatgcaaaaccagttatacacccaacaagaaaagtagctttacttacctttacttaaaaatttagaagaaagtctaaacaatcttgnnnnnnnnnnnnnnnnnnnnnaagttgtaggtccttcagaatgggtgaaatcctttggtacttgtaagaaagtacttngagaaaattgttagatccttctgact

SEQ ID NO: 13000 - DNA, 159 bp, Diabrotica virgifera
  misc_feature (7)..(44): n is a, c, g, or t
  misc_feature (66)..(66): n is a, c, g, or t
  misc_feature (80)..(102): n is a, c, g, or t
  misc_feature (110)..(131): n is a, c, g, or t
taacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaccggtgtgagccaggttggtt

SEQ ID NO: 13001 - DNA, 755 bp, Diabrotica virgifera
  misc_feature (19)..(138): n is a, c, g, or t
  misc_feature (140)..(556): n is a, c, g, or t
  misc_feature (563)..(600): n is a, c, g, or t
  misc_feature (620)..(633): n is a, c, g, or t
  misc_feature (636)..(658): n is a, c, g, or t
  misc_feature (666)..(688): n is a, c, g, or t
  misc_feature (718)..(749): n is a, c, g, or t
ccccaccccctagtccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 13002 - DNA, 779 bp, Diabrotica virgifera
  misc_feature (13)..(41): n is a, c, g, or t
  misc_feature (559)..(576): n is a, c, g, or t
  misc_feature (617)..(684): n is a, c, g, or t
cccttcgcgtccnnnnnnnnnnnnnnnnnnnnnnnnnnnnnctttttattgattttgattatacgatgaaattaccttaggactgagagagaaattttattggtgcgatcgaagccttcctttttagtgcggagtggatggggaattacgaattgtgaatgaacgacttatcaacaccaaatgagctagacctccaataatatatttcttatccgaagacaaattttgtgcagaattttgatggaaagaaacgcgcctcgacgattattatatccacgttcatcagaagtacggtccagtgactgtttcacaacagcttcataattgagtattttcaccttaccaggcttgcatatatccagggacggggtgatgggtacgattctgtcactgtttcacttgtaaataacaattatggttggaactttccatatgacgatataaggtattgttgatttttatatgttattattctgatttttaatgagttctttactagaatataaattgcaattatgataaaattagtaatgatgatagtattatcattgacgacacnnnnnnnnnnnnnnnnnntattggctgaataaaggaactcggcaacattctttttccgnnnnnnnnnnnnnnnnnnnnnnnnnnnnnnnnnnnnnnnnnnnnnnnnnnnnnnnnnnnnnnnnnnnntggccgtgggattttcgccgtgctaaggtagcatcatccttagttgtttttttgaaaggtggaccgaaggggttggttgaacaaaaactggcttt

SEQ ID NO: 13003 - DNA, 606 bp, Diabrotica virgifera
  misc_feature (13)..(13): n is a, c, g, or t
  misc_feature (26)..(26): n is a, c, g, or t
  misc_feature (31)..(31): n is a, c, g, or t
  misc_feature (54)..(54): n is a, c, g, or t
  misc_feature (85)..(86): n is a, c, g, or t
  misc_feature (89)..(89): n is a, c, g, or t
  misc_feature (99)..(99): n is a, c, g, or t
  misc_feature (101)..(101): n is a, c, g, or t
  misc_feature (106)..(107): n is a, c, g, or t
  misc_feature (112)..(112): n is a, c, g, or t
  misc_feature (128)..(128): n is a, c, g, or t
  misc_feature (147)..(147): n is a, c, g, or t
  misc_feature (152)..(152): n is a, c, g, or t
  misc_feature (163)..(163): n is a, c, g, or t
  misc_feature (180)..(180): n is a, c, g, or t
  misc_feature (193)..(194): n is a, c, g, or t
  misc_feature (211)..(211): n is a, c, g, or t
  misc_feature (213)..(214): n is a, c, g, or t
  misc_feature (252)..(252): n is a, c, g, or t
  misc_feature (265)..(265): n is a, c, g, or t
  misc_feature (315)..(315): n is a, c, g, or t
  misc_feature (337)..(337): n is a, c, g, or t
  misc_feature (339)..(339): n is a, c, g, or t
  misc_feature (347)..(347): n is a, c, g, or t
  misc_feature (448)..(448): n is a, c, g, or t
  misc_feature (453)..(453): n is a, c, g, or t
tctacacctgggnccgaagttcattnatatntttgtaggttagtctttaagaanatggaaaataaattaaaatggaaaatagggnnttnaattttaaangnagatnntattnaattatatgtagaatnataaaaattattagatagnggagntgagtatttanatttagatgttatggangggaagtttgttnntaatataatttttggananntagtagtaaaatgtttaaggaaaaaaataagaaatganttatttgaaaganatatgatggttgagaattgagaaaagtggattgaatttatggtagaaganaatgttaatttatatatatttnanatagaagntgtaataaatgatgttataaaagtgtgtaggaaagtaaaagaagaaggtatgaaagttggtttagtattaaaagtagggaaaggaattgaagatgttaggnaatanatagaatatgtagatatgattttggtaatgaatgtggagaatggatttggaggtgaaagggttatgagtgatatgatagagaaggtgtaatggttgaggaataattatttacttttagatattgaagtagatggaagagttgaattgattata

SEQ ID NO: 13004 - DNA, 173 bp, Diabrotica virgifera
  misc_feature (3)..(82): n is a, c, g, or t
  misc_feature (94)..(113): n is a, c, g, or t
  misc_feature (117)..(158): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnctcattgggggnnnnnnnnnnnnnnnnnnnnctcnnnnnnnnnnnnnnnnnnnnnnnnnnnnnnnnnnnnnnnnnncattttttttggatt

SEQ ID NO: 13005 - DNA, 710 bp, Diabrotica virgifera
  misc_feature (208)..(233): n is a, c, g, or t
ctctacgcgtccgccataattatttctaatttaattttacctgtgtgtgtattggtgattatttgcttttttaactttacttgaacgtaaagtatcaggttatattcaaattcggcacgggcctaataaagatggatttttgaggataattcaaccttttagtgatgctattaaattatttactaaagaactagtttagcctttgatnnnnnnnnnnnnnnnnnnnnnnnnnnctccaattttaaattcatttttagctttattgttatgaatgtgtataccttttgttactataaatgtaacttttaatttatcattattatgttgttgatcacgttctagtttaagggataataccaatatattggcctggatgatcgtctactgctaattatgctttattaggaaggttacgtcctattgctcaaacaatttcttatgaaataagattaactacaatttgattatcttttttattatcaattatagctttgaatatcttaaattctatgatatatgaatgaatatatttgatgtttttattgattctttccatgatgactatgatgaattggttctggattagcacatgaaatcgtactccttttgattttgctgaaggagaatcagactgacgtacaggatatgatgccgaatagttaagtgcaggatttgcaataatgttttcatgtgaatatggagagactata

SEQ ID NO: 13006 - DNA, 919 bp, Diabrotica virgifera
  misc_feature (14)..(719): n is a, c, g, or t
  misc_feature (726)..(763): n is a, c, g, or t
  misc_feature (785)..(785): n is a, c, g, or t
  misc_feature (799)..(821): n is a, c, g, or t
  misc_feature (829)..(850): n is a, c, g, or t
  misc_feature (874)..(874): n is a, c, g, or t
  misc_feature (880)..(911): n is a, c, g, or t
cttctagcgtccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnagtttaaaccggtgtgagccaggntggttnnnnnnnnnnnnnnnnnnnnnnnnnnnnnnnngaaaggac

SEQ ID NO: 13007 - DNA, 974 bp, Diabrotica virgifera
  misc_feature (238)..(252): n is a, c, g, or t
ctcccccagcgtccggacagatttagatcaacaacaagtagaacatttagattttgggcaaaaagttgaaaatgttctacatcaagtaactggaggaaaggtgcatttaaaacctttaaatcaagggcagcaagtagaagaccttagtcaacagcaacagacagatttagatcaacaacaaatagaacatttagattttgggcaaaaagttgaaaatgttctacatcaagtaactggnnnnnnnnnnnnnnnaaaacctatagatcaaagtcagcaagtagaagaccttagtcaacagcaacaggtagattttggccaacaaattgaagaggggggaaaaatacatcaaacaaatggaggaaaaatacagcaaaaaaaccttgaccaaaatcaacaaaccgaagatcttagccaacaacaacagatagactttggccagcaaattgaagaagagaccaccactataggccaggaaattgaagagacgaccactgtagtctaccagaaagtcgaaaatatcgaccaacaacagcaaattgattttggtcaacaaatagaagaaacccacttagatcagagcaaattgcatttaaaacctttagatcaatctcaacaacaagaagaacttggtcaagagcaagaagaagtcaactttactataggtccacaagttgaagacgactttcctcatggaaaccaaggaaaaattcaaattggtggttcacaggatcaagaacaggaacaggacactcaacaagtggaacagcagatcagtggttggcacgaccaaccaagaatacaacaaaagccattagaccaaagccaagagccaactgacacacagcaagttgaaatttttgatgtgaattcagtaaagggtactgatgatcacctacccaaagacattttgaaaaaaggttaattttattgaggataagctatcaaaacaagtagaagctgcatcaataggattt

SEQ ID NO: 13008 - DNA, 811 bp, Diabrotica virgifera
  misc_feature (64)..(123): n is a, c, g, or t
  misc_feature (284)..(317): n is a, c, g, or t
gttggagagcctatagtggagcaactccggacacttttgaaccttcgttgtgcactcatttaannnnnnnnnnnnnnnnnnnnnnnnnnnnnnnnnnnnnnnnnnnnnnnnnnnnnnnnnnnnttaaatataaagggatgggtttgtttaagatgacaactgatttaaaaaagaggaacaaaagtttaaaagtattactaagcgttggtggtagcggaggcacgaactcatcactttttagagaacttgctaacaataacaataaaacaaaagctttcttatcnnnnnnnnnnnnnnnnnnnnnnnnnnnnnnnnnngatggattggatatattttggttctacccagaagtggatgataaggagagatatatccgtctgttagagaaaataaagaataactttaagaagcaaagatggctattatgtgtgaccgtacgacctggattggaagatgcgggatacgatcctaagaaaatggatgggatagtggactgggtgaatctcaaaacttatgatttttacggaagttggagttcttccactggcaatcataactctctttatttttcctcaaaagagtataattgggaaaaggaacattctaacatagcggcagccgctaagaactggctcaatgcaggcctatccaaagagaagacggttttaggtgttgcattctatggagtgaggtttgaggtgaaagctaagcaatgaaactggtatacatgctcctgtaagaaagggatgtgcccttggagagcttagatatttttgagatttgttctcttacgaaaactttaccaaagtat

SEQ ID NO: 13009 - DNA, 875 bp, Diabrotica virgifera
  misc_feature (25)..(48): n is a, c, g, or t
  misc_feature (61)..(78): n is a, c, g, or t
  misc_feature (112)..(134): n is a, c, g, or t
  misc_feature (360)..(380): n is a, c, g, or t
  misc_feature (459)..(478): n is a, c, g, or t
  misc_feature (543)..(591): n is a, c, g, or t
  misc_feature (731)..(751): n is a, c, g, or t
cttacccgcgtccgccaattctctnnnnnnnnnnnnnnnnnnnnnnnngtcatcctgaagnnnnnnnnnnnnnnnnnncaggatttggattaatttctcatattgttaggcnnnnnnnnnnnnnnnnnnnnnnntttggtactttaggaataatttatgctataatagcaattggcttattaggttttattgtttgagctcatcatatatttacagttggaatggatgttgatacccgagcttattttacctcagcaactataattattgctgtaccaactggaattaaagtatttagatgattagctacttatcatggaactactattacatatagtccagtaacactctgagctttannnnnnnnnnnnnnnnnnnnngttggaggattaacaggggtagttttagcaaactcctcaattgatattgtacttcatgatacctattatgttgttgcannnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaatttgccatattatcatcaaat

SEQ ID NO: 13010 - DNA, 592 bp, Diabrotica virgifera
  misc_feature (17)..(17): n is a, c, g, or t
  misc_feature (43)..(63): n is a, c, g, or t
  misc_feature (520)..(520): n is a, c, g, or t
tttaccaaggtccggtntttattgtgagtgtggtgggtttccnnnnnnnnnnnnnnnnnnnnnttaggttggtgatagtatgtttatttgtaaatgtgaaattatttggttttcttgtttttagattgagatttgtagaagtttttaaattaaagaattgtagaagtgatgtgagaagtaaaaatgaataaataagaattatgtaaattgatgaagataggaatggtaagaagttggttatttaatgtataaggtgtaataataaaggtgttaatgaggatgatgatattggtgatgttttaagtaaatatgagggtattgtagatgagaattatgttatatagtttgttgaagaaagtataagatttggtaaaagttgaaggaatgaagagagaagaattggatgatgtaagaatatgggatgagtaaggagtataaggagttaggagttttaatgattaatggttgaatgattgataagtttaatatttgtagataatgttgtaagagaatgagtaanataggtgggattgaatatgaattattggtggaataaaaaaagttggttggaagtatttgaatgttgaatatt

SEQ ID NO: 13011 - DNA, 870 bp, Diabrotica virgifera
  misc_feature (448)..(470): n is a, c, g, or t
ggatttaattgcttccgcgggtgagcaggtttgacgggctgtcattaccacctgttctacgtttcgcttgaccggccgcagtatggttctctacacaatcacagtgatcaactgtgaaaatgcccagctttggtagattcagagaagtttttcgacgctgcctctccgtataatactagaacgtctcagcaagactactgagattataaagaacatcaataacagaaagctggagtacttagaacatgtaatgagatgtgtcaaatatgctaaataatgtaatgagatgtgtcaaatatgctaaaaaatatgcaagggaaaatagcagaaagaaaaaaactttatagttgaaaaacttgcgtgattggtatagtattgatacaagcattctatttagggtggcagtcagtggtgtcatggtgcgggaacgccgttccggcactggttnnnnnnnnnnnnnnnnnnnnnnngagaatttgggttttgtaaacaaaaattagcagtgcgttccggcactgctaattttgccatgacaccactggtggcagtgaataaaattaagatagctatgatggtaaccaacgttctgaaaggacttggtacatgaagaagaagaaggactctcatcaccactgttaacaccattttaaataatggtcaaatgatgtgacatcacatgtgaatttaatgaactacagtagaaccccgcaaatccgaactaattggggggacagcctgttcggattccgaaaagttcggattatccgaaagttagccttaactagtagttcaaagctttcattgtgatattgagtagccaaacgttctcgcaagagtgtggacaatattttttggactcccagttgacta

SEQ ID NO: 13012 - DNA, 591 bp, Diabrotica virgifera
gttgataaaatttaaacaaatatacttaaattgtacatactttcatttattaaattaagttgtaaaatctagtaataattatggacgaagacttcgacgaggacgacttcgaagaactaatattagacgatgatggagttatttacgaagaggaacctgttgaacatatgttagatgatatcagtctacaagatcaaaataatgaagaaattgaggaacaaataattgatgtatcatccctcactctccaaaaacacaaaaaagccgtttttagttcagctttgagcaaagatgatacgttagccataacagggggagaagatgatatagcttatctctggaacactgaaactggtgaagtactatttgaattttcaggccataaagattctgttactgaagttcattttaactttgatggtcaatatgtcactactggtgatatggggggtatgatacaaggatggagtttaaaagagaaaagactagcatggtgttatgaaggagatgatgtggagtgggtgaagtgggatccgtttgcaaatgctgtattttgcggttgagagtcatgagatgtctattgatgggaga

SEQ ID NO: 13013 - DNA, 732 bp, Diabrotica virgifera
  misc_feature (160)..(182): n is a, c, g, or t
  misc_feature (187)..(205): n is a, c, g, or t
  misc_feature (540)..(558): n is a, c, g, or t
gtccattctcagcgtccgatttgattcaatttttattaaacagcttatggcatagctgtttgctgcttcaataggttttattttcgaaaaaagtatcttgagcaaacacttgaatttgaagaggtaaaagtaaaaatgactagtaattataatacttatnnnnnnnnnnnnnnnnnnnnnnntgtcnnnnnnnnnnnnnnnnnnngtttaaatcctgatattttatttggtaacaagaaaaggtagctttaaccgaccgcgtggacactccactcatctttttatcccacaatcaatttaactttctttttttcccaaattatattaatatttccaatataattagtttgaaaccctcttcgaatcgttttttgcaaattattgttaaatcataatcttataatattatatcgttttagtaacacaaagattctattttattaatcatggactctcatttttctctggtctcttcaattagtagtacgaaaaaaatgttcttttgtcattgtttgggtaaacatatgcaaataaaattannnnnnnnnnnnnnnnnnntacattttttatatgtgatattgtaaactaaaattccataatagtattgtaaagtattgtaaatattttatgttataacatgatgtcccaaggaattggggatttttgtagtttcataagtttttagttgtaagaaaatacattttttatgaaacacgaaaaaattttgacaac

SEQ ID NO: 13014 - DNA, 907 bp, Diabrotica virgifera
caaaaaacgatttcatccagtaaccttttggttcattaggaagtgagacagaaaacacaatccaacgttatgaattacataagataagttggtttagaagtcaatgttggttgcctaaattggtaagtaatgacatggaatttttgtaatgtgcagaaaccagcagtgaaaacgaaatgaggtatatcttcgattatataggtttgttccaacacacgatttttgtacgttttagaaatcgtcacgaaaccgcctgtaccatttttaggagcatgttcatcatttgtaccgtccggtgacggtatttcgaaaccgatcctagtgcgcaggtcaccccaacccgtacttgcatttatccgtgtactgaaatgatcgtcacgaaactgtcactggactactggacgatcacaatttttgttggaacaatcggaaggacgatgtgatgaactgtttgttggaacgtgttttgtttactgcgcaggagcgtgatcgtttcatgacggtttttcatttgtttggaataaaccttataacactagtaattttgcccgtcgccatgcgatgacagggatccaatcaattgccatcttttttttcctgactccctccttttttatcgtgcctctctttaattgttccttactccctcctgttatcatttacgggagccaacgcattcacacactttcacgggtgtaaatccattcgcatatgtacattcaagtaagtaaattcattcacacaaattttcttggattaattttttgcggaaacagccgcaaggaaaattaattttcacctctgacaacctcaccctatctctcaaaatccgacttctgaaatgttatgtattccccggttgtgttatatgaaaatgaaggcgtacaaaatgatctcaacattaatg

SEQ ID NO: 13015 - DNA, 957 bp, Diabrotica virgifera
  misc_feature (926)..(927): n is a, c, g, or t
tacataacacaagttgtggatgaccacgcagcattgtttatgaagaattttctctctgcattcttctatcaaaatattatattggtacaaaagagaattgtgatcctatctttagaagccttgcctccaatgcccctttctcctttcagggtataagttttcttgggtaatgctctaaactctaaaaaataatcccgtctcatctgcgttaataataggtttgttccaacacaacgaaaacctcatcatgtaacgatcatcgtcctgcgcagtgaacaaaataacccatggaatgcacgatatacagtgtatatcgcacgatatacaacccatgtatgttggaacaaaactcaacgcttagattccttgcaacttctaatgccttttcttgaataattttaccagaaacaggaatatttttagaccgcacttcacaaaaaatcgaaaacaattatttataggtctaatgctgtaccatcggttttcaaaaattttcttttcgcttccaggtgaccgttctcataaaactgattgattatatcacttttatgattcaaaatttcactggcttgaggttttctaattccaaatttttcagctagctgtctaacatttaacttatgcttctctccataatgaaccacatcgactttttctttcaaacttaaaaaaatctaatagacacaaaatttattatgaaatgtaatccaaaaataatgtttttaaggaaacattcataaaaatacgacatctattgcatatgcttaatcagacattccgcttaaaattattaaatccttgttccagtcaaaacacaagtcaaaacaaccgaccaacaaaaacataaaatttttttacttcttatatattgttgataacgtgaacagtaccaattatcatttcgtggacatcctgtattgatttgnnaataataatgtattatctactgacgattta

SEQ ID NO: 13016 - DNA, 596 bp, Diabrotica virgifera
  misc_feature (28)..(29): n is a, c, g, or t
  misc_feature (35)..(35): n is a, c, g, or t
  misc_feature (63)..(64): n is a, c, g, or t
  misc_feature (68)..(68): n is a, c, g, or t
  misc_feature (79)..(80): n is a, c, g, or t
  misc_feature (84)..(84): n is a, c, g, or t
  misc_feature (86)..(86): n is a, c, g, or t
  misc_feature (88)..(88): n is a, c, g, or t
  misc_feature (98)..(98): n is a, c, g, or t
  misc_feature (101)..(102): n is a, c, g, or t
  misc_feature (111)..(111): n is a, c, g, or t
  misc_feature (115)..(115): n is a, c, g, or t
  misc_feature (152)..(153): n is a, c, g, or t
  misc_feature (208)..(208): n is a, c, g, or t
  misc_feature (366)..(366): n is a, c, g, or t
  misc_feature (431)..(431): n is a, c, g, or t
tttaccctctaaggggccgaaagaaagnntggagntacattgaggaattccgttaataggggnnttangatgatgaagnnaatnananttattgttanaannaagagttangagnttgtaagaatgggtgtgtgaggtggagaaattggaannttataggaataggtagttgggggtaggatagttgagagttttgaagaggttagtngtgaaaaaattggtgatggtggtttggtatgagaaattgaatttggtataagtaaggatagaatgttggttattgaagaatgttaaaattgaagggaagttatgattgttgtaagaggaggtaattaaatgttagtaggtgaaaggaagagaagtatngatgatgtattatgtgttgttaggagtttagttaaagaaataagagtagtgtatggtggtggagnagtagaaattggttgttgtttggtagtggtgggtcaagcagatcaactaactatccgtggaacagaacgcctatcgtgcatgtgctgaagacttagaaagtgataccacttgctgttgtatgataacagggggctatctgcggatcatacgctaggagaagtcac

SEQ ID NO: 13017 - DNA, 644 bp, Diabrotica virgifera
  misc_feature (536)..(553): n is a, c, g, or t
aaagaaaatgggaagcgtgtaaagcgttctcatatcttttaaatctgagaaattagtgataattctatttaaacatagtagatagagatttaataaaatgatggaaacagatgaacgtttacacattgattggggcaatgataaattacataggacgcaaaagcaagtcgaaaggaacccttacgacttagaatcgtggtctattcttcttagagaatcccaaattaaacatatttcagaagttcgtgccctctatgaacatttgattggtatttttccaagtgcttccagatattggaggatataccattgaacatgaaaggagaggaagaaattcttgactatgccgctacgatatttcatggaggagtaatgcaaagtctacgaaatgttctagtggccaagaaaattggaaccgctactgcagacttctgctagaatgtcaaacgtcgatctaatctcaggattaaaggtatatttctgagaaagaatgtttttaccctaagtgtgagctttaaatgccgtgatgaatgtgnnnnnnnnnnnnnnnnnnggtcagttggtttctatattttagcagaatgttacacttatcgactaaaggaactgatgttctttatttatacattttatatattactttg

SEQ ID NO: 13018 - DNA, 554 bp, Diabrotica virgifera
ctggaatgcgaggaccaattttactcctccttacaattatctactgttaagtcagagattaataataataattgtcaattgacaaccaagtcagtcgttcccgaaattgtgattactaatgacaaggttaaacccgacaatgaagatgaagtgaccaagaagatcgatgtgaaagaaagaatttcgaacacgaggaagttgtttggtaatcttaaagaagtcgagagaacgagaagagctactagtatgctaattcttaggtattttaaatacttcgagacgacacaggatgtcaagtttatatcgatagtgtgatctgaacatctcaagaggaatagtctaaggcacttctattagaactggcaccacagcaagaagaaggcattaaccaaaacttcgtaaaattgcagagtagatttagccaaaaactccatctaaaaggacttagagaaaattgctaaatacttgtaaatcgcatcagaattattgctaatagtctcattaaatctgatgaaagaatgtcaaaataaagtccattgtataggatattcaat

SEQ ID NO: 13019 - DNA, 100 bp, Diabrotica virgifera
  misc_feature (26)..(61): n is a, c, g, or t
  misc_feature (68)..(92): n is a, c, g, or t
cacatttttttacagacgagaaagannnnnnnnnnnnnnnnnnnnnnnnnnnnnnnnnnnngtattgnnnnnnnnnnnnnnnnnnnnnnnnnctcgcggt

SEQ ID NO: 13020 - DNA, 62 bp, Diabrotica virgifera
agatgaaggtactagttctgttttctttagtcgtactcagcgttgctctaccacactccttg

SEQ ID NO: 13021 - DNA, 941 bp, Diabrotica virgifera
  misc_feature (12)..(12): n is a, c, g, or t
  misc_feature (14)..(14): n is a, c, g, or t
  misc_feature (38)..(59): n is a, c, g, or t
  misc_feature (66)..(66): n is a, c, g, or t
  misc_feature (72)..(72): n is a, c, g, or t
  misc_feature (78)..(79): n is a, c, g, or t
  misc_feature (86)..(86): n is a, c, g, or t
  misc_feature (96)..(96): n is a, c, g, or t
  misc_feature (100)..(100): n is a, c, g, or t
  misc_feature (113)..(113): n is a, c, g, or t
  misc_feature (125)..(125): n is a, c, g, or t
  misc_feature (130)..(131): n is a, c, g, or t
  misc_feature (136)..(136): n is a, c, g, or t
  misc_feature (138)..(140): n is a, c, g, or t
  misc_feature (156)..(156): n is a, c, g, or t
  misc_feature (169)..(170): n is a, c, g, or t
  misc_feature (178)..(178): n is a, c, g, or t
  misc_feature (193)..(193): n is a, c, g, or t
  misc_feature (196)..(197): n is a, c, g, or t
  misc_feature (199)..(199): n is a, c, g, or t
  misc_feature (212)..(212): n is a, c, g, or t
  misc_feature (214)..(215): n is a, c, g, or t
  misc_feature (246)..(246): n is a, c, g, or t
  misc_feature (248)..(248): n is a, c, g, or t
  misc_feature (253)..(253): n is a, c, g, or t
  misc_feature (256)..(259): n is a, c, g, or t
  misc_feature (270)..(271): n is a, c, g, or t
  misc_feature (274)..(274): n is a, c, g, or t
  misc_feature (277)..(277): n is a, c, g, or t
  misc_feature (306)..(306): n is a, c, g, or t
  misc_feature (319)..(319): n is a, c, g, or t
  misc_feature (325)..(325): n is a, c, g, or t
  misc_feature (337)..(337): n is a, c, g, or t
  misc_feature (343)..(343): n is a, c, g, or t
  misc_feature (349)..(349): n is a, c, g, or t
  misc_feature (364)..(364): n is a, c, g, or t
  misc_feature (366)..(366): n is a, c, g, or t
  misc_feature (378)..(378): n is a, c, g, or t
  misc_feature (395)..(395): n is a, c, g, or t
  misc_feature (398)..(398): n is a, c, g, or t
  misc_feature (421)..(422): n is a, c, g, or t
  misc_feature (427)..(427): n is a, c, g, or t
  misc_feature (429)..(429): n is a, c, g, or t
  misc_feature (439)..(439): n is a, c, g, or t
  misc_feature (448)..(448): n is a, c, g, or t
  misc_feature (453)..(453): n is a, c, g, or t
  misc_feature (458)..(458): n is a, c, g, or t
  misc_feature (466)..(466): n is a, c, g, or t
  misc_feature (481)..(481): n is a, c, g, or t
  misc_feature (484)..(485): n is a, c, g, or t
  misc_feature (490)..(491): n is a, c, g, or t
  misc_feature (508)..(508): n is a, c, g, or t
  misc_feature (520)..(520): n is a, c, g, or t
  misc_feature (540)..(541): n is a, c, g, or t
  misc_feature (543)..(543): n is a, c, g, or t
  misc_feature (551)..(552): n is a, c, g, or t
  misc_feature (561)..(562): n is a, c, g, or t
  misc_feature (565)..(565): n is a, c, g, or t
  misc_feature (579)..(579): n is a, c, g, or t
  misc_feature (587)..(587): n is a, c, g, or t
  misc_feature (589)..(589): n is a, c, g, or t
  misc_feature (604)..(604): n is a, c, g, or t
  misc_feature (610)..(611): n is a, c, g, or t
  misc_feature (624)..(624): n is a, c, g, or t
  misc_feature (648)..(648): n is a, c, g, or t
  misc_feature (676)..(676): n is a, c, g, or t
  misc_feature (688)..(688): n is a, c, g, or t
  misc_feature (693)..(693): n is a, c, g, or t
  misc_feature (775)..(775): n is a, c, g, or t
  misc_feature (813)..(813): n is a, c, g, or t
  misc_feature (831)..(844): n is a, c, g, or t
  misc_feature (847)..(920): n is a, c, g, or t
ccaccaggggtngnattttattgtattaaagtttttcnnnnnnnnnnnnnnnnnnnnnngttaatngttaanatagtnntgtttanaaaatgtttnttanaagaagtgattangataggggagtnaatannttttnannngaaggaagattatttnaagtagaatatgnnatagaagntattaagttaggatntanngntattggaatatgnannagtggtggagtagtggttggtgtagaaaaangnattanttnnnnattaatggaanntantangattgagaaaattgtagaagttgataaanatattggatgtgnggtttnaggatttatggnagattnaaggantatgatagatagagntngtgtggaatgtnagaattattggtttgtntanaatgaaaatataagtgtagaatnntgtgnanaaggtgtatnaaatttggntattnagttnggagattntgatgaagatggtgnagnnatgtnntagatttttggagtagnaattttgtttgntggtatagatgaaaaagganntnagttgtannatatggatnnatnaggaatatttgttnagtttgangnaaaggggataggatnaggatnngagggtgtatagnaaagtttataggaggtatattatngaagtatgattttggaagaagttattanaattgatttaanaattntaaaataagttatggaagaaaagttgaatttttaaaatgttgaggttatgaatatgaatttaaaagagatgtttaatatgtntaaaaaggaaaaagtggaaaaggtaattgttaaattgnttaaattaggaaaaaagnnnnnnnnnnnnnnggnnnnnnnnnnnnnnnnnnnnnnnnnnnnnnnnnnnnnnnnnnnnnnnnnnnnnnnnnnnnnnnnnnnnnnnnnnaaaaggatataagttttaggt

SEQ ID NO: 13022 - DNA, 580 bp, Diabrotica virgifera
  misc_feature (2)..(50): n is a, c, g, or t
  misc_feature (52)..(160): n is a, c, g, or t
  misc_feature (171)..(497): n is a, c, g, or t
  misc_feature (499)..(512): n is a, c, g, or t
  misc_feature (531)..(574): n is a, c, g, or t
gnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnntcggaacattttttttcannnnnnnnnnnnnnnnnnnnnnnnnnnnnnnnnnnnnnnnnnnncccctg

SEQ ID NO: 13023 - DNA, 353 bp, Diabrotica virgifera
  misc_feature (2)..(236): n is a, c, g, or t
  misc_feature (244)..(314): n is a, c, g, or t
  misc_feature (316)..(335): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggggnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnncctaaggggaaaacacgg

SEQ ID NO: 13024 - DNA, 830 bp, Diabrotica virgifera
  misc_feature (8)..(64): n is a, c, g, or t
  misc_feature (80)..(97): n is a, c, g, or t
  misc_feature (100)..(122): n is a, c, g, or t
  misc_feature (127)..(146): n is a, c, g, or t
  misc_feature (248)..(282): n is a, c, g, or t
  misc_feature (284)..(311): n is a, c, g, or t
  misc_feature (328)..(386): n is a, c, g, or t
  misc_feature (399)..(419): n is a, c, g, or t
  misc_feature (432)..(480): n is a, c, g, or t
  misc_feature (485)..(500): n is a, c, g, or t
  misc_feature (502)..(517): n is a, c, g, or t
  misc_feature (607)..(662): n is a, c, g, or t
  misc_feature (665)..(691): n is a, c, g, or t
  misc_feature (706)..(735): n is a, c, g, or t
  misc_feature (799)..(826): n is a, c, g, or t
tttttgtnnnnnnnnnnnnnnnnnnnnnnnnnnnnnnnnnnnnnnnnnnnnnnnnnnnnnnnnncattttcttataaaannnnnnnnnnnnnnnnnnggnnnnnnnnnnnnnnnnnnnnnnnggagnnnnnnnnnnnnnnnnnnnngttggggggggccggatcatctttcttttttctcaacaacaaaaaataaatagggtgtggggggggagggggtgccttgctctttctccccccccacaaggnnnnnnnnnnnnnnnnnnnnnnnnnnnnnnnnnnngnnnnnnnnnnnnnnnnnnnnnnnnnnnntgtgttgggggagggannnnnnnnnnnnnnnnnnnnnnnnnnnnnnnnnnnnnnnnnnnnnnnnnnnnnnnnnnnacaacaacaccannnnnnnnnnnnnnnnnnnnntgtttgtggtggnnnnnnnnnnnnnnnnnnnnnnnnnnnnnnnnnnnnnnnnnnnnnnnnnctttnnnnnnnnnnnnnnnngnnnnnnnnnnnnnnnncaaccacgcgcggcggggggggcgggggtggggggggcgggggtcgggttcccccaccccaaacacaaaacacacacagtttccccgtcnnnnnnnnnnnnnnnnnnnnnnnnnnnnnnnnnnnnnnnnnnnnnnnnnnnnnnnnttnnnnnnnnnnnnnnnnnnnnnnnnnnntgggaggatggggannnnnnnnnnnnnnnnnnnnnnnnnnnnnnccccacccgcgcgcgggggggggtgagcggcgggggtggggtgggaatcacaaacacaacacannnnnnnnnnnnnnnnnnnnnnnnnnnngtgc

SEQ ID NO: 13025 - DNA, 847 bp, Diabrotica virgifera
  misc_feature (22)..(54): n is a, c, g, or t
  misc_feature (79)..(130): n is a, c, g, or t
  misc_feature (166)..(254): n is a, c, g, or t
  misc_feature (274)..(294): n is a, c, g, or t
  misc_feature (300)..(329): n is a, c, g, or t
  misc_feature (340)..(413): n is a, c, g, or t
  misc_feature (429)..(496): n is a, c, g, or t
  misc_feature (500)..(552): n is a, c, g, or t
  misc_feature (557)..(673): n is a, c, g, or t
  misc_feature (675)..(792): n is a, c, g, or t
  misc_feature (794)..(811): n is a, c, g, or t
aaaaaaaggagggggccgcccnnnnnnnnnnnnnnnnnnnnnnnnnnnnnnnnnccggtgggggggggcgccccccccnnnnnnnnnnnnnnnnnnnnnnnnnnnnnnnnnnnnnnnnnnnnnnnnnnnnaggggtggtgttgtttttttgggggcgcgggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccctccctctcccgggnnnnnnnnnnnnnnnnnnnnncccccnnnnnnnnnnnnnnnnnnnnnnnnnnnnnntttttgggggnnnnnnnnnnnnnnnnnnnnnnnnnnnnnnnnnnnnnnnnnnnnnnnnnnnnnnnnnnnnnnnnnnnnnnnnnncttcctttttgttttnnnnnnnnnnnnnnnnnnnnnnnnnnnnnnnnnnnnnnnnnnnnnnnnnnnnnnnnnnnnnnnnnnnncttnnnnnnnnnnnnnnnnnnnnnnnnnnnnnnnnnnnnnnnnnnnnnnnnnnnnnccctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntnnnnnnnnnnnnnnnnnnaggggggggcggggaggggggggggaaggaagagag

SEQ ID NO: 13026 - DNA, 822 bp, Diabrotica virgifera
  misc_feature (215)..(233): n is a, c, g, or t
  misc_feature (713)..(734): n is a, c, g, or t
ctccgaaagaggtgtaatgttaacacagtaaagacgggtaaaagcgagagagatcgttcaaatttggcagttgcgtctactacttgtagcaaaatgtcgtcttccgatgacgatataattgctttagattctgttttgactaaactgaaaagaaagagagttgatgtacatcctattaatcgagatagattaatttatggagaatatcatcatcnnnnnnnnnnnnnnnnnnntaatgaacgattcttccagtacatgagaatgactcaagagacttttaaatatatttggagaaagtggagtatcgttaaaaacaatattaaacgctcaacttacagtcaaccaacagaatatcgaaagagttgagcaatatacatatttgggtacgaatttaaatagccaatgggactactcaacagaaattaaacagcgaataataaaagcgaaagcagcatacgttagaatgagacccattttcaacagtcgagatatatcattaaaaacaaaataccgtctgttgaaatgctacatattcacagttctgctctacggaatggaagcgtggacactaactgttgcatctatgaatcggctcgaagctttcgaaatgtggtgttataggcgcatcttacgtatatcctgggttgaccgaattactaatgtggaattcctgcgtagaatggggaaagagtgtgaaattcttcataaccatnnnnnnnnnnnnnnnnnnnnnntctaggacatgttttgagaaatcaggaacgttacggccttctcccaactgattctccaggggaaggtaaatggtaaaagaggacccgg

SEQ ID NO: 13027 - DNA, 326 bp, Diabrotica virgifera
  misc_feature (2)..(59): n is a, c, g, or t
  misc_feature (64)..(90): n is a, c, g, or t
  misc_feature (177)..(195): n is a, c, g, or t
  misc_feature (240)..(262): n is a, c, g, or t
  misc_feature (290)..(323): n is a, c, g, or t
gnnnnnnnnnnnnnnnnnnnnnnnnnnnnnnnnnnnnnnnnnnnnnnnnnnnnnnnnnncccannnnnnnnnnnnnnnnnnnnnnnnnnncctttagggataaaaggggaaattttttttggggaaggttcaaattcgaaaataaaaaattgggcgccccctccctgttgggatttnnnnnnnnnnnnnnnnnnnggggggagacaagctattattttatttaagtttcgggttcccgcnnnnnnnnnnnnnnnnnnnnnnnataggggttcttggggatttaaaaaccnnnnnnnnnnnnnnnnnnnnnnnnnnnnnnnnnntgt

SEQ ID NO: 13028 - DNA, 339 bp, Diabrotica virgifera
  misc_feature (24)..(27): n is a, c, g, or t
ataaggaacactttttatatttannnncttgagcagcccgcatcacatgagagttgatgcgcaactcatgctaaagagcgatggtcctttagtacgcgaagacagatacctgaaaccgctaaacaaccgagaggacgatacctcaacgcagcgaccatgcctccaaacgcagtagaagtccataatcagcaactatacactgtcgccgttagtcatcctgccaccgcgcctgaatatggtaaacacatagagccacacatcccggacaactcgaccatgtgcgacttgtacataaacagtagtgcgagcgtcacaagtcgcacaagaagacatgcttct

SEQ ID NO: 13029 - DNA, 829 bp, Diabrotica virgifera
  misc_feature (33)..(50): n is a, c, g, or t
  misc_feature (388)..(429): n is a, c, g, or t
gtatattatacataattatttacgcgaaaaagnnnnnnnnnnnnnnnnnncctgaaatggaaaatctgatgaactgtttttttcatctaagttaataataactgtttggacgatttttcctttaaagtatctaattctcatattttttgctcgtcattaatagtaacatattcaattctacatttctgccaattctccgcaatgatttctctaagtatttgttcaaaatatttccttatcacaggactgtaggagaataggatcaacatgggtagctggaaaactgagggaagtatttcgatcagatattcacatgtgcttgaaaagaaaggtctttgatcagtgtgtgcttccggttctgcttgtgtaatcgtatttgttcatttannnnnnnnnnnnnnnnnnnnnnnnnnnnnnnnnnnnnnnnnnttaaaaatgggtcatttttgatgtctcgaagttcctaaacctgatttccgatttgggtgattttttaatatgttagatatagtctcataggcataacagaggcccccgcagcatgaagcttgcgggggggggggggcatcttgtcgtctaatataatatgtaaaaatgtgttattgtgatgttagaataataaataatactatgtaataatgtaatcatttattaatttttgttctattttattctacatcaataaagatgaaatatataagttgtcataaacagtacttgaatatacctactaatagcaaagtaaatggccgttttagagtgtaattattagcgtcacgacggatttgcttgacattttgaacttatataattaggttctacttaccct

SEQ ID NO: 13030 - DNA, 103 bp, Diabrotica virgifera
  misc_feature (29)..(48): n is a, c, g, or t
gttatccaatagtctcactaagtacattnnnnnnnnnnnnnnnnnnnnaccagtggttcacctcctgagactgagactagctctattctactagtatatacac

SEQ ID NO: 13031 - DNA, 1029 bp, Diabrotica virgifera
  misc_feature (16)..(45): n is a, c, g, or t
  misc_feature (47)..(70): n is a, c, g, or t
  misc_feature (117)..(140): n is a, c, g, or t
  misc_feature (157)..(181): n is a, c, g, or t
  misc_feature (203)..(222): n is a, c, g, or t
  misc_feature (233)..(277): n is a, c, g, or t
  misc_feature (301)..(355): n is a, c, g, or t
  misc_feature (367)..(400): n is a, c, g, or t
  misc_feature (422)..(523): n is a, c, g, or t
  misc_feature (602)..(603): n is a, c, g, or t
  misc_feature (611)..(632): n is a, c, g, or t
  misc_feature (646)..(665): n is a, c, g, or t
  misc_feature (686)..(721): n is a, c, g, or t
  misc_feature (744)..(763): n is a, c, g, or t
  misc_feature (766)..(779): n is a, c, g, or t
  misc_feature (820)..(837): n is a, c, g, or t
  misc_feature (853)..(935): n is a, c, g, or t
  misc_feature (938)..(1013): n is a, c, g, or t
cccccacaccaccacnnnnnnnnnnnnnnnnnnnnnnnnnnnnnnannnnnnnnnnnnnnnnnnnnnnnncccacacccaccccaccccaccccccaccccccggtgggggtggggnnnnnnnnnnnnnnnnnnnnnnnnattgagagggagagagnnnnnnnnnnnnnnnnnnnnnnnnngaggagaggggagaaggggggnnnnnnnnnnnnnnnnnnnncacaaaccaannnnnnnnnnnnnnnnnnnnnnnnnnnnnnnnnnnnnnnnnnnnncttaagggggagggagccatccannnnnnnnnnnnnnnnnnnnnnnnnnnnnnnnnnnnnnnnnnnnnnnnnnnnnnntcggcgacgcannnnnnnnnnnnnnnnnnnnnnnnnnnnnnnnnntggctgggaaaaaaaagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggcgccgcccccccccccgcgcggggggggggaattttttttctcctctctctccccctcctcccccccccccctgnncgcccagnnnnnnnnnnnnnnnnnnnnnncaaggaaggaagcnnnnnnnnnnnnnnnnnnnngagaaaacccaagccgggggnnnnnnnnnnnnnnnnnnnnnnnnnnnnnnnnnnnncgcccgcaccctccccctctccnnnnnnnnnnnnnnnnnnnncannnnnnnnnnnnnnatatattttcttatatttgtgtgtgggtggggggcgtgggnnnnnnnnnnnnnnnnnncagacaacacaaaacnnnnnnnnnnnnnnnnnnnnnnnnnnnnnnnnnnnnnnnnnnnnnnnnnnnnnnnnnnnnnnnnnnnnnnnnnnnnnnnnnnnctnnnnnnnnnnnnnnnnnnnnnnnnnnnnnnnnnnnnnnnnnnnnnnnnnnnnnnnnnnnnnnnnnnnnnnnnnnnngtcgtgtttcccttcc

SEQ ID NO: 13032 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13033 - DNA, 628 bp, Diabrotica virgifera
  misc_feature (7)..(46): n is a, c, g, or t
  misc_feature (48)..(64): n is a, c, g, or t
  misc_feature (71)..(94): n is a, c, g, or t
  misc_feature (96)..(187): n is a, c, g, or t
  misc_feature (192)..(209): n is a, c, g, or t
  misc_feature (214)..(380): n is a, c, g, or t
  misc_feature (420)..(437): n is a, c, g, or t
  misc_feature (440)..(452): n is a, c, g, or t
  misc_feature (471)..(503): n is a, c, g, or t
  misc_feature (505)..(607): n is a, c, g, or t
tttatgnnnnnnnnnnnnnnnnnnnnnnnnnnnnnnnnnnnnnnnngnnnnnnnnnnnnnnnnnggggcgnnnnnnnnnnnnnnnnnnnnnnnntnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggagaacacacccccaccaccgcggccggagaaagnnnnnnnnnnnnnnnnnnggnnnnnnnnnnnnngtctatatatataaaatcnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttttttcttcggtccgctac

SEQ ID NO: 13034 - DNA, 638 bp, Diabrotica virgifera
  misc_feature (14)..(41): n is a, c, g, or t
  misc_feature (49)..(88): n is a, c, g, or t
  misc_feature (110)..(134): n is a, c, g, or t
  misc_feature (137)..(188): n is a, c, g, or t
  misc_feature (191)..(212): n is a, c, g, or t
  misc_feature (223)..(458): n is a, c, g, or t
  misc_feature (498)..(570): n is a, c, g, or t
  misc_feature (575)..(603): n is a, c, g, or t
  misc_feature (606)..(631): n is a, c, g, or t
ggggggtttgcttnnnnnnnnnnnnnnnnnnnnnnnnnnnngggggggnnnnnnnnnnnnnnnnnnnnnnnnnnnnnnnnnnnnnnnngtggtggtggggcgcccccccnnnnnnnnnnnnnnnnnnnnnnnnnaannnnnnnnnnnnnnnnnnnnnnnnnnnnnnnnnnnnnnnnnnnnnnnnnnnnttnnnnnnnnnnnnnnnnnnnnnnggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggggtgtgggtgttttcttttctctctcttttctctcnnnnnnnnnnnnnnnnnnnnnnnnnnnnnnnnnnnnnnnnnnnnnnnnnnnnnnnnnnnnnnnnnnnnnnnnnatcgnnnnnnnnnnnnnnnnnnnnnnnnnnnnngannnnnnnnnnnnnnnnnnnnnnnnnntgggggg

SEQ ID NO: 13035 - DNA, 727 bp, Diabrotica virgifera
  misc_feature (11)..(32): n is a, c, g, or t
  misc_feature (49)..(82): n is a, c, g, or t
  misc_feature (84)..(139): n is a, c, g, or t
  misc_feature (241)..(263): n is a, c, g, or t
  misc_feature (305)..(333): n is a, c, g, or t
  misc_feature (347)..(369): n is a, c, g, or t
  misc_feature (377)..(461): n is a, c, g, or t
  misc_feature (688)..(708): n is a, c, g, or t
  misc_feature (714)..(726): n is a, c, g, or t
ctaaattgaannnnnnnnnnnnnnnnnnnnnngtaataatggaattcannnnnnnnnnnnnnnnnnnnnnnnnnnnnnnnnnannnnnnnnnnnnnnnnnnnnnnnnnnnnnnnnnnnnnnnnnnnnnnnnnnnnnnnnatattttgaccgggctaaggtaccctaagcattatttttttgattgaaagctgtaatgcagggtaggatgaaaaaaacactgtctttatttaagttataagnnnnnnnnnnnnnnnnnnnnnnngcttatgatttttttataagacatagaagaccctatatagannnnnnnnnnnnnnnnnnnnnnnnnnnnncattaaaatcattnnnnnnnnnnnnnnnnnnnnnnngaagtgannnnnnnnnnnnnnnnnnnnnnnnnnnnnnnnnnnnnnnnnnnnnnnnnnnnnnnnnnnnnnnnnnnnnnnnnnnnnnnnnnnnnccttaaggataacagcgaacttttattgtagagtatcaaaacgataataccgattgcaacctcgatgatgtatatatggagaatacttgtcgaaacaactaaatgattcctccaggtcgacttatagaatattacatgagcagagtctataccattgagagccagctagttttctatctttacatgatcagaatattttacgacgagaggaccgaagatatcaatcnnnnnnnnnnnnnnnnnnnnnattacnnnnnnnnnnnnng

SEQ ID NO: 13036 - DNA, 129 bp, Diabrotica virgifera
  misc_feature (7)..(70): n is a, c, g, or t
  misc_feature (74)..(116): n is a, c, g, or t
gaattcnnnnnnnnnnnnnnnnnnnnnnnnnnnnnnnnnnnnnnnnnnnnnnnnnnnnnnnnnnnnnnnnattnnnnnnnnnnnnnnnnnnnnnnnnnnnnnnnnnnnnnnnnnnnctcattttactcg

SEQ ID NO: 13037 - DNA, 118 bp, Diabrotica virgifera
  misc_feature (70)..(70): n is a, c, g, or t
gttcagtttttggttaccttccagctccatttctgggtctagtttctttcaccttgcgacacccttttgnttttgttttttcttggtagagactacgtttggtttcgcatttatcaat

SEQ ID NO: 13038 - DNA, 570 bp, Diabrotica virgifera
  misc_feature (12)..(147): n is a, c, g, or t
  misc_feature (165)..(197): n is a, c, g, or t
  misc_feature (204)..(221): n is a, c, g, or t
  misc_feature (246)..(338): n is a, c, g, or t
  misc_feature (342)..(364): n is a, c, g, or t
  misc_feature (369)..(471): n is a, c, g, or t
  misc_feature (474)..(494): n is a, c, g, or t
  misc_feature (525)..(555): n is a, c, g, or t
ccgctccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaggggggggtgttnnnnnnnnnnnnnnnnnnnnnnnnnnnnnnnnnggtgctnnnnnnnnnnnnnnnnnnccccaccctcctttttttctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacannnnnnnnnnnnnnnnnnnnnnnattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnntggttttttgtttctcctcctccctcccctnnnnnnnnnnnnnnnnnnnnnnnnnnnnnnncggtgtccccccccc

SEQ ID NO: 13039 - DNA, 604 bp, Diabrotica virgifera
aaataattattttgtaacaatttgtattatttaagaatatcataattacattctggtttcgtagtaagtgtttttttaagaatattaatgtatagttttaaaatattgtattgcaaataattatcattattaaatggttattatttgtgaagtattattttgcttttttcacacccttatgtatgtaacaaaactaagggactttctgaaaggtaaatcgtagacgttaaagacacaaaagaagcgatacttaaaagttacataaagaattcgagacaacgctgttggtgccgtcattgactccgcccgctatatatctgtatatcgtgggaaatatacaatacaacacgagctccaatcgctcgactaatactctttagagctggcatcagtgtgtgatctcgcgttgatcggtaaatatctaaaatttcgtatataagtcctcccctttacttttcagctacggatctcgtttcagtgtaaatttatcagaaaaatttaagtaccaaaatcttttcccctctaagtgtggcatgattaatatggtaattattaagatagttatgaacaatatactccaataattaatttcctaatggtggat

SEQ ID NO: 13040 - DNA, 244 bp, Diabrotica virgifera
  misc_feature (139)..(139): n is a, c, g, or t
  misc_feature (175)..(175): n is a, c, g, or t
gtcatgaagggcgtttgcgtttgtgaattaatggacaagtgatttaaagtatttacggtaaatatcggttttattaataaaagagtggttgtgttcaaatattattgcttcaccgaatagatagccagctttgctggtnattttaacaatgacaacggactcatatagtgagggngacccaccttgcacagaattgcgagatacgatacacggggtactctcgctagctttcgacgtctcgatc

SEQ ID NO: 13041 - DNA, 159 bp, Diabrotica virgifera
  misc_feature (6)..(59): n is a, c, g, or t
  misc_feature (108)..(125): n is a, c, g, or t
  misc_feature (127)..(149): n is a, c, g, or t
gggggnnnnnnnnnnnnnnnnnnnnnnnnnnnnnnnnnnnnnnnnnnnnnnnnnnnnnngatccattttttttgttccaaaaaaaatttaccttagggataacaagcnnnnnnnnnnnnnnnnnngnnnnnnnnnnnnnnnnnnnnnnngaacccccca

SEQ ID NO: 13042 - DNA, 530 bp, Diabrotica virgifera
  misc_feature (10)..(111): n is a, c, g, or t
  misc_feature (156)..(226): n is a, c, g, or t
  misc_feature (236)..(276): n is a, c, g, or t
  misc_feature (281)..(360): n is a, c, g, or t
  misc_feature (409)..(500): n is a, c, g, or t
ataaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccccccctcctccccccccgcgcggcggggggagggggaannnnnnnnnnnnnnnnnnnnnnnnnnnnnnnnnnnnnnnnnnnnnnnnnnnnnnnnnnnnnnnnnnnnnnntgggtgtgtnnnnnnnnnnnnnnnnnnnnnnnnnnnnnnnnnnnnnnnnngcgcnnnnnnnnnnnnnnnnnnnnnnnnnnnnnnnnnnnnnnnnnnnnnnnnnnnnnnnnnnnnnnnnnnnnnnnnnnnnnnnngaaaagggaggggcggagggcggggcgggcgcgcccacccccccacgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaggggacagcgggcggggtgttgttgtt

SEQ ID NO: 13043 - DNA, 58 bp, Diabrotica virgifera
  misc_feature (8)..(55): n is a, c, g, or t
aaataagnnnnnnnnnnnnnnnnnnnnnnnnnnnnnnnnnnnnnnnnnnnnnnnngtg

SEQ ID NO: 13044 - DNA, 574 bp, Diabrotica virgifera
  misc_feature (2)..(25): n is a, c, g, or t
  misc_feature (29)..(55): n is a, c, g, or t
  misc_feature (59)..(93): n is a, c, g, or t
  misc_feature (98)..(133): n is a, c, g, or t
  misc_feature (145)..(169): n is a, c, g, or t
  misc_feature (224)..(262): n is a, c, g, or t
  misc_feature (265)..(325): n is a, c, g, or t
  misc_feature (339)..(339): n is a, c, g, or t
  misc_feature (345)..(466): n is a, c, g, or t
  misc_feature (481)..(531): n is a, c, g, or t
  misc_feature (533)..(557): n is a, c, g, or t
gnnnnnnnnnnnnnnnnnnnnnnnnaccnnnnnnnnnnnnnnnnnnnnnnnnnnncccnnnnnnnnnnnnnnnnnnnnnnnnnnnnnnnnnnntgggnnnnnnnnnnnnnnnnnnnnnnnnnnnnnnnnnnnncggggcgggggnnnnnnnnnnnnnnnnnnnnnnnnnttcatctcccccccccaaggggagggggtgggtgttgttttttggtttttgtgtnnnnnnnnnnnnnnnnnnnnnnnnnnnnnnnnnnnnnnntcnnnnnnnnnnnnnnnnnnnnnnnnnnnnnnnnnnnnnnnnnnnnnnnnnnnnnnnnnnnnnctcccccccccgcngggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcgggaaccaaannnnnnnnnnnnnnnnnnnnnnnnnnnnnnnnnnnnnnnnnnnnnnnnnnncnnnnnnnnnnnnnnnnnnnnnnnnngggttgttgttgggtgg

SEQ ID NO: 13045 - DNA, 884 bp, Diabrotica virgifera
  misc_feature (812)..(812): n is a, c, g, or t
ctcctatagaacccgaaataccaccaaatatccccacttcagaactaaacaatgctacaccctcaaaaacgcccgcatacaaacgtggccactctgaagtcgaaagtactagtgagcagaccgatattcccgataacacatccgtcacaaatctgtccgaggataacatcatgcctccccctagtaatgatattaagaaaccaaaaaagaaacccagaacaagttcagcctcagatcgttacctttgtgatttaacaaaagactctatcaaagaagcctttaagaaaacctcagaatcacttgttattcccccagaaaacttgatagcctttattgaaaacacttttggatgtagtaacccctacgctgaagctcttaagtttacagaaaatgttccagggctaattgctaacattcaagcattgcacccagcttgtcaggagaggtctacgaaaagtaggttaacccgtctaaccaaaaaactgagaaaggccttgaacactgatccagaagaccccgaaaatttgtccaacccaaagctttcctccgatcataccgaagacaactataattctgatagttcagaatcatcccaatcctctcaaatcagctcttattaatactaacattatgttaagactaattcagtggaattgtgatgggttttatcccagactagaatacttacaaaaacttatatcggactgttcgcccaattttatttgtctccaagaaaccaatttcaccaaagctcacaacccttatctaaaacactacaccagttacaactttttaagaccaacacacctacngaacaagtggaggtcatctctatttttgtttctaacgatatctttctcatcagagtttgacctacacacaag

SEQ ID NO: 13046 - DNA, 60 bp, Diabrotica virgifera
  misc_feature (2)..(52): n is a, c, g, or t
cnnnnnnnnnnnnnnnnnnnnnnnnnnnnnnnnnnnnnnnnnnnnnnnnnnncatttttt

SEQ ID NO: 13047 - DNA, 321 bp, Diabrotica virgifera
aaggagaatgagtgaggtagtattgtactaccataaagaagaggttattttgtgtacctggtaggtcggggatgattaactaacaattatatatgtattagtatcagaacaagaggtagcctaacaatgacaacacatagtggaaaggcaagattctaagtcagtttttatgataccgtcactggattcgttacaaagtatatgtacagtatatgaagaaaacgtgaaaacttacctattaacaatatatttgtaattaattacttttatattattaatagtaggtaacgttaaggatgagcttacaaagataattctatt

SEQ ID NO: 13048 - DNA, 1066 bp, Diabrotica virgifera
  misc_feature (99)..(128): n is a, c, g, or t
  misc_feature (293)..(311): n is a, c, g, or t
  misc_feature (339)..(361): n is a, c, g, or t
  misc_feature (1041)..(1062): n is a, c, g, or t
acatttaagatagaaacttagatagaaccttgtaacttacgtatttcagccacctgttaatatatatcgttgctagtatcatattaaggtgaagaacannnnnnnnnnnnnnnnnnnnnnnnnnnnnntttagacaaaaattacagataaaaccttgttattctgacgcaacgaattgtaaaatattacacaaatttgaaaaaaaatgtatccattaatatattataacaccctgtgaatttagattataagtaggcttagatgttaaattaaacattgttattgtaataccnnnnnnnnnnnnnnnnnnngtctggctaattggctaagccaaagccnnnnnnnnnnnnnnnnnnnnnnnattcatgcaagttctttgaaaagacattttaatgtgcacgctggggaaaacgtgggaaatttgttttaagcagttttctcacaaatgttttttgaaaatatgttatgagagtacctacatttatttatttgtgttaagagcacacagtggcgatcagcaggtggcagcaagcgcggtccaagattgcggttccaattttgaatatttggtcgaaatatttggcacacattcgtaatataataaagaatgacggtacagagcccaatttcagaaatatgttagtatgtggaaattactctataacaaaaagaagcctgtaccgccattaagaacgacaaaaaatactctttcttcaaataaacatttttatcccgtccctagattttgtgtcacatttgatctactaaaaatcgagttttttataacaagaaatagaacgtcactgacttcggcaatatttcgcgcccatgtgtataaaaattattgtttttgatagtataaacggcacctgtcagtggccaatttaccgacgtactggtgcctcactttcgaaagttccaaaaaattttcacatcttgggaccgcgtttggtggcctaccggtggatcgatactggggggctcctttaggtttaaaaaggctttggtaaagattagggtaaaaaatgtgggacgctttcnnnnnnnnnnnnnnnnnnnnnnccac

SEQ ID NO: 13049 - DNA, 287 bp, Diabrotica virgifera
  misc_feature (2)..(170): n is a, c, g, or t
  misc_feature (172)..(260): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctctagggataacagcgtaatttta

SEQ ID NO: 13050 - DNA, 66 bp, Diabrotica virgifera
agaagaaggtgcatgacaggcacatgtagctcagcatgtcattactgctgtgatacaaagtatgcc

SEQ ID NO: 13051 - DNA, 61 bp, Diabrotica virgifera
  misc_feature (2)..(15): n is a, c, g, or t
  misc_feature (17)..(37): n is a, c, g, or t
tnnnnnnnnnnnnnncnnnnnnnnnnnnnnnnnnnnnttaaaaaagcttacaatttttttt

SEQ ID NO: 13052 - DNA, 207 bp, Diabrotica virgifera
  misc_feature (52)..(69): n is a, c, g, or t
  misc_feature (80)..(95): n is a, c, g, or t
  misc_feature (97)..(109): n is a, c, g, or t
ttttcctttttaaaatggatttattttcttaaattatacaaactcatgttannnnnnnnnnnnnnnnnntaataaatctnnnnnnnnnnnnnnnncnnnnnnnnnnnnnagataacatcagaaaaccaaaaacattttcctgtatttgacataatagttaagtgcagtagacactagaagctcaaacatctgctacatacaacgagc

SEQ ID NO: 13053 - DNA, 901 bp, Diabrotica virgifera
  misc_feature (103)..(142): n is a, c, g, or t
  misc_feature (510)..(528): n is a, c, g, or t
  misc_feature (753)..(753): n is a, c, g, or t
aaagagtaactttgatacagtttgaattttgaaactcttttgtggcgcgtttatttcaaatttagcagagattatggaaaggtcttttgaaataaaactagannnnnnnnnnnnnnnnnnnnnnnnnnnnnnnnnnnnnnnncgtagtattcatatcaggttttttttaagctggagtattgtatgcgccactcatttttgcggcgtttggaggttttttttattcttgttgcatttataaaatggtattttatttgattcgtatagtcttataaattgtacagattatattcgtagatatattatatgattcgtaaataatttttttttcgattatagcgccatccatcgacaactagaataaatgttataaatgtctgtaatcacggacgtgcctttttttctgtcacatacaatttaatgcgttagattagaaagaaatcgaaaaactgtgacgcactgaaagatgctcatgagaaaaagaatagtgattttatgtccaaaacgtgnnnnnnnnnnnnnnnnnnnccttcctaaactctctagctccagatgctgtaagagcgctggctttagttcaagatggtcctgaaacactaacattaaccaaagcaagggtgtcaaagcttagaatagaacagcggaacatggaaagatccattctaggaataagacttatggatcgagtgagaaatttagaaataaggcaaagaacgggtgtgcaagagattatagaaagaatttccagattanaatggagtttcgccggacacatagcgagattgcaggatgacaggtggataaaaaaactgttagaatggagacctcgcatggacaagagaagcagaggcagaccaccacacgctggagacgacataaaaagaatagatggtagatggat

SEQ ID NO: 13054 - DNA, 537 bp, Diabrotica virgifera
  misc_feature (40)..(40): n is a, c, g, or t
  misc_feature (112)..(227): n is a, c, g, or t
  misc_feature (305)..(335): n is a, c, g, or t
tctttcgacgcgtccgagagaacacgaaaaagagaaaaanaggcctttttgtgatccctaaaaatatttaatatataatagtataaaagtattttgagggaggagcttaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttattaaggatcgatattcgcggttctactgggatggatcctgtgcgagaaagggggacctagttggcccagtgagnnnnnnnnnnnnnnnnnnnnnnnnnnnnnnnaatgcgtggatctggaagcaggagtaggttgtttaggggggcacccgactatggacgtgaggatgcaattcataattttacttatgatagaggaaaatacagtgtgagagattacacgcgcatcatgtgcttgcaaaaggtgagcgcgaatgtcttaggtttctggtactttaggagatgaaccgaggacgaagattgccgt

SEQ ID NO: 13055 - DNA, 131 bp, Diabrotica virgifera
  misc_feature (2)..(33): n is a, c, g, or t
  misc_feature (69)..(104): n is a, c, g, or t
  misc_feature (120)..(120): n is a, c, g, or t
gnnnnnnnnnnnnnnnnnnnnnnnnnnnnnnnncgaaatgaaaggggaggaagaaaaagaaactgtccnnnnnnnnnnnnnnnnnnnnnnnnnnnnnnnnnnnntctcaacagtcttaanttttttttgaa

SEQ ID NO: 13056 - DNA, 665 bp, Diabrotica virgifera
  misc_feature (108)..(148): n is a, c, g, or t
cccacgcgtccccttttatttacttagccaattgttatgtaggtttaaagcatgttagatttattggtgttggattttagataagggatacttgctgttttattaggnnnnnnnnnnnnnnnnnnnnnnnnnnnnnnnnnnnnnnnnnagattaattacccaacggctgttatgtttgatatttaataacactgggtgtgtgattctgatagacagatctggcgcttccaaagtactaaaaactttaaacaaacacattctctgtgaaacagctattattttctactaatatcctttacccatttctaatatatactccaattcgtgattttactctgcacaccctgatgggcttacctatccccactctatttcgtatattcgtgtatatcctgtattcttctaccctatgttattctatactattatatagtattccctgctaatcttgttcctgtacctacacctgtttagatatatcctaccaaaaccaggactatcccaatgtcgagtcatcttctcatgttatgtattagacgatgccgttgatatctattcaatgaattctacatcatactattctagtgtattccatgacgtactctgctattctactctattactttccactaccttctcatataccctgctagacgcgactaaat

SEQ ID NO: 13057 - DNA, 62 bp, Diabrotica virgifera
cccacgcgtccgatcattttgaattacgtgttaaggtgttaaaaatgaggttccttattcta

SEQ ID NO: 13058 - DNA, 892 bp, Diabrotica virgifera
  misc_feature (660)..(660): n is a, c, g, or t
  misc_feature (788)..(788): n is a, c, g, or t
  misc_feature (845)..(845): n is a, c, g, or t
agatttagtatctgttgctattgaagtattcatcaagtctgttattgctgaacctatgttgtggagtgcttggtttgagctaggaaagataattcctgataaaaatttcattttttcggtagcattaccagaacattggataaagtccttcttcttagcacacacttttcttgaacaactaaataatgatgaatctcttcagatgtataataccttcttttccttaggttttcaaaataatacttatgtgttatcacaaatagcattaggccatcacaacagaagaaatttaaatgatgctattgaaattttccaaagaatattggaaattgatccatatcgtttggacaacctggatacttattcaaatcttctgtacgtacttgaaatgaaaaaggaactggctgatttagcacacaaagttgttaatatcgataaatatcgtgttgaaacatgctgtgtgataggaaactactacagtttaagatcagatcataccaaagctgttctatattttcgtagagcattaaaactcaatccacagtttctctctgcctggacattaatgggtcatgaatttatggaaatgaaaaatacaaatgctgctatacaaagttatagacatgctattgaaataaattctagagattacagagcttnggtatggattaggtcaaacttacgaaattttaaaaatgcccaactattgtctacattattacaaacgagcacaacagttaaagccaaacgacagtcgaatggttatagcattaggagaagcttatganaaattagataagactgaaaatggcgttgaaatgttattataaggcttgtaattttangtggaatgtcgagggtactgctttactaaaactggcgaaattatatg

SEQ ID NO: 13059 - DNA, 594 bp, Diabrotica virgifera
  misc_feature (249)..(283): n is a, c, g, or t
atgtgttgaagacatcatatgagtgcgctggacgcgccatgctgtcgtgaccgttgggcgctcgcgaggcatacctcgggacccctaggaacgattgatgaaattcggaacccgcacataataacactacccttacgagaatctgctacaataattgggtatccagaacaaccgcagaccttccgaggagcgacagggcgcatccatattcgagattcaactgtattgtatccgtgacaacaaagtgcnnnnnnnnnnnnnnnnnnnnnnnnnnnnnnnnnnngtgcggcatctgtatgaataagcaaatctggccttcgtagtatattgccgagacaatgcaccctgactatggctcgagaatgatgaaatactgaatatacttatatgacaccaaaatacgggagcaatattactgggccatctgctgatgtaacaggaccatgcaatgcctctgatgtcgagtactctacgacatgatccgagtccgtactctcggtgatggtactgctaatgtctgtcccgaagaagcagatgcaagacgaggacgtcttctgacttatcactgtaactacgataaactcactgaagtct

SEQ ID NO: 13060 - DNA, 720 bp, Diabrotica virgifera
  misc_feature (577)..(577): n is a, c, g, or t
  misc_feature (608)..(609): n is a, c, g, or t
  misc_feature (675)..(693): n is a, c, g, or t
  misc_feature (705)..(705): n is a, c, g, or t
taaagtatttagtattagtaagtacttaggcgtacaatttaatatttcttaaattaatttgaatttttggtataagtcgttttacatataaattatcatgtctgaagttgagagtagaaagcttgcagatttacgcgttatagatttaagattggaattagaaagaaggggactggacaaaaatggcgtgaaaaagtagcattggcaaggattgaacgggaagcacattgggagaagcaaaaaaaaatggagtatgacatgacaaatatgtacgaaaaggatatggacagaagagttagtaaaaggtctgcaccttttcgtcgggaagaatttgaaaggagagaccagcatatgatagacatttcaatgagccgcctccacctccaagtctaaaaaccagggaggcagtccacaaagtttcataatcgttcaaagaacctttcccaaaaggggtagaatatctgtgccaagggagattctttacccgaaacgaaggaattatatgggatcctctaaagggaaaacggggggggtcattttatctctgaatggaaattgggggaacaagaaaaaatgnaaatgggagttactctgctgctatacaaagnnatagacatgctattgaaataaatgctataggtgaccgaccttgtgtgggggaggaggccccacttnnnnnnnnnnnnnnnnnnncctatctatggnctacattattacaaa

SEQ ID NO: 13061 - DNA, 300 bp, Diabrotica virgifera
atacaaggtgtgtaggtacctacatcatttttattattttctcggtccatctttttacattgacaatatttaaacgacagagtttgctggggatgagcctctttttactaaggactaaaaatataaagtataaacgtggacataactgcttatgtattaaaatgtagaggatagaataaaagttataaactccacacatggtgatcgggggagttgtcgaggagcccgatcctgccaaggagagtagggccacagccttagattggtctgagtaatatatctgaagatggcgggacaaga

SEQ ID NO: 13062 - DNA, 480 bp, Diabrotica virgifera
  misc_feature (65)..(106): n is a, c, g, or t
  misc_feature (117)..(167): n is a, c, g, or t
  misc_feature (169)..(188): n is a, c, g, or t
  misc_feature (201)..(238): n is a, c, g, or t
  misc_feature (265)..(314): n is a, c, g, or t
  misc_feature (342)..(446): n is a, c, g, or t
  misc_feature (451)..(471): n is a, c, g, or t
ttcttccccgccccccgcgccccgcccgcggggggggtgttttttttctttctctccacaccccnnnnnnnnnnnnnnnnnnnnnnnnnnnnnnnnnnnnnnnnnncggggggaggnnnnnnnnnnnnnnnnnnnnnnnnnnnnnnnnnnnnnnnnnnnnnnnnnnngnnnnnnnnnnnnnnnnnnnnagaggggcgtcgnnnnnnnnnnnnnnnnnnnnnnnnnnnnnnnnnnnnnncccccggcgccggcggggccgcggggnnnnnnnnnnnnnnnnnnnnnnnnnnnnnnnnnnnnnnnnnnnnnnnnnncaccttttttttgtgttttgttgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgannnnnnnnnnnnnnnnnnnnnaacacaccc

SEQ ID NO: 13063 - DNA, 81 bp, Diabrotica virgifera
tcgaattgtatatctagtaggcaatatatacgttcataaaaggaattccgcaacaacttttacccctgcctcttgaaaacc

SEQ ID NO: 13064 - DNA, 925 bp, Diabrotica virgifera
  misc_feature (303)..(320): n is a, c, g, or t
  misc_feature (519)..(542): n is a, c, g, or t
  misc_feature (544)..(557): n is a, c, g, or t
  misc_feature (736)..(753): n is a, c, g, or t
  misc_feature (867)..(885): n is a, c, g, or t
atcagctcttaaaattgttgtaatgatttgaagaaaataccatggcactaaaaatgggactgtaagggaagattaattaaagatattaatgaactgaaagaagaataactccatttatatcgtttgtaacgttgtgattaaataattttgtatctctgtcttttactccaatttcccaattcagcacctttgacgaatctcaaaaggaatagtctagtaaaataaaattccactacatgtaaatcaaaatgtaaattcgtacaggttgaaacaaattttatatcaaagtttaggtgggtacannnnnnnnnnnnnnnnnngtatccaaatcatacagggggatcattgtttaaataattaaaaaggggcaatttttgcaaaaaaaaaatacttttttaactgctgacgtcattcaattactgacgaaggtgtataggactattttctacaaatttgaagggcaaatctttcatataagacttgccgagttagatttgaccccgtggtggtataactccnnnnnnnnnnnnnnnnnnnnnnnngnnnnnnnnnnnnnnttagttagtggaaggttcccaggagggcaattgtcgaggcggcatttcaaaatgcttaatccccgcgatgttgttaaaaggagcaatttataaacaaatttgaataattttcaaatgccattttgggtgggagtttgatttaaatttgaatttgtcaatgcaattgtcgagaacatacnnnnnnnnnnnnnnnnnnagatcttaagcgggtgaatatttctttggcaacaaccgcatttttgcaattgaaaatataataacatttaataaacaagttcaatattttaggaaatgttgaatattttttgannnnnnnnnnnnnnnnnnntactggtaacatggcgcaacttcgtctgtaaaatgggata

SEQ ID NO: 13065 - DNA, 860 bp, Diabrotica virgifera
  misc_feature (781)..(781): n is a, c, g, or t
  misc_feature (842)..(842): n is a, c, g, or t
gtgactagtgaggaactcatttacttatagtacaacgcgacgccgacattaaaagtatcatagtaaagtatggctgaacgtctagatcttctcctatttggagcaacaggggtcacaggtctacatgctattcgataccttcacaaattttcgaaagaaaaaaagttaacctggggtgtttctggacgctcggagacaaaacttaaagcagttttaaagaatgaaggtttacggatgggtgaagatttatccaaaatcccaatcatacttgccgatacaaaagatcaggaatctttaaatgaaatggctaaaaaagcaaaagttttgctgaattgttgtggaccatacagactgttgggctttccggtagtagaagcttgtattaaagctgggactcaccatttagatgtaagtggtgaacccagttatatagattcacttccagaaaagtacgatgctgctgcaaaagaaaaaggaatttatatcgtcagtgcgtgtggtgtcgactgtgttcccacggatttgggttcggcatatctgcagcaaaaatttgatggcgtattgaattcagtggttgcctacgtggaattatggactgaaggtaaaagtagcggatccgttggcggttatgggacttggcaaagccttgtttatgaattccagacaatgggttcattaagtaaactaaaagcaaagctgattccaccttcagactctgcgtttaaaccaacgttgccagttaagatccgtccattctattcggaggtaactaagggggtgngtgatgccatttgcaggacacgatagaaagataatggcagagactcaaaagtatttctatngaaaagaatcgcaaagac

SEQ ID NO: 13066 - DNA, 910 bp, Diabrotica virgifera
  misc_feature (127)..(148): n is a, c, g, or t
  misc_feature (851)..(851): n is a, c, g, or t
cggacgcgtggggtagcacacgattgctgcgttcgtggaatagcgcactttttcgtaattcagcaaaaaatctactgaaaaagcgagtcttccccagttgcagaatcggtgtgttgtgtgtacgaannnnnnnnnnnnnnnnnnnnnngggtgctatacaggataatcatgtctaccgctataatgtcgcagaatgccatgtacgaattcggggagagtctgataaaggtcggacaaagtaaattattcttccggtatcctacgaataacgagcagagcaactatagaaatgaaataaacggtataacacccgactcaactacaacttcacacataccaatcggatcaacacagatgcgtctcacactaaccagaatggcgtcaactcccattggccaggctagctcgaaccaactagcagcactcctggacaatctgacccaacaccggcgattggagcgcactcaatccgcccccgcgccacaagtgtcagcccccgcggcggcggtcacagccaccacagtcaacacgtcccgctacaagacggagttgtgccgcccattcgaggagttcggcgtgtgtaaatatggcgacaagtgccagttcgcgcatggcatgagtgaactccgcagcctcgccaggcatccgaaatataaaaccgagttgtgccgcacctaccacacggtcggcttctgcccgtatggaccccgttgccacttcgttcacaaccaagacgaagtcacaaagcctccaatgttgagcaataggccatcttctgtcacaccaagggcagccagacccgctgctctcagtccatcgttgtccctggatagccccagcccaccatgcangttgagtcaaagtcctacctcttccgatgggatcgttcttcagcagcgaaccagactac

SEQ ID NO: 13067 - DNA, 918 bp, Diabrotica virgifera
  misc_feature (866)..(866): n is a, c, g, or t
  misc_feature (883)..(884): n is a, c, g, or t
gactagttctcaacactaagagacgccgatctccgaattttctcgcctttttgcccctcgaaaatccgaaaaaatggtttatgaaagcgatttttacacgaccaggaggccctatcgtgccactccttccgtttcgtcttacactatttcgggtgtgccttctcgacaagtcagggtattgccgggattagggaaggttcacgtaacgtatacatacgaccgcatcgtaccgtacgtggggcacaagcggcttacggtcgtaacggcccctcccagagtatggggaacgcgaccaagtgttcttcagcgcgaattcgaccgtatcgagaacaaaatccgtccttggaccggttattccgcgactaatcgctacctcaactccaactccgctgtgatattcgatgacgagacgagacttattcgcgctcaaacggcgtctctgttgaaacggattcatgacccggttcctcgtgtccaacgatatagctggcccgcggtcgctgcaaaatacgataatggtcttccggccagactacataacgacaactacatccaccggttgttagtgacctcgccaaactctaaaaccgaatacaccacctattacacggaacccgttaaaaaatatatcggcgacagagtatacagccgcaggccccacatctacctctacgaagatcccttgaagaatgacatccaacttttgagctactacatcaacaagttcaagcaggagaaagctattactgcaagcagtgagcctgctaaagctgcaaaagttgagaaagctcagtctcctgagaaagaacaagagaaagcagaaatcacagaaattaccgaataaccaaacctctccgtctaataanttctactacctacattnnctcttcccctgctatctattttattaactgaatt

SEQ ID NO: 13068 - DNA, 625 bp, Diabrotica virgifera
  misc_feature (2)..(624): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 13069 - DNA, 898 bp, Diabrotica virgifera
  misc_feature (806)..(806): n is a, c, g, or t
  misc_feature (816)..(816): n is a, c, g, or t
caatatgaaagaagtcaatcatatgtgttcgctgaacgcggaagcctatcctgacagtttggcgttagcgacggatacctcagtaaccataggaacaattgatgaaattcagaagttgcacataagaacagtacccttacaagaatctgctagaagaattgcgtatcaagaacaaacgcagaccttcggtgttgtgacagcgcgcatcgatattcaagattcaactggcttgaatccggcacgacaaagtgcgtcgacgatggcccagtcagtcacaatttccagcagtgtgggatctctaggaataagtaaatctggtagcagtagtttattgtcgagtcaggcacccgactatggacaagaagttgaaatacataatttacttataatagaccaaaatacgtttgaaatattacacgcccatcaactgatgcaacaggagtatgcaatgtcgttggtttcgtgtactttaggaaatgatccgagtccgtactttgttgttggtactgctaatgtaaatcccgaagaagcagaaccaaaacaaggccgtcttctcgtttttcactggaacgacaataaactcacgcaagtctcagaaaaagaaataaagggtgcatgctactccttatcagagttcaacgggaaactactagctagcattaacagcaccgttcggcttttcgaatggacagcggagaaagaattaagactggaatgttcacaatttaacaatatcatttcactatttttaaaaacgaaaggggacttcatattgattggagatttgatgagaagcatgacacttnttacatacanaacaatgggaaggtagtttcgaagaaatagcaagagatttacacccccactggatgaccgctgtcgaaatactcgacgatga

SEQ ID NO: 13070 - DNA, 53 bp, Diabrotica virgifera
cttataaatttttgattaaagtatatattcaactgatttacagtggatagtga

SEQ ID NO: 13071 - DNA, 162 bp, Diabrotica virgifera
  misc_feature (11)..(33): n is a, c, g, or t
  misc_feature (112)..(136): n is a, c, g, or t
catttttttcnnnnnnnnnnnnnnnnnnnnnnngtttatcacattattcataacgttttttagtattaactcatttatatcataattcatttatttgcgtgattaacaaatnnnnnnnnnnnnnnnnnnnnnnnnncactcataattttttgatccattttt

SEQ ID NO: 13072 - DNA, 791 bp, Diabrotica virgifera
  misc_feature (16)..(39): n is a, c, g, or t
  misc_feature (88)..(115): n is a, c, g, or t
  misc_feature (145)..(164): n is a, c, g, or t
aatatttgttttgagnnnnnnnnnnnnnnnnnnnnnnnngaaaatacacctcctatatctacgatatatttaaccttattgcgctacnnnnnnnnnnnnnnnnnnnnnnnnnnnntatttcctataccttgagtatcgtgaaccnnnnnnnnnnnnnnnnnnnnttcttgtcttccaattttttaaagctgaaaaatgacatcctatattgtgatagaaatatttgaaataattgtatgtgtaatgaaagatgacatctcgctcttaatattagtctaatttttcaaccattcacctcccttgatctgttagacttagtattatataaccaaatattatcacatcattaatatttgatattgatattaatgacctgattcttgaaaatgactcaaggtatatttttagactaccatctacagtactcttttatctgtcaagctcggagaatgaacctaattctatttccatatattattatcttgatattattgatgagttttttgttaacaactcaatatatataaatagactttaatctacatccctgtatctaggattagctgaatagtgattcagatgaggatatactcagattatcccgacaattcgaacacatcatattctatcagagcattatcaacatcgttcatgcgatatagatactacggatgcgccggcccgctgaataattaacattgcacggtgaattttgaccgagccaacctgaccatatcatatacttattcatcacaagatagctcgcacgggtgaatgaccttacaactgtg

SEQ ID NO: 13073 - DNA, 938 bp, Diabrotica virgifera
  misc_feature (22)..(40): n is a, c, g, or t
  misc_feature (92)..(109): n is a, c, g, or t
  misc_feature (790)..(790): n is a, c, g, or t
  misc_feature (854)..(854): n is a, c, g, or t
  misc_feature (913)..(913): n is a, c, g, or t
caaacttgaaacgtcaacatcnnnnnnnnnnnnnnnnnnnttagtcatcccactttgaatcatctgtcggcaaaattcggtgaattttaacnnnnnnnnnnnnnnnnnngatcggtatcgttccagaagtttggaattgtgctttttgctactttttgtataatagtctagtttatatttctaaagatgagtgtactaggttttagtgacattgttaacggaccgttagctcaatatctgcaactttccgcccaaattggcggagatgtggcagagcattcgaatttggttaaaaatgcatttaacgcccaatacaaattcatagaattggccagtcaatcttccaaacccgcacccaacgatttaaacaactttttggttccaacaagcgatagtattcgacaaatccaagagtttagggaaaaacatcgcacttcccaatattttaaccacttatcagccatcagtgagagtattcctgcattaggatgggtcacagtaagtcctacacctggcccctttgtcaaggaaatgaatgatgctggacagttctacaccaacagagtactaaaagactggaaagaaaaggataagaagcattttgactggaccaaatcttgggtgcagaccctatctgaccttcaagcttttgtgaaacaatatcatactactgggttggtatggtcaggcaaaggagctccacgaagcctgggggggttccccccaccacctccgccaggatgtcctccacccccacccgtcctcgacttggccagtatgggaggagcgngagatgccagtcaagatcgttcggcgctctttgcggaaataaacaaaggacaagatattacaangagtttgaaaaaagtcacttccgatatgcagactcataaaaatcaactttgaggcaggncctgcaccttcaaaccgacactcac

SEQ ID NO: 13074 - DNA, 958 bp, Diabrotica virgifera
  misc_feature (675)..(798): n is a, c, g, or t
gtctgcaacatgtgtgttaatatcgttctatatgtaaacaaaagtatcaaatacgaattgctaattccttatgtgttcattttaacataatgttactttgaaagacttataaaatggttgtgatctttcgtttgaaaagatattttttcattaggtttatatttttgttatctttgtctttatttttagtgatatttatttaccatatatttgagatctttgataaagtttattcttcaagtacaaaaaactgccaatataatgaaaatatagatgtagtttacacctgggtaaacggatctgatccagaattcttaagaaatttgaatggatacttaaaagatcacagaaatattacttgcgatgcttctaagcaacgatttgatgataaatatgaactaaaattctctctcagatctttagagaagtatgcgccatggataaaccatgtatatatagtgactaatggtcaaattccatattggttaaatttggattatgaaaaagttaccattgttacacatgaagatatatttaaagatgtatcaaacttgccaacattttctagtccagccattgagtgcaaccttcacagaatacctgggctttcaaaaaagttcatatactttaatgatgatatatttcttggttcaccattgtacttagatgattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatgggatggaagtgattgtgatgattttgagaacagagaaagctcctgtttgacctcacaacagaagccctagaagataacatgaagaaaacgaaacagaaatatcgctcttcaagagacattgaaaaagtccaaaccacttttatcgatcatttctt

SEQ ID NO: 13075 - DNA, 873 bp, Diabrotica virgifera
  misc_feature (836)..(836): n is a, c, g, or t
aagcgagtgtggacaaatactgcggaagaaaataaggatttgttaaaagaacaacaagaattaaggactaagtatgataaggtgttaaagaaaagtaacgatctaatagcgaagagtaatgacttgaagcaaagcatccacaaattccattcggcaatactcagcgcatgccctacaaagaatctacccagcatcgatgatttgggtaagcccgtttcaaacaggacaccacaacctatgatggtaccgacggcagctgccttgaagatgggcgtaggatttccattgcagaatataccatctgggcgtactgatcgagtattgagtagtcatgctaacaaagatccgctgcaactgaacgaatgtggaacgtgtcgacaacgtcgagaccaacatcttctagcaaaatgcgacacctgccatctctattatcatttggactgtctcaatccacctttaagccgtttaccgaaaaaatctaagctctatggttggcagtgttcagaatgcgacaaaacatcggactctgaggtagaagaattaaaaactcccagaagaagtaggagtatctacagcaatagggaaagtaagtcagaccaagacatctccacgccaaaactaaagatcaaatcggtcgattcctcggcggatagcgctgaaaaagaaaaatctaaatctcgcgactcatctccctccaagaaaaaaacttatgagaatatattcaccgaattagcccaaatgaacggtgtccaggttatcgtggacaacggatacgagggatacgagggaagtcacaaatccgcaaagatacgccgaagagaaaagcacagaagtanaagttcagggtctccggatgctagcagggagcataag

SEQ ID NO: 13076 - DNA, 875 bp, Diabrotica virgifera
gaaaatacctgaccagtatggtccagtgcctatcccgcaagtttttcctgatccaagacaaattgaaaaggtcataactgttctttcgcaagcccagaatcccctgataattgtaggaaaaggtgcagcttattcaagagccgaaaaagaagtcagagacttgatagaatttgctaatttaccatttttagctacaccaatgggaaaaggagtcgtacctgacacttctacaaagtttgttggatcggcaagatcgaccgctttacaacaagctgacgttattctacttctgggagcacgacttaactggattttgcattttggcagacctccaagattttctccaaatgttaaagtaattcaaatcgatattactgccgaagaattgcacaatagtgtaaaatctgaagtagcgatacaaagtgacataaaaagtgcattagaactaataaatgcaggtttaaaaaaacgaaatttcaaatataatgacaacagcgaatggtggagtttattaagaaaaaaatgccgggataatcagaggactgtaaaggctatgtgtgccgatatatcagtaccattaaactactatgctgtttttcaaaacctatttgatcatttacctgaagattgtataattgtaagtgaaggtgctaatacaatggatataggaagaacattattgcttaataatcaacccaggcatagattagatgctggtacttttggaactatgggtgttggtccaggatttgccattgctgctgcattttattgtagacataatcaaccaaataagagagttatttgtgtagaaggagactcggcttttgggttttctggtatggaaatcgaaactatggttagatataaacttc

SEQ ID NO: 13077 - DNA, 181 bp, Diabrotica virgifera
  misc_feature (6)..(6): n is a, c, g, or t
  misc_feature (18)..(37): n is a, c, g, or t
  misc_feature (62)..(86): n is a, c, g, or t
  misc_feature (108)..(161): n is a, c, g, or t
gcttanatttttttcacnnnnnnnnnnnnnnnnnnnncgtttatacaattattaataacgtnnnnnnnnnnnnnnnnnnnnnnnnnctaaatttatctacttgccgtnnnnnnnnnnnnnnnnnnnnnnnnnnnnnnnnnnnnnnnnnnnnnnnnnnnnnncgatcccattttttttgatt

SEQ ID NO: 13078 - DNA, 216 bp, Diabrotica virgifera
  misc_feature (15)..(16): n is a, c, g, or t
  misc_feature (95)..(95): n is a, c, g, or t
  misc_feature (127)..(147): n is a, c, g, or t
  misc_feature (180)..(207): n is a, c, g, or t
gataaattaccttanngataacagcgtaattttatcgcagaagtcaaatcgataataaagattgcgaccctcgatgttgatcaagttataattgntgtagcagctatatcattaaagtctgtcgacnnnnnnnnnnnnnnnnnnnnnagttaaaaccgtgtgaagccaggttgggttccnnnnnnnnnnnnnnnnnnnnnnnnnnnnccaaaaggc

SEQ ID NO: 13079 - DNA, 52 bp, Diabrotica virgifera
  misc_feature (2)..(43): n is a, c, g, or t
cnnnnnnnnnnnnnnnnnnnnnnnnnnnnnnnnnnnnnnnnnncattattaa

SEQ ID NO: 13080 - DNA, 793 bp, Diabrotica virgifera
  misc_feature (9)..(26): n is a, c, g, or t
  misc_feature (28)..(73): n is a, c, g, or t
  misc_feature (77)..(251): n is a, c, g, or t
  misc_feature (305)..(305): n is a, c, g, or t
  misc_feature (319)..(362): n is a, c, g, or t
  misc_feature (380)..(457): n is a, c, g, or t
  misc_feature (464)..(525): n is a, c, g, or t
  misc_feature (530)..(673): n is a, c, g, or t
  misc_feature (709)..(723): n is a, c, g, or t
  misc_feature (726)..(786): n is a, c, g, or t
gcccccccnnnnnnnnnnnnnnnnnncnnnnnnnnnnnnnnnnnnnnnnnnnnnnnnnnnnnnnnnnnnnnnnaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacccccctcctcccctctcccaaacaaaagaaaagagggggggaagggggggngggttgttcttttnnnnnnnnnnnnnnnnnnnnnnnnnnnnnnnnnnnnnnnnnnnnagaaaaaacagatttcgnnnnnnnnnnnnnnnnnnnnnnnnnnnnnnnnnnnnnnnnnnnnnnnnnnnnnnnnnnnnnnnnnnnnnnnnnnnnnnaggtggnnnnnnnnnnnnnnnnnnnnnnnnnnnnnnnnnnnnnnnnnnnnnnnnnnnnnnnnnnnnnngggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattataaataatggagggggggggttttgtttttcnnnnnnnnnnnnnnngcnnnnnnnnnnnnnnnnnnnnnnnnnnnnnnnnnnnnnnnnnnnnnnnnnnnnnnnnnnnnngggggga

SEQ ID NO: 13081 - DNA, 864 bp, Diabrotica virgifera
  misc_feature (663)..(691): n is a, c, g, or t
  misc_feature (840)..(849): n is a, c, g, or t
  misc_feature (851)..(851): n is a, c, g, or t
agaaaaaccagctgagcaagctccaaaactggtcgccactgaaataaaagaagacaaaatcttactcagtgaacaaaaagtagaagctagtcctgtagccgaagaaaaactgcccgaattgaagaaagccgaagaacctgctccacaacttgaaggtaaatcagtgctcgaactacctgaagaaaaaccacaacctgcacagcctgaaggtaaattggaaccagtacaacctgtccttgcggcagttccagctgtagaattagaagtaaagccagaagaaaaaccagaaggtgaaaagaaagccaaatcagaagagcccaaacccgaagagcagaaggtacaaaaagttgaagaagccaaaccaagcgaaggaaaatctttagagcaacaaccagctgaaattaaacctgtcgaattagtaccagtagcagaagaaaaaccaattgaaggacccaaactaccagaaggtaaattagagaagcttccactgccagaaaaacctctggaagagcccaagccaaccgacgcagcgaaaatcgaagaacccaaatccgcagaagagaaactacccgaacctcgaatagtagattttatttatgtgtgctcaaaaataaaaaaatcgtgttttgttatagaaacagtgttgtttttattttatagtannnnnnnnnnnnnnnnnnnnnnnnnnnnncgatcagaattcattatttctttttgatttatgttaacgacaagccaggaattcattcgaccttgtgaatctaaccatagtttctcttctaatcgatttagtttaaggttatgtattaaaagcttttaataaacttttatacatccccnnnnnnnnnnanaaaacaaaaaccc

SEQ ID NO: 13082 - DNA, 110 bp, Diabrotica virgifera
  misc_feature (4)..(101): n is a, c, g, or t
gggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttataaat

SEQ ID NO: 13083 - DNA, 354 bp, Diabrotica virgifera
  misc_feature (16)..(60): n is a, c, g, or t
  misc_feature (70)..(154): n is a, c, g, or t
  misc_feature (156)..(234): n is a, c, g, or t
  misc_feature (238)..(272): n is a, c, g, or t
  misc_feature (313)..(353): n is a, c, g, or t
tctttttgtgtggggnnnnnnnnnnnnnnnnnnnnnnnnnnnnnnnnnnnnnnnnnnnnntttttctctnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnggcnnnnnnnnnnnnnnnnnnnnnnnnnnnnnnnnnnntccccctccctccccgggggggggggaaggacccccccccnnnnnnnnnnnnnnnnnnnnnnnnnnnnnnnnnnnnnnnnng

SEQ ID NO: 13084 - DNA, 919 bp, Diabrotica virgifera
  misc_feature (193)..(210): n is a, c, g, or t
  misc_feature (627)..(651): n is a, c, g, or t
  misc_feature (840)..(840): n is a, c, g, or t
ggttaataatatggattgtcgcttggaaatataattgtaataaagtgctaaataaagattgtctcaataattctacagtaataacttagtaattaataatattcattagtcatttataataatatgtagtaatatttagtaatttataattagtaggtagtagtaatagtcgtaagtagtaattaatttagtnnnnnnnnnnnnnnnnnnggtgcatctacagagacaggtttatcttcacatattaaaagagcaagaattggaggagaacattttaaaaatgatgctctcagatgaaggtaaaccaaaaaaagagtaaaactgatgaaatgtatgtgaatagggttgaagaaggataccaaaccaatttaataagtaaatatatggttgataatgagaccaagtttcatagtttctttcgcgtgacgaagaaccagctccatttcttgttatgtgctattaaggaagacataacgaaatctcctacaagaatggtaaagagaatgataacactatatataacaccagaagaaaaacttggtgtcacattaaggttagtacaaaatgtttatttcctgtgcaattatgaaaacaacagaattgcttatttatatctggaaattacgnnnnnnnnnnnnnnnnnnnnnnnnngctttttaacctcgaacctcgttatcataatttgataaacaataaacaacaaacttttaaattctatgtcaaattttttgttgttttatgaaatggacgcatgcagtcactgcaaagcactgctatcattaccagtcgatgcagcaggcgcatgcgattcctcgcgtcggacgcacaagacagaccggncgtataaagtttacatttgaggagtgcacagaacatcgcttgcgactgctgcttgcgtcaaacgcatgcgacaatcgca

SEQ ID NO: 13085 - DNA, 870 bp, Diabrotica virgifera
  misc_feature (450)..(478): n is a, c, g, or t
  misc_feature (767)..(767): n is a, c, g, or t
  misc_feature (803)..(803): n is a, c, g, or t
  misc_feature (840)..(840): n is a, c, g, or t
gtaccacaataatgaattaattggaacgtacacaaaagtttaggggggttttacgtgagaaaaacctccaaaaaaatttttatgtggtgcactaatttcactttaatttttttacgatgttgctgccataagaatgccacatgtcaattttcaatgaaaaatctctaagagatttcgatatatgaaaaaaaatcgattttcatttcgtaatttcaaagggctgtaacttttttgtgtacacttttgtactaagagtcatcaccaatatttaaaagatcagcatattatggtaaggcagatggtacaccctttaagaattgtaaggagatattagaatctggtaggtactaccttaaaatgaacattcctaaatataattcagttcttaaacgtaacaatattgagattaaatatgataaacctaaactaaatataatctagaactttcannnnnnnnnnnnnnnnnnnnnnnnnnnnnctagaccggccctggcaaggtaaagtcaagctgtactgatattgtactcttagtttttactaaaaataagtggtattattaaatagattttttaaaattaaagtgtttatctactagatacctactactatgtaagtcatctatacgtaattactattttattattgtgaaaagaaaacgtcaaataataaatatacaccaccgtaaaatcattttgtgaggttagctagcatgcggttggtttgtcacttaccagagtcggactgaagctttcgccaccgcagcttanaatgacttcacactatgtaaacacaccttccgatcncaccactccagtaaatcaaagttcgaatatcacaatncagtatgcatcagccgcttcgcattctttt

SEQ ID NO: 13086 - DNA, 636 bp, Diabrotica virgifera
  misc_feature (545)..(545): n is a, c, g, or t
  misc_feature (599)..(599): n is a, c, g, or t
ccacatcttagagaaagggaggaaaaaggtagaagcccttgtaaaagtcgagacggaaatactgccagatctggattacaaaaatttcagcagtcttttggagtactttcggtagctctggcttctagggctcttagtttgttatccgaattgtttgacgatttatatttagaagtgtgtggtggagcagggagcatagtccaggttgaacctgctcccttagcaataatgggccagttcacagcattgcagagaatttctaggatattgaatgcggctcccttaaatcaccttttgttttatctagcaatagtcagttatagaaaagcatgtacacttaaaagattacatccgccagagggcgacacctttagccaatcagattcaacgacatattatgaagatatgatcatgtgctccgacgatagttcaacggatgaagacgatgatagtgagcccatcttaggacaatggtttgaagaaacccttgcgcccccagaaacaaccgagtccaaatcaccaacttctgaaaatggagaaactanaactgtccaaaacgaacgatctcgatcgatggtcccggaaaagggagagctcancgattatcgctctttcactagtgtttttgagttctta

SEQ ID NO: 13087 - DNA, 180 bp, Diabrotica virgifera
  misc_feature (7)..(38): n is a, c, g, or t
  misc_feature (54)..(54): n is a, c, g, or t
  misc_feature (94)..(94): n is a, c, g, or t
  misc_feature (114)..(154): n is a, c, g, or t
gcttacnnnnnnnnnnnnnnnnnnnnnnnnnnnnnnnngtttatcacattattnataaagttttttagtatcacattattttatatcataattnatctactcgcggtgattacnnnnnnnnnnnnnnnnnnnnnnnnnnnnnnnnnnnnnnnnncttttttgatcccaatttttttgatt

SEQ ID NO: 13088 - DNA, 699 bp, Diabrotica virgifera
  misc_feature (9)..(31): n is a, c, g, or t
  misc_feature (62)..(106): n is a, c, g, or t
  misc_feature (129)..(169): n is a, c, g, or t
  misc_feature (176)..(260): n is a, c, g, or t
  misc_feature (274)..(405): n is a, c, g, or t
  misc_feature (476)..(517): n is a, c, g, or t
  misc_feature (562)..(602): n is a, c, g, or t
  misc_feature (605)..(620): n is a, c, g, or t
  misc_feature (636)..(660): n is a, c, g, or t
gggggggtnnnnnnnnnnnnnnnnnnnnnnnggggggggcggggggtgggtgtttttcctannnnnnnnnnnnnnnnnnnnnnnnnnnnnnnnnnnnnnnnnnnnnggtggggcggcaccaccaccaannnnnnnnnnnnnnnnnnnnnnnnnnnnnnnnnnnnnnnnncacacannnnnnnnnnnnnnnnnnnnnnnnnnnnnnnnnnnnnnnnnnnnnnnnnnnnnnnnnnnnnnnnnnnnnnnnnnnnnnnnnnnnngcccaaaaaaacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcccgcccgggcccccctctaattcatttagaagagaaaggaggaggggggggggagccgcccccttnnnnnnnnnnnnnnnnnnnnnnnnnnnnnnnnnnnnnnnnnntctcaccccccaccccccaacccatcgtgttggttggtggtggtnnnnnnnnnnnnnnnnnnnnnnnnnnnnnnnnnnnnnnnnncgnnnnnnnnnnnnnnnnacccaccccccaccannnnnnnnnnnnnnnnnnnnnnnnntcccgctcgcccgcggcggggcagggggggggggagaag

SEQ ID NO: 13089 - DNA, 491 bp, Diabrotica virgifera
  misc_feature (93)..(105): n is a, c, g, or t
  misc_feature (107)..(124): n is a, c, g, or t
  misc_feature (197)..(216): n is a, c, g, or t
  misc_feature (438)..(452): n is a, c, g, or t
tccgcctcctaatatctgtcttgagcatacaacattcctgtagaagcagtaaacacaaatcggcatataacgtcaatccgatgaaacattggnnnnnnnnnnnnncnnnnnnnnnnnnnnnnnntaagtataggagccagtgcagataccatgattatcaattagtaattatatatatactatattctcttattagnnnnnnnnnnnnnnnnnnnngggtgtactgaaacagaaatatcttcaagaattactagtgcaatgatcggctgtgcgattttaaatatagcgctctcatttgacagatagccgtaaagttatttattcacaatagtgtatatcattagaggtgaaggatcatatcgatccatatttacaattctagcgatgggatatcatgagagcgaactttcatactaactttcgccgtgtccaaaaaannnnnnnnnnnnnnnatatgtcctattagtaaaatcctaacatcatctaactgc

SEQ ID NO: 13090 - DNA, 131 bp, Diabrotica virgifera
  misc_feature (115)..(115): n is a, c, g, or t
taacagcgtaattttattggagagctcacatcgataatacagattgcgacctcgatcgtggattacagttataattggtgtagcagctatatcattacgtctgctcgacttttancatttacatgatctga

SEQ ID NO: 13091 - DNA, 118 bp, Diabrotica virgifera
  misc_feature (2)..(86): n is a, c, g, or t
  misc_feature (93)..(111): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnactcgcnnnnnnnnnnnnnnnnnnnctaactc

SEQ ID NO: 13092 - DNA, 275 bp, Diabrotica virgifera
  misc_feature (11)..(66): n is a, c, g, or t
  misc_feature (74)..(112): n is a, c, g, or t
  misc_feature (114)..(147): n is a, c, g, or t
  misc_feature (151)..(169): n is a, c, g, or t
  misc_feature (193)..(265): n is a, c, g, or t
aaaaactcccnnnnnnnnnnnnnnnnnnnnnnnnnnnnnnnnnnnnnnnnnnnnnnnnnnnnnnnngcggcaannnnnnnnnnnnnnnnnnnnnnnnnnnnnnnnnnnnnnnannnnnnnnnnnnnnnnnnnnnnnnnnnnnnnnnngggnnnnnnnnnnnnnnnnnnncggttctcctttcctccccccccnnnnnnnnnnnnnnnnnnnnnnnnnnnnnnnnnnnnnnnnnnnnnnnnnnnnnnnnnnnnnnnnnnnnnnnnnaattataaaa

SEQ ID NO: 13093 - DNA, 864 bp, Diabrotica virgifera
  misc_feature (161)..(208): n is a, c, g, or t
  misc_feature (215)..(233): n is a, c, g, or t
gaaagtcaaactaaaagtcaagtgtttttatttcaaccctgaaatctttaaaaactaatttaatatcctcaatattcctcaataataacaataagaacagttttaaaaatggacttactaggatcaataatgaattcaatggataaaccaccaagtttaannnnnnnnnnnnnnnnnnnnnnnnnnnnnnnnnnnnnnnnnnnnnnnngacgccnnnnnnnnnnnnnnnnnnngctaaaacggtttaaagatcgagtggaagcaaaacttttatcacattttaaggatacatccaaccttactttaaaatttgaacccatggaccaaatatgtagaagcatagttcatgaattagctgaggcatgtggtctgctgtcttttgcctttggaattgatggtgttgataggtatataagagtatacaagaaagaatatcctccctgtgaagatgaattagctgcaaggagaagaggtgaaccttggaatgaagaagttaaaagaagactaattgaaaaacgacgactagataatttagatgaccaagaacaagaatgctcttccaaaaaatctaaaaagttcataccaaactcaaattataaagataagtatgtacaccttattggtgaggatgcagctttaaaggctgctatgaagacgcaaactaataaatcctatggatatgtacctagtgaaaataaaaaggacgttagatcaattgagcaaacgatggctgacataatggctaaaaagaaacaaaaactccataccgatccaagtgaaagttcctctagtgcgctttcagagacttgaaccctcgcataattcgaatgtaatttaatgttaattatcttatttgtaaattaa

SEQ ID NO: 13094 - DNA, 215 bp, Diabrotica virgifera
  misc_feature (19)..(20): n is a, c, g, or t
  misc_feature (63)..(63): n is a, c, g, or t
  misc_feature (79)..(79): n is a, c, g, or t
  misc_feature (102)..(103): n is a, c, g, or t
  misc_feature (176)..(203): n is a, c, g, or t
taacagcgtaattttattnnggagagtcaaatcgataataaagattgcgacctcgatgttggnattaagtttataattnggtgtagcactatattaattaanngtctgtcgacttttaaaattttacatggatctgagtttaacccgttggggagccccgggttgggttctattcnnnnnnnnnnnnnnnnnnnnnnnnnnnncccacaggaacc

SEQ ID NO: 13095 - DNA, 645 bp, Diabrotica virgifera
cgactcgatgcatgtcctgaggaggagctgtcgcaaagaatggcacaacgaaggttattgcatcctgctaccatctatttgctgcaaagaccgaccacgcacatgcaacatacagagataccatcaaggataaactgatacatatgtcttgatttgggaacatgccccttccaggtcattagaagaagactgtgtcgaggctaaaaacattgggaaaagacgtcgcaaggatgcgagatccttggaacccccatctgaaaatgcctctattcgacccctactacctacacgggaagctacatagatctggactcctgggagaagacgcaactcagatcgaggtccaacgaactgaacgacatgcaccatgtatactgggatgttctctgttaccgatccggtgctgacactgaacctaccactcaaatataaatacgccgcttgaaggtatactggagttcttgtcccactgcaatcggacgatacaaaaacggaactaggccatgctgaatcctgcccatccatcttaaatatcttcaacaatgatgcactctgatgtgacaaagtcgcttgacaccacacccccactgacttatgagctaacaccgctgaacatcttaacaccgtcgcctggagaaaccctga

SEQ ID NO: 13096 - DNA, 934 bp, Diabrotica virgifera
  misc_feature (6)..(32): n is a, c, g, or t
  misc_feature (829)..(829): n is a, c, g, or t
gaaagnnnnnnnnnnnnnnnnnnnnnnnnnnngaaattctgaaaatctataaagcagtaaaatggaatttacagcagataatttagaaaaagcggttactttattttatcggactgaagctcatcaacaagcagaagcacatcagtggttaacagaagctcaaaattctccccttgcatggagttttgtttgggaacttcttaatcctcaaagaagttctgaagttcaattttttgctgctaccacacttcacacaaaacttatgaagcattggaatgaaattcctgaagatcattatgaattgttgaagaaaagaattttagattccataattagttatgccagtggcccaaaaattattttaaatcgtctttgtattacgctatctgcttatataattcatactgtaccaaaccactggccaaaagtatttgaagagctagtatcaagttttcaaccacaatatctaccaaatgttgaaccagagagagtaatttggatattattagaaattctaactgtgatacctgaagagtttcaaagaactacattggctttgaaccaaaggaatagagtcaggcaggttcttcaggatgtttcaaaggatatattaacagtcgtggaaatgtgtttgatgcccatacctgctgcaggatttaacatgggtaacttaacaacttacctaaatgcatcaagatgcgcatctgcatggatacaattggggggtctaaatatggatgaatgtaattcagtgaataacctcctcattgatcttacatgttatgtttattggaataagtctgatccagaaggattatctggcgatganatgggatttgatggaaataacagtagaagctcttacagcaatttttcagcatcctaacaccccacagtataaaaatcatgtatttaaatatgctgctcaaatact

SEQ ID NO: 13097 - DNA, 673 bp, Diabrotica virgifera
  misc_feature (3)..(43): n is a, c, g, or t
  misc_feature (54)..(73): n is a, c, g, or t
  misc_feature (77)..(111): n is a, c, g, or t
  misc_feature (121)..(176): n is a, c, g, or t
  misc_feature (186)..(243): n is a, c, g, or t
  misc_feature (250)..(345): n is a, c, g, or t
  misc_feature (349)..(371): n is a, c, g, or t
  misc_feature (375)..(455): n is a, c, g, or t
  misc_feature (460)..(493): n is a, c, g, or t
  misc_feature (498)..(551): n is a, c, g, or t
  misc_feature (573)..(621): n is a, c, g, or t
  misc_feature (626)..(670): n is a, c, g, or t
gcnnnnnnnnnnnnnnnnnnnnnnnnnnnnnnnnnnnnnnnnngtgggtgggcnnnnnnnnnnnnnnnnnnnnttgnnnnnnnnnnnnnnnnnnnnnnnnnnnnnnnnnnnggaggggagnnnnnnnnnnnnnnnnnnnnnnnnnnnnnnnnnnnnnnnnnnnnnnnnnnnnnnnntttttgtggnnnnnnnnnnnnnnnnnnnnnnnnnnnnnnnnnnnnnnnnnnnnnnnnnnnnnnnnnnacacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagnnnnnnnnnnnnnnnnnnnnnnngttnnnnnnnnnnnnnnnnnnnnnnnnnnnnnnnnnnnnnnnnnnnnnnnnnnnnnnnnnnnnnnnnnnnnnnnnnnnnnnnnnaccgnnnnnnnnnnnnnnnnnnnnnnnnnnnnnnnnnnccacnnnnnnnnnnnnnnnnnnnnnnnnnnnnnnnnnnnnnnnnnnnnnnnnnnnnnngcacgggacctgcggcctcacnnnnnnnnnnnnnnnnnnnnnnnnnnnnnnnnnnnnnnnnnnnnnnnnncaacnnnnnnnnnnnnnnnnnnnnnnnnnnnnnnnnnnnnnnnnnnnnnaag

SEQ ID NO: 13098 - DNA, 434 bp, Diabrotica virgifera
  misc_feature (2)..(65): n is a, c, g, or t
  misc_feature (73)..(86): n is a, c, g, or t
  misc_feature (88)..(123): n is a, c, g, or t
  misc_feature (131)..(182): n is a, c, g, or t
  misc_feature (188)..(206): n is a, c, g, or t
  misc_feature (214)..(294): n is a, c, g, or t
  misc_feature (312)..(335): n is a, c, g, or t
  misc_feature (337)..(418): n is a, c, g, or t
  misc_feature (420)..(433): n is a, c, g, or t
cnnnnnnnnnnnnnnnnnnnnnnnnnnnnnnnnnnnnnnnnnnnnnnnnnnnnnnnnnnnnnnnngcccccgnnnnnnnnnnnnnngnnnnnnnnnnnnnnnnnnnnnnnnnnnnnnnnnnnngggtggtnnnnnnnnnnnnnnnnnnnnnnnnnnnnnnnnnnnnnnnnnnnnnnnnnnnnagggannnnnnnnnnnnnnnnnnncgtctccnnnnnnnnnnnnnnnnnnnnnnnnnnnnnnnnnnnnnnnnnnnnnnnnnnnnnnnnnnnnnnnnnnnnnnnnnnnnnnnnnccccaaccacacaaaacnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnc

SEQ ID NO: 13099 - DNA, 786 bp, Diabrotica virgifera
  misc_feature (5)..(27): n is a, c, g, or t
  misc_feature (48)..(71): n is a, c, g, or t
  misc_feature (518)..(541): n is a, c, g, or t
  misc_feature (763)..(778): n is a, c, g, or t
attgnnnnnnnnnnnnnnnnnnnnnnntctagtaaaagtacagaaacnnnnnnnnnnnnnnnnnnnnnnnntcattgtgagagagtattttattgttataaaagaagcatttattttccgccccttgtgtatcacggattattaattcataatcatgtctttattattttctgatttgctatagctaaagaattagaacttttattgcaaaatacatcttccatagaatctttttgcaatgctctgctattcgttgttacatatatctaatttttgcccaaatacattccagttgtttattatcgatatatttattattacatctccttatattattaatattacctattcttagggctgagcttcatcatgaacttttattccaatttactcctctcatctccaaattaagattacaaattttcctcattctagaatatgtgattatttatcttactatatatcatcatttttatttcttataaatcttctcttagaatatctatttatattatttnnnnnnnnnnnnnnnnnnnnnnnnactcctatgacattgcatatgtagtagaaatatataggactaatgaaggaattcgccatcattcttctcacctgtttattacaaaacatgtctatttgtattaaatatgaagtctcgactgcccactgattagttggaacgctcgcgtttatcccaccgtgctacggtagcatcgtcatcatttctctcattggaagctgcatcgcatggctggatgaaaannnnnnnnnnnnnnnntgatccat

SEQ ID NO: 13100 - DNA, 556 bp, Diabrotica virgifera
  misc_feature (389)..(413): n is a, c, g, or t
cggacgcgagggtcaaccagggaaaaccctcccactaccagcagacagtactgcttctcaataataagaaactaatatacgatagatagtattatattcttctctatacacagaaatatatcgtgcataccttctccacaaagaacaactaactactagatacttatttaatacttataacaataaaagataatatcactataattaatgtatagaaccatattaacatcatctttctgattggtaacgataatattatcgagattacaacctaactaattttacataaagtcaataaaattaaattaaacacaccatacccccacatctctaatattataaaattaataacaataatgtatatacctaaaaatatcaacacattatcnnnnnnnnnnnnnnnnnnnnnnnnnataacaaataagcaacggctaattactacatataacactacagcttatcagacatcccaatttgtatactggaattgattgactacatcatataatattagactccctaccaatactaatgcagctattatgaacataagaaa

SEQ ID NO: 13101 - DNA, 242 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (204)..(204): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttacaccggtgtgagccaggttggttnnnnnnnnnnnnnnnnnnnnnnnnnnnnnnnngacaggaccanatatataacataatttttatatttagcataatattacc

SEQ ID NO: 13102 - DNA, 867 bp, Diabrotica virgifera
  misc_feature (14)..(32): n is a, c, g, or t
  misc_feature (165)..(183): n is a, c, g, or t
  misc_feature (797)..(821): n is a, c, g, or t
  misc_feature (838)..(838): n is a, c, g, or t
cttctaaaattggnnnnnnnnnnnnnnnnnnngaaatttctagaatttattattttatacagaaaatatttatggcagctgaaaatgttggtgtatcagatattaaaaagatatctgatgaagatagacaatttaaagttaaagctgcaatcttcctctctggannnnnnnnnnnnnnnnnnntcataggatttggagcaacattagcatctgcaaaaaggcaagacccaaaacattttggaattggaatgacaccaacaagagaattgtccgagacaggggcgtctttagcattacgagctctaggatggggaactttatacgcatttgcaggatgtggagtgctgttttatggtatttggaaactgtcaggagctaagaatttacaagaattcagatataaaatgggttctgctcttcctgtgatacctaggaataatccacctcaaggaaggactgaatttagtggattgaatgatctcttagactacttgcaacatcaaaaaggtgtaaacgacaaataaattattagagattatgaaattttagttgtttgttcagttttatgaataataactatgagatatttatacataatatatgtgtaagttggaaccatgtggaaaacttttttcttagtaattttatgaaagaagttattctttatatacaaaatacaaaagccttataatactgttaaactttgatatctgatggttgcatcttaggttttggaccatgcagagttttttttatgcattttaatgtatattataaagaacgactttttttcgtannnnnnnnnnnnnnnnnnnnnnnnngggaaaaccccattaancagtaaaattaacaaaacataatgatagt

SEQ ID NO: 13103 - DNA, 770 bp, Diabrotica virgifera
  misc_feature (3)..(16): n is a, c, g, or t
  misc_feature (21)..(568): n is a, c, g, or t
  misc_feature (575)..(612): n is a, c, g, or t
  misc_feature (634)..(634): n is a, c, g, or t
  misc_feature (648)..(670): n is a, c, g, or t
  misc_feature (678)..(700): n is a, c, g, or t
  misc_feature (703)..(703): n is a, c, g, or t
  misc_feature (730)..(761): n is a, c, g, or t
acnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattanagtttataattggnnnnnnnnnnnnnnnnnnnnnnntgttcgannnnnnnnnnnnnnnnnnnnnnnagnttaaaccggtgtgagccaggttggttnnnnnnnnnnnnnnnnnnnnnnnnnnnnnnnngaaagggac

SEQ ID NO: 13104 - DNA, 453 bp, Diabrotica virgifera
  misc_feature (6)..(50): n is a, c, g, or t
  misc_feature (52)..(68): n is a, c, g, or t
  misc_feature (73)..(254): n is a, c, g, or t
  misc_feature (261)..(298): n is a, c, g, or t
  misc_feature (318)..(331): n is a, c, g, or t
  misc_feature (334)..(356): n is a, c, g, or t
  misc_feature (364)..(386): n is a, c, g, or t
  misc_feature (416)..(447): n is a, c, g, or t
aattcnnnnnnnnnnnnnnnnnnnnnnnnnnnnnnnnnnnnnnnnnnnnncnnnnnnnnnnnnnnnnngacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 13105 - DNA, 468 bp, Diabrotica virgifera
  misc_feature (56)..(75): n is a, c, g, or t
  misc_feature (140)..(188): n is a, c, g, or t
  misc_feature (328)..(348): n is a, c, g, or t
cggacgcgtgggctcaattgatattgtacttcatgatacctattatgttgttgcgnnnnnnnnnnnnnnnnnnnntataggagctgtatttgctattatagcgggatttatccaatgatttcctttatttacaggtatannnnnnnnnnnnnnnnnnnnnnnnnnnnnnnnnnnnnnnnnnnnnnnnngtgtaaatttaaccttcttccctcaacattttttaggattaataggaatacctcgacgatattcagattatcctgatgtatttatattatgaaatattgtatcttctattggatcactaatttctttaattggggtattnnnnnnnnnnnnnnnnnnnnnagaagctttttcttttcaacgaaaaagattaagacctttaagaataacttcttcaattgaatgactacaatttaaccctccagctgaacacagatattctgaattgccaatattatcatc

SEQ ID NO: 13106 - DNA, 530 bp, Diabrotica virgifera
  misc_feature (2)..(483): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtaaaagcttaatttttttacagacgagagaccctatagagtttat

SEQ ID NO: 13107 - DNA, 305 bp, Diabrotica virgifera
atgactttcattcataacatgttttctcacaaacaatattaagtatttttgctacgttctttagttactaacttaaaaaattacttggtttaaacacaagaattctcgtctatatagtgagtacctactacacttgattgccgagaccgatagacatataatctagatatataactatatatatcatagagatatatatatctagatatatatcacagatatataatctaaataatgttcattagcttatactaaatggacgattcaagaaaataacgttccactatatttgatagacactccag

SEQ ID NO: 13108 - DNA, 52 bp, Diabrotica virgifera
  misc_feature (37)..(38): n is a, c, g, or t
gttaaaaagattacatttttttacaagacgagagacnnctatagagttttat

SEQ ID NO: 13109 - DNA, 124 bp, Diabrotica virgifera
  misc_feature (9)..(42): n is a, c, g, or t
ccaagcttnnnnnnnnnnnnnnnnnnnnnnnnnnnnnnnnnngtttatacattattaataagcttttttagtatcaatttcacttatatcataattatttaattgcgtgatcaaaaataacttc

SEQ ID NO: 13110 - DNA, 894 bp, Diabrotica virgifera
gtgttaaatagcgaatgaattttattttccgcattaaatcttctggttaaattgcttattatatgacaatattaaatatttctcagcgaaatattgcgtcgggctcaaaattatcagtcacatcactactaggcccaggcaactcatcaaaaaatctcccaagctttttgcgtcgtttttctttatttgatgtagaataaaaatatgctttattgtcactgaaaattatacaattttatggacaaaacttaacatagagtcagagtaatttaaactcttaatttattccataattgctgctaactaatttagattcttcaacatagattcttctgattttttgtaaatcttctagaagccctgatatatttttaatctccatatccataccatagttttatctgactgcactgtagtatttgactcctgtgatttattgcttttaaaattttaaacaaaatcgaataaaggtcataatattaaatatagccgagtattaattaaacgcattatgggcataaagtgaagagcaaaaaaacgggaaaaattacgtctttggtctggtcgacgccgggctccttacatcaccgggccccggtaaaatgtaccggctgtaccgccctctcggcggccctgaatatatggatcgataacagtcggccacgaagatattgattacttgttagttgtaatttaacaatatacttaactatgataggtacacaagttagtctattatttatacagatgctgttttagtctcaaaaaataccgtccattagccattaccactaacgtagttagtgctttaggagtagtaaaaaatttaatatatcataaattaaatataatacgaactccgtgtggatcggatgtcgataacgaccagtgaaa

SEQ ID NO: 13111 - DNA, 150 bp, Diabrotica virgifera
  misc_feature (12)..(99): n is a, c, g, or t
  misc_feature (101)..(124): n is a, c, g, or t
  misc_feature (126)..(142): n is a, c, g, or t
catttttttacnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnncnnnnnnnnnnnnnnnnncaattaat

SEQ ID NO: 13112 - DNA, 121 bp, Diabrotica virgifera
  misc_feature (25)..(54): n is a, c, g, or t
  misc_feature (56)..(80): n is a, c, g, or t
gttacaaagcttacatttttttacnnnnnnnnnnnnnnnnnnnnnnnnnnnnnncnnnnnnnnnnnnnnnnnnnnnnnnncaattattcactatataacttatttaattgccgtgattacc

SEQ ID NO: 13113 - DNA, 93 bp, Diabrotica virgifera
  misc_feature (6)..(25): n is a, c, g, or t
  misc_feature (54)..(76): n is a, c, g, or t
ggatcnnnnnnnnnnnnnnnnnnnntttataatgttattgttacagctcatgcnnnnnnnnnnnnnnnnnnnnnnnttatacctatttataat

SEQ ID NO: 13114 - DNA, 493 bp, Diabrotica virgifera
  misc_feature (9)..(36): n is a, c, g, or t
  misc_feature (50)..(211): n is a, c, g, or t
  misc_feature (222)..(277): n is a, c, g, or t
  misc_feature (283)..(308): n is a, c, g, or t
  misc_feature (326)..(364): n is a, c, g, or t
  misc_feature (433)..(485): n is a, c, g, or t
ggggggtgnnnnnnnnnnnnnnnnnnnnnnnnnnnnttttgtttggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttggtgnnnnnnnnnnnnnnnnnnnnnnnnnnnnnnnnnnnnnnnnnnnnnnnnnnnnnnnnggcccnnnnnnnnnnnnnnnnnnnnnnnnnngggttgggtggtgggaannnnnnnnnnnnnnnnnnnnnnnnnnnnnnnnnnnnnnnccccccgcgcgcccccccccccgcccgcgcgcggcggggggggggagtatttaatatatatatttgttnnnnnnnnnnnnnnnnnnnnnnnnnnnnnnnnnnnnnnnnnnnnnnnnnnnnntggggggc

SEQ ID NO: 13115 - DNA, 895 bp, Diabrotica virgifera
  misc_feature (239)..(254): n is a, c, g, or t
gtactttttgagaacttacgcgatgtataagcactcgctccgttgtcgctcgtactctaaaaatcgcgtgctttcgcaaaaagcatactttacgaactgtttcataaataacgattgtttaacaaaatttgaaaaagatttttcaaattttgatactatcttttattactggtcttctcatcctgcgtctacgtcgaagtataaacaatacacttgtcgctaatattattttactgagnnnnnnnnnnnnnnnntcggtgtcagtgtcacccaccggtgtttcgtttgcgcagctgaagaaccaccagtggcggacaccaatgtcgggacaccagccggttaatctgaaagggtactaatgcttcagtatttattttaattttgatctgtataccacatactttatttatatgtatacctcgtattgatattattttatgaaatagaaacttaatattaaaaatagtgatacatctaattacaattgaatactttattattacatatttagataatgtattattttttaaacgtaatatttaagaaattgatttagccttgggatataatgataaagtatgagagctaaagtataatacttattaacttcttttttattgcatgcctgaaaagaagaagaatgaataaaaaaagtgatataacgatggcttagtgtgagaacctcgtatctcattttttttttcgaaaatgacatttttggtggttttagcttgaaaaccttgtatctcacgatttacaactgttagaaaaaatccaaatacaccagactattttctacagccgaaaaaagaaaccacgtatatcaattgctctccttcatttagtgtgaataccacgtatatttataacaaagaaattggtactttaatttgaa

SEQ ID NO: 13116 - DNA, 892 bp, Diabrotica virgifera
gtcgaggaatacactctttttccaaaaagagaaatcattacgaagctgattttataaataaagtaacttacttattaggacttcacaatgcagtattcccaataatagaaaaaactctccagcacgacaatttccagaatttgatcaagtcaggtactgaacagtttgatgtagtagtggtcgaacaatttcacagtgatgcttttaaagccttggcttggtattataacgcccatctggtagttttatctcccggagcttcctcttgtggaactaattctctagtaggtagcccgaccgaacttgcttacaatcccatgccctatactaattttccaacagacatgaacttttttcaaagagtacataacaccataatatacagttttgaatacttagctaaccagttatactttttacctcaacataaccaactgattcaacagcattttcctggatgtcccgatatttttgaactactgaccaacgtttcattggtgcttactaattcccatgaaagcttcaccccgtcaaaacctctggtgcccaatttgatcaacgtaggaggattacatattcaaccagcagggatcttaccagagaaccttcaacgatatctggacgagtctacagacggtgttatatatttcagtatgggttctcatctaaagagcagtgggatgagttttgataagatgcaatactttatacaagcttttaagagactaaaacagaatgtgctatggaaatgggaggcagaagtcttaccaggaaagccagcaaatgttaggatagagaaatgggtaccgcaaatgggagtgttagctcatcccaatgtaaaagttttcattactcatggaggacttttaagcttttacgaatcgattttatt

SEQ ID NO: 13117 - DNA, 387 bp, Diabrotica virgifera
  misc_feature (277)..(297): n is a, c, g, or t
gattcatatgacctctgctatctaaggatagctgaagaagatttggatagccagcagaatctttccttatgaaaagtacatccctcgtaccatgccgccaaatgccttctactcatgggctatatgcttgccaccttcaatgagtgaagtgataggttttcgacactattaatgaaaagtattgatcttcattgcctggcccgtgagcggctagatattcgccgattaaaactatcctcctcaacacttcattacattttcctgggtatgtcctcgnnnnnnnnnnnnnnnnnnnnntagaggagtaactccagagcctaatatggtagtcctcaagactccactgtatttagtgtttgtccttaaatgcgccacgaagatgatggc

SEQ ID NO: 13118 - DNA, 940 bp, Diabrotica virgifera
ctgacagtttctacagtatagttacagtgttcagtggaaaatattcaattaagagtatacaccttccaacagtactactagtactagttgccgccttacacaacggccattcagccaccctcacagacgtccttctctcggacgaatcaaacaaaccccaagaaatctcttccgatgaattcatcccccctcttcgactatccagagacgtcaagtacccaaggtacgcagccgacaatactgataaagacctgaaaccagaagactcaccagatcgggaccgggatagcggcagcgctcctcctggaaaacgatgcatcagttgtttcgccagctacccccagtactccaataatccttcctacgataggaacaggtactactacgacgacaggagtcgagatagggattatgatcggtacgatgatcgggatcgggatcggtacaacgagagagataggtactactatagagacccttattatgacagatacgacagatacaatgacagagatcggtactacagcagaggtcgcgaccggtacggtgaccgagatcggtactacgatccctacgactacgacagatacgacccttacgagaggtacgaccgatatggcgatcggcagtacgataggtacgaccgagatcggtacgacactaggtactccgaccgggggatagggtacgataacaaaggctacgattacaggataaacgatccgtacaacaagggcaatgacgattataatagaggatattccgggcgacctgactatggtactagtgggtacgctagtaaatggaattatggaagtagcggaggtgggaggggatgattattactccagagatagatatcccagttatagacccgtaagcaagacacctacaacagagacccctataatgacacctacagaccgaccagttacctcta

SEQ ID NO: 13119 - DNA, 62 bp, Diabrotica virgifera
gttatatttacttactataactattttgtaactgggcaggtaaataaatcctatctagtact

SEQ ID NO: 13120 - DNA, 111 bp, Diabrotica virgifera
  misc_feature (7)..(107): n is a, c, g, or t
aaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggt

SEQ ID NO: 13121 - DNA, 492 bp, Diabrotica virgifera
atccgatcaaacttggacccctttaataaatttaacgatgaagagctttggagcgccatcgataaagcaaatttgaaaagttttattctagatttagactctaagattatagcttcatcttctagtttaagtttgggtcagaaacagatgttctgcgtagcaagagcaattataagtaatgccaaaattattgtccttgatgaagcaacggcaaatatggataatgaaactcaaactttggtgaataaaagtataagggataacttttctggctgtactgtgctgacgattgctcataggttggaaaatatcatagagtctgacaaaatacttgtgatggacagaggtgaggtcagagagtatgctaatcctgaacagcttctcaaaaacaaggaaagttatttctcgaaaatggttcaaaaaacgttaaattattaattcttaatattgtattatatataatattattatgtagattattagcatgttttg

SEQ ID NO: 13122 - DNA, 822 bp, Diabrotica virgifera
ggaagttaccggttagactttaaagtattccaactctcctttgtactttttcgggtttattctgttagcattcaattctatggattttgttcctttccatcagaatgataggtagcagtgttttgtgtagataacaagctgcgaggttacaagagaaaaaaaaacagtaagattttaaatattgcaaacatctattagtgttttgtagaatttgctttgaaatattacatggattacccaaataggcgaattatactaatctaaataggcgcaactatccagcaatcttgcgaaaagtaccaggggcagttacaagctacaggtcaggattttgaattattccaaaatagcaattgtatttttcagttctaattctgttgtatatcgattttatgggattttaccctttcacaataactatagcagtcctttttcttaacaaaccgctgattattggaggaatggtgtaaagccaagaaggataaaaaacagtaagagtttaaacattgcaaacatatgctaatattttttagaaagcattatttgaaaatgttatatgggctacctaagtgaacgaataatcaagagagagggaaacgaagtatgaatcaatcttctaaaagtacaaagaagagttagcagctacaggttagacttttgaagtattgcataacgtaggatctatttttcaggtttgctcagctgtcaattgtatgggatattattcctctttatctgaatgaaagctctatttggctagctcattagtggatagagaagagattcagaaacggcaagattttgaatctttgcagacatcta

SEQ ID NO: 13123 - DNA, 117 bp, Diabrotica virgifera
agaagatcaagactgttgagaaagtaacaaacatttttatatttataagaacgtgattccaaataaattgttaagacttttgtcgccttgtatattttattaaagattaatattacc

SEQ ID NO: 13124 - DNA, 103 bp, Diabrotica virgifera
  misc_feature (6)..(84): n is a, c, g, or t
  misc_feature (93)..(93): n is a, c, g, or t
  misc_feature (96)..(96): n is a, c, g, or t
tttttnnnnnnnnnnnnnnnnnnnnnnnnnnnnnnnnnnnnnnnnnnnnnnnnnnnnnnnnnnnnnnnnnnnnnnnnnnnnnnntattttaanttnggggtga

SEQ ID NO: 13125 - DNA, 840 bp, Diabrotica virgifera
  misc_feature (87)..(114): n is a, c, g, or t
  misc_feature (580)..(603): n is a, c, g, or t
  misc_feature (608)..(625): n is a, c, g, or t
  misc_feature (797)..(797): n is a, c, g, or t
cattaatattgtcattaatgtcactgaatgtttatttttgcgtagcaacgaaggacatctgtcgcgctactcgacgacaggaagttnnnnnnnnnnnnnnnnnnnnnnnnnnnncacaagatagcgagaataaattgaaaatattgcgacaatttttcgaaaacttgctgcctggttcttcggactctcgtgtctattgccgaatggcaaaaggtttgagaaacaaagtggattattattttcttatttattcgtactatcgtgtgatattcgaaagattattttttaacactcacatgcaaaattcatgtctttgtaaataaacattcagtgacattatcacaatttttgcagcttgtcaaagttaacaccatgagcgggtttagcaaatattcagatgaagatattaataacatattagaaaaaattatttgaaaatacagttttgtttgtgaaatgatcttgccgaattacactcgagctcttaaaattatcgatttgtatcgccctcgtgacaatttgacattagatacagaactaaaaacacatgataaaaaatcttactaggtacacgattggnnnnnnnnnnnnnnnnnnnnnnnncgctnnnnnnnnnnnnnnnnnnggtttctattggtcaaaatctctatgaatgaaagaatcaattaaagccttaatttaataagtggtatctatatcaagccaagaagtgtacaattttgatagcattacatattgagttaattttataatttataagtcaccaatgataatactgattccggcaaagctgatanaacacttttgtcagactgaatcaaatttcagactgaatcaaat

SEQ ID NO: 13126 - DNA, 1119 bp, Diabrotica virgifera
  misc_feature (438)..(456): n is a, c, g, or t
  misc_feature (664)..(682): n is a, c, g, or t
  misc_feature (771)..(806): n is a, c, g, or t
  misc_feature (909)..(978): n is a, c, g, or t
  misc_feature (991)..(1004): n is a, c, g, or t
  misc_feature (1007)..(1020): n is a, c, g, or t
  misc_feature (1069)..(1108): n is a, c, g, or t
gagatctttggagacggtcaatacacgacatcacgtcgaccactagactccctctgggggggggggggtcaagattgaagatcatatataatatacgagtatattcgttttacgcaaataaatggttataggaagagctaagtatgaattagtgataatattatattgcttgcttattttcacaattaacaaagagcaactgaacaagttcagtgttactccaacgttaagggttaaaatacattcacttaaaaatatactttaaatataataaacacaaaaaattacttatatatgtatattttatgctttcatcaattgtgattaaacagcacttgaataaagttacctaagtctaccaaatcaaagatataaatttaattattgtgcatttcaccagtgtatagatcgtaaaattaattttatgttgtgttaccnnnnnnnnnnnnnnnnnnnacgtataaataattagaaaaacaacaaaaaacactgaatattgaagtatattgtaaaaggaaaatttattattttaacatattcatcgtttcggtaactattatttcaatttgtataacaaggaatgagaaaatgcttttttgttaaattcacattgcatattttattaaaatggcctcatttctcagaaaataaagcttcaatgtgnnnnnnnnnnnnnnnnnnngataattactaaaacaatggatggtttaaaagctcctactaatatactccaatatatcagtagtattacaaagttggaactttttggcnnnnnnnnnnnnnnnnnnnnnnnnnnnnnnnnnnnnttcttcataaaaagttcatcatggcatcaaaccaaaatgaaattatcgaacttgtgtgtcaaaaatattaagtttgataagaataaagtacccttacttttgnnnnnnnnnnnnnnnnnnnnnnnnnnnnnnnnnnnnnnnnnnnnnnnnnnnnnnnnnnnnnnnnnnnnnntccttctatttcnnnnnnnnnnnnnnccnnnnnnnnnnnnnnttacggtccaaaaaaatggaatttattttccttttccaaaacttacaannnnnnnnnnnnnnnnnnnnnnnnnnnnnnnnnnnnnnnncgttttccaaa

SEQ ID NO: 13127 - DNA, 947 bp, Diabrotica virgifera
  misc_feature (103)..(117): n is a, c, g, or t
  misc_feature (607)..(629): n is a, c, g, or t
  misc_feature (815)..(842): n is a, c, g, or t
  misc_feature (844)..(924): n is a, c, g, or t
agtggacccatagacataatatatgttacgggcaataacgtaaatccggccaataactacgttaataaccggccaatatcgacaatggcctgttgaattagtnnnnnnnnnnnnnnnccggatattaacgttattgtccatagaaactggacattgatgacaattttaatttcttgataacatttccatcattttccggtcaatgtcaacaatgcccgttgcgttgttaatcggtcaatgttgaaatttagactaaaagataggttatatgtttattatttgcttcatttctgtgctcgtgctgaaattactcgttgtcgagttgcagggttatcatgtcgagttctcgtgttggatcctcaatggtacggaaggggagccaactatcggaacttaggaaaacactgactctaacttataaccgttgactgataaatatactggaagatacgaaactaaatgagcgtttatgtacgacaccagtggttttagaaataggtggcgttagcagctttctaggtgcgagattgaatttacctgagacaacgatgagacgtattcaggtagctttggttatcggaatttggggtcggtcgggtcgatcggnnnnnnnnnnnnnnnnnnnnnnncttttgatgcatttaaatttgagttctcattcaacgataacaatgcggcaatctttaaaataattattggagtgtacctatgtataactttctaaactcgtttttaaattagcaagaataattttgtaggttgtaatttgtcttctaatttgaattcttgaaacaaatcattaaatattctaaagnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnntgcctcataatctccgataaaaa

SEQ ID NO: 13128 - DNA, 234 bp, Diabrotica virgifera
  misc_feature (195)..(223): n is a, c, g, or t
tttactttagggataacagcgtaatttttattggaaagttcaaatccgaaaataaagattggcgacccccgatgttggaataaagtttataatttgccggaacaagtaatttaattaaggcctgtcccaccttttaaaaattttccatgatcttgagtttaaaccggggggggagaccaggttgggtttctaatnnnnnnnnnnnnnnnnnnnnnnnnnnnnncaaaaggagcc

SEQ ID NO: 13129 - DNA, 586 bp, Diabrotica virgifera
aaaactcccacagtggggacttcatcttcctttattgctaggcagaggtaagtaagctaaatgggattcccttattatcagggagcaaagagggatgaatcgatcacctaaatcccgtgtcgtatatctgtcaccgggaattgtcggtgtatcggagggtacatgtatccggatatcgtgcggggagtccatggcagacgtgacgtgagtcgcagctggtagagggtgccaggaccgcagtgatcggcaccgattgcggtaggatctctcttcattaggcggtttgcttgagagtgcagccctatgagggaggtaaactccatctatggccaaatatcaccatgagaccgatatccaacaagtaccgtgagggaaacttgacacgagctttgagagagagagttcactatgtacgtgaatccgtccaggggtaaacctgaaagatccgaaaggtcgaaagaggaaattcattcacgattctactgtctaagttggatagctgtatgacggataatgtatcggagacatctacttctaatattcttggagtatatgtcgatcgtgtgcactttacatctagtaggac

SEQ ID NO: 13130 - DNA, 934 bp, Diabrotica virgifera
  misc_feature (475)..(497): n is a, c, g, or t
  misc_feature (639)..(662): n is a, c, g, or t
  misc_feature (748)..(765): n is a, c, g, or t
  misc_feature (840)..(860): n is a, c, g, or t
  misc_feature (863)..(883): n is a, c, g, or t
  misc_feature (892)..(915): n is a, c, g, or t
gagacttattaaattaagtttgacccttggtttatttaaataattgtaaatcaaaattacaaagcagatttccaaaagggtattatttgcaatataagtaagcactatgaaatattttgttttgcacagaaagttgcgctaagatatcactataaattgtcagaggaaatggttgataaatattgagtggtttatgagatgtttaatttgtttgtgaaaaattgccattttttcaattgcaggagcgcggttgttgccgatagagtatacaagcttttaaggtttcatttttttgcttttatgtatattttcgatagatgtattgacaaattaaaattttaattggacaccccttcaaaatggcgtttgagaattggtgtggtttgtttggaacttgtttttttaataacatcgccgggattgaaaattttgaaattatttttcgatattcgtgtttctggtggtttttgacacnnnnnnnnnnnnnnnnnnnnnnntagatccattttttgccaagcttttctagatagcttttccaagtttaaaaattcataaattgtttatttatcaatattaacacacagtgcgtgagtaaatctatcaaccctactacttgacaatgtcatttatacatagagnnnnnnnnnnnnnnnnnnnnnnnngtggcaaccttaactgaaaactttttacatgaagagtggtgcagtaatactttgcaataccttcgttaataatggaccaatttcannnnnnnnnnnnnnnnnnatggtagattataaaaatagtaattgacacagaaaatgacacttttaacaataaaaatattcgtcaatttgttannnnnnnnnnnnnnnnnnnnnagnnnnnnnnnnnnnnnnnnnnngacaaaagnnnnnnnnnnnnnnnnnnnnnnnngaacttaactttaaaaatt

SEQ ID NO: 13131 - DNA, 88 bp, Diabrotica virgifera
  misc_feature (2)..(15): n is a, c, g, or t
  misc_feature (21)..(21): n is a, c, g, or t
  misc_feature (25)..(50): n is a, c, g, or t
  misc_feature (52)..(53): n is a, c, g, or t
  misc_feature (65)..(65): n is a, c, g, or t
  misc_feature (68)..(86): n is a, c, g, or t
tnnnnnnnnnnnnnntataanattnnnnnnnnnnnnnnnnnnnnnnnnnnannattatttatatnaannnnnnnnnnnnnnnnnnngg

SEQ ID NO: 13132 - DNA, 256 bp, Diabrotica virgifera
gttagaatgtatccattaaaaatacagttatcgtaacaaaatatttgattcgactttaaagaagtattaagattaaatgtaggcatatttgcaacttttcctttagtcacgtgtaaaatataaaaatgattcagtttagaaatgtcagcgcctatttctatgcaaatattagtaaagcgaatgtaagtagttattggtcgtatcttctcagtctacgtcattttacctgatcaggttaataaagttcagattcttc

SEQ ID NO: 13133 - DNA, 674 bp, Diabrotica virgifera
  misc_feature (38)..(55): n is a, c, g, or t
ctgttttgatgaagtgaattagtgaagtaacgttaaannnnnnnnnnnnnnnnnncatttaatagaagtttaggtaatatttagcttagcttaggaagtattaaattcgagattttattacaattagattagttacggcttataggcactaaaagactatttaaaagttaggatcaatttcattcactgtggacactgttttgatgaagtgaattagtgaacgaaaaaaaaaaggacgaaaagacacgacgtgaaagtacgtgaactagtgataggttataaaataccagtttagtatagggaaaatatgaacttttgtgtagaataggatttttttaactatataagtaatataaggtctatctcctaaaaggcgatgatggacaatcaatctcattttaaaaatatgtaattttaacaaaacggggaggtgtggtattataatatcaccctgtacaaaagatgtttgattgaaagtaaagcatattataaattgtccgcccttgaccaaggccgacgtgtaaggttgcaaagttcattctaatatataagtaaacgcccgatgatatcataatcattattattattgttgtagtaggtcgttactgttaaatgtaaacacattgttatggttaggctgatggaggtgattgtaaatataatgtatttgaacc

SEQ ID NO: 13134 - DNA, 348 bp, Diabrotica virgifera
  misc_feature (3)..(82): n is a, c, g, or t
  misc_feature (96)..(217): n is a, c, g, or t
  misc_feature (224)..(272): n is a, c, g, or t
  misc_feature (276)..(347): n is a, c, g, or t
tgnnnnnnnnnnnnnnnnnnnnnnnnnnnnnnnnnnnnnnnnnnnnnnnnnnnnnnnnnnnnnnnnnnnnnnnnnnnnnnnngagggggagggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccnnnnnnnnnnnnnnnnnnnnnnnnnnnnnnnnnnnnnnnnnnnnnnnnncagnnnnnnnnnnnnnnnnnnnnnnnnnnnnnnnnnnnnnnnnnnnnnnnnnnnnnnnnnnnnnnnnnnnnnnnng

SEQ ID NO: 13135 - DNA, 883 bp, Diabrotica virgifera
tttttgtagtggccctcttgagagtctcgaacggggagatttttgacttcgccgatgaagatcctttaaattctgtgtggccgcagggtgaacgaataaaactgaaaacaacagaatgtcaagttcaaacgcaaaatggtgtcaaatggggtcagtgcgtcccatacgccagttgtcttctctcacaaggaacaccgaacggattttgtggtattctccaaacctgctgtgtttatgaaagtacgtgcggaaaaaccagtaatgccaaagtaagctacttcgagacaacagaacttggcaatggacaaaccaactgtgaatatatagttaacctcaggaacaagaatatttgtcaaataaggttggacttcataaaatttaacttagccccagccactctaaccacaccgcagtatgcatcttataaatcatacagatgtgttgatgacatatttagagtaaccccgaaccacttcaatattccagatctatgtggaaataatgataaacagcatgtttatatccacgtcaaccagaccgacggagtaaccaaaggagtccagttgcagatgactctagcaaacagaaactacaacccgttactcttttctccaacttggagaattaaaattacacaacttgagtgtcctggtcatcgctctggtataaactttggagaaaataaagacataatcgaagattttccactactagctcctttgggtgccatacaatacttttctgaatctactggatatattaagtcatttggtttcgatggttctgtgagtaatccacagagttatacttatgggcaacaatatgctattgctttcaagagggagattggcgtatgtggaataagatttgtacctgactatat

SEQ ID NO: 13136 - DNA, 505 bp, Diabrotica virgifera
  misc_feature (2)..(306): n is a, c, g, or t
  misc_feature (313)..(350): n is a, c, g, or t
  misc_feature (370)..(383): n is a, c, g, or t
  misc_feature (386)..(408): n is a, c, g, or t
  misc_feature (416)..(438): n is a, c, g, or t
  misc_feature (468)..(499): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggagtgagccaggttggttnnnnnnnnnnnnnnnnnnnnnnnnnnnnnnnngaaagg

SEQ ID NO: 13137 - DNA, 553 bp, Diabrotica virgifera
  misc_feature (2)..(475): n is a, c, g, or t
  misc_feature (484)..(484): n is a, c, g, or t
  misc_feature (509)..(536): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagaattnctatttttaacgttaaaacgctttnnnnnnnnnnnnnnnnnnnnnnnnnnnnctcatagagtttttata

SEQ ID NO: 13138 - DNA, 870 bp, Diabrotica virgifera
  misc_feature (11)..(57): n is a, c, g, or t
  misc_feature (789)..(789): n is a, c, g, or t
  misc_feature (830)..(831): n is a, c, g, or t
acaaaacatannnnnnnnnnnnnnnnnnnnnnnnnnnnnnnnnnnnnnnnnnnnnnngtaggacttgccttttagaaaaagcaaatttaaagcctttatttgaagcttgtgttgctaacatgttaatgtcttgttctgctatacaggttatacagggagatggtttacctaatcagatctgtacccaatgtctacaaagtgtaaacagggcctatacatttaaacaactttgtgaaaaatctgacatggcattgagaagttatttaagcattaacttacaaccaattgctttgcctaccgaaaatcttattaatgaagtaaagagtgatttatttagtactagtgaagttctgcaacagagttctttatttcaagatatcttcaatgatgccactacgcattcctttgttgaaacttttacaaatcagaatactagcacagatctggctgaaactatgcaaagtctccaaaccattgctgaacagtgtctaccagaatcatgggaaagtgacggtaatattgttccttgtaattcagatgaagcaacagataattttagtctagatgctttgtacaagtgtcaattttgcgaaaatatatttaaagatgaatggtctttatccgagcacctaaaaattcacactatccaacatagatacttttgtaatatgtgtgacaagatatatgacgattcaaatgaactgaataaacatatcatagaacatacatttattgacaatcaaaagagccaggacatagatcataccagtttctaaagaagtctttaanaattttaagtgccatatatgtgatcgagattttccagattnnctaatttctaaaaggcatttgaaagaaatcactttattg

SEQ ID NO: 13139 - DNA, 280 bp, Diabrotica virgifera
  misc_feature (8)..(71): n is a, c, g, or t
  misc_feature (74)..(110): n is a, c, g, or t
  misc_feature (167)..(187): n is a, c, g, or t
  misc_feature (250)..(269): n is a, c, g, or t
gggggtgnnnnnnnnnnnnnnnnnnnnnnnnnnnnnnnnnnnnnnnnnnnnnnnnnnnnnnnnnnnnnnnnatnnnnnnnnnnnnnnnnnnnnnnnnnnnnnnnnnnnnnccccttagggggaataaccagcggtaaatttttatattgggaaaaggttccaaaacnnnnnnnnnnnnnnnnnnnnncgacacccccccatgggttggagtttaaaaggttttttttaatttggggggggaacccagcgnnnnnnnnnnnnnnnnnnnnccttcggggct

SEQ ID NO: 13140 - DNA, 103 bp, Diabrotica virgifera
  misc_feature (2)..(38): n is a, c, g, or t
  misc_feature (46)..(90): n is a, c, g, or t
  misc_feature (100)..(100): n is a, c, g, or t
cnnnnnnnnnnnnnnnnnnnnnnnnnnnnnnnnnnnnnattattcnnnnnnnnnnnnnnnnnnnnnnnnnnnnnnnnnnnnnnnnnnnnncttatttgcngtg

SEQ ID NO: 13141 - DNA, 209 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (196)..(196): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttacaccggtgtgagccaggttggttnnnnnnnnnnnnnnnnnnnnnnnnnnnnnnnnganaggaccaaatata

SEQ ID NO: 13142 - DNA, 905 bp, Diabrotica virgifera
  misc_feature (536)..(635): n is a, c, g, or t
  misc_feature (849)..(849): n is a, c, g, or t
ccttacgcgtccgccaggaacagggaaggagaagcctcagtcacatttactctgaaaatcaagaaaatcaagaagactcaggaaggcaagtttaagatagtcgccaggaacagggaaggagaagcctcagtaacatttactctgaaagtaattacttcagagaaagaagcacctgaggtcttatcacctctagaatctattaccgtaaggaaaggagaaccagttacactttccactactatatttggaaacccggaacctactatcgaatggttgaaggatggtaaacctttaaccagaccaaaattcaaaaaagacggaaacacatacactttaactattcccaagacatctacagatgacactgctacatatacagttcgagctaccaattctatgggtacaatagaaacaagtgcaaacctaactgttgaagaattcccagaaaaccaggaaccaccattgttcgtcaaacgatttgaagagcaaactgtaccacaaaagtctcctctcaccctcaaagccaaagtggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattaaagaaaccaattctgaacttgactctggagactacaaatgtattgctgtgaatccagcaggcaaagcctcgcatggtgccaaggtatctattgaggtagatactgtcaaatttactaaagaactgaaagaagtttacgaaacaatagaaagaaagaccatcgaattagaatgtgaaacatcccactcagttagaacaaaatggtggtancacacacggaaattagtggtatggaccatcgcgttgtagtacaagatggacgtacc

SEQ ID NO: 13143 - DNA, 742 bp, Diabrotica virgifera
  misc_feature (116)..(135): n is a, c, g, or t
  misc_feature (178)..(364): n is a, c, g, or t
  misc_feature (657)..(695): n is a, c, g, or t
  misc_feature (697)..(726): n is a, c, g, or t
atttttatttattccaagatactaaaatatttcttcactaagagcccagaacaatttccctgaatgatagtcaaccctgtattcgtgacagaatatgttatttttatacaagaagnnnnnnnnnnnnnnnnnnnncgtatcagggatcattcctccacacttatatccctattatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgagcttaaccctagaattttattaaaatttccttgttatgtaagaatcaggattaatcaccttcatatattaaaccaccatattattcttgttcatctatcattatttctatcccccatacattcttgctcaagatataaattctgattattctgatgctgaaatgatgctgatactaatattcaaaaagtgcagctttactatgactatataggcttaataacgcaattcggcaccatttttctcacctgtttattacaaacatgcctttctgtattatatataacgannnnnnnnnnnnnnnnnnnnnnnnnnnnnnnnnnnnnnncnnnnnnnnnnnnnnnnnnnnnnnnnnnnnnctttctattgatagct

SEQ ID NO: 13144 - DNA, 166 bp, Diabrotica virgifera
  misc_feature (8)..(97): n is a, c, g, or t
attttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttggagcaatttttttggattataacaattaattaccttaagggatacaaccgaaattttattgg

SEQ ID NO: 13145 - DNA, 464 bp, Diabrotica virgifera
  misc_feature (3)..(28): n is a, c, g, or t
tgnnnnnnnnnnnnnnnnnnnnnnnnnnctatatattggtaaatatctcgagtcgagtaaaatattacattcacgacagttgcgccccatgatggcatatacagcttatctgactatcagaaaaattaatacttcggaacgtttttgtcatagctactcaccggacagctaacactctcatgcccccgctacacgatagtgctgacgagtcgctcaccaatgttcccactaaatatgctacagcatcaattccgcacgaacggaatgatgatattattacatccagaacatctgaataacctatagaagaccaattctctaatttaatattactctgagcttatactaatcttgtaagcgcattataccctcacgagacgacctttttgatgtaatcctatgaacctgtttcttaacacctaatagacaggatgagaaaattgcatcatttttaataggtgaat

SEQ ID NO: 13146 - DNA, 100 bp, Diabrotica virgifera
gtaggcgtaaggtaacatgtgtttaccttagcacattgatggatctgctacatcaataataaattataacgaattataatactaaaataagcgtgtttta

SEQ ID NO: 13147 - DNA, 901 bp, Diabrotica virgifera
  misc_feature (743)..(743): n is a, c, g, or t
  misc_feature (783)..(783): n is a, c, g, or t
  misc_feature (809)..(809): n is a, c, g, or t
  misc_feature (823)..(824): n is a, c, g, or t
  misc_feature (848)..(848): n is a, c, g, or t
gagaaaggaaagagatgaaagtctcaaatgtgtgcactgaaaagttcgccggcagtgaggatgacaatctactgcacaaaggtttgaaagaaactagtaaaaaggaagaagcaatacaacgcaggaaagaaattttagctcaggtttttgtgacaagtgcagtgatgttgagcgcggcaagctgtgggatgcctgtaggatattctgccgttctgctcccacaacttaaatttatgaacgattcgatgcaaattgacgacgagatgggatcttggatagctagtatccattcagctgcaacccctttaggatccctgctcagcggcatcttaatggaacgatgcggtagaaaattggcactacaaattgcttccatgcctctaatattcggatggtttttaattgccttttctctgaaccactctattctgttgttaggaagattaattgcaggattttcagcgggattaactgcagcagctggacaagtcttgatcggagagatatcagaaccacgtcttcgaggtttattttcaagtgtgcccttagccagctactcatttggaattctgctagtttacgcactgggatcattattaccgtggagatatgttgcagtatctagtactgtcctgcctgtaatcatcactgtatggttttcttctttctaccagagagtccagtatggttaacaagacaagagaaactagaagatgctaagaaagctctagtttggctgaggngaggaaataaaataaaggcaaaacaagaaatgcagcaccntcgttgatcgactagaatcagaaaanaagtcacagacaannagtaatatcacgacgctctctccnacccgaagttctgaaacctctaattatttataatgtattttacatacttcagc

SEQ ID NO: 13148 - DNA, 187 bp, Diabrotica virgifera
  misc_feature (2)..(42): n is a, c, g, or t
  misc_feature (48)..(66): n is a, c, g, or t
  misc_feature (68)..(118): n is a, c, g, or t
  misc_feature (126)..(186): n is a, c, g, or t
cnnnnnnnnnnnnnnnnnnnnnnnnnnnnnnnnnnnnnnnnnctatannnnnnnnnnnnnnnnnnncnnnnnnnnnnnnnnnnnnnnnnnnnnnnnnnnnnnnnnnnnnnnnnnnnnncggggtgnnnnnnnnnnnnnnnnnnnnnnnnnnnnnnnnnnnnnnnnnnnnnnnnnnnnnnnnnnnnnt

SEQ ID NO: 13149 - DNA, 876 bp, Diabrotica virgifera
  misc_feature (791)..(791): n is a, c, g, or t
caactaatacttctacaactaataattgtaatttttggtcaggcattttccaatttcttcaacggactccctaaaagaacatttgaaacacattatgcagtcagtgtcactccaactttattccttactgcggttattcttccaattcctgcaactctagcaagtttaggccaggcattgtaccatttgagtctaagatcaagtttttcacaaataattttacaattattgctttagatatcgctcaattttacctccaacgtcaacaaaatattgcgggagtggtgcttatagtgaaaattacacagattctgcataaatgacacttttaccgccaatgatattaatttttaggccaggctttcaacacatgttttaaagttgagtctctgaacgaatttttccatcaaattctggagtgagtggatatgaaatgaagaattttgctaattttttgtacggaagaagttttattgtgattaatttgctcaatattgtgtttagacatgattttcttgatgataaatcgtgtagattgactgcgccactttcaattgctaatttttcatcttcttgagactatataccatcattaatctgaattagatgtgaaaaattctcttatcaatcgttgtatagttgcttttttataggagagttagactataatcgtgcgggcacatgaaaagtgatactatacagttctttttttttggtaaaatgtcacagacggaatgtggtattacaaatcctgttatctcttcaatatttcaaggcaaaaatactcttanaatattattgttagcatcactgtggttcctttaggggtaataaatcatgtttctcttatttttcgcaattttcaactagttttac

SEQ ID NO: 13150 - DNA, 422 bp, Diabrotica virgifera
  misc_feature (3)..(369): n is a, c, g, or t
  misc_feature (372)..(405): n is a, c, g, or t
  misc_feature (413)..(414): n is a, c, g, or t
cannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttnnnnnnnnnnnnnnnnnnnnnnnnnnnnnnnnnnaccttagnngatacagc

SEQ ID NO: 13151 - DNA, 534 bp, Diabrotica virgifera
  misc_feature (5)..(285): n is a, c, g, or t
  misc_feature (292)..(329): n is a, c, g, or t
  misc_feature (349)..(362): n is a, c, g, or t
  misc_feature (365)..(387): n is a, c, g, or t
  misc_feature (395)..(417): n is a, c, g, or t
  misc_feature (447)..(478): n is a, c, g, or t
  misc_feature (485)..(521): n is a, c, g, or t
ctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaaggnnnnnnnnnnnnnnnnnnnnnnnnnnnnnnnnnnnnnattccgaattacc

SEQ ID NO: 13152 - DNA, 517 bp, Diabrotica virgifera
atccatcgcagaaatcgcatctgtaacaaaacggctggacaggtttggaggacttcattttttcaaccctgtacctatgatgaaacttttggaagtcatcaggatttctgaaaccagtgaccaaacctacaatgccatgatggcttggggcaagtccattggcaaagtctgcatcacctgtaaagatactcccggatttgttgtcaataggttgctggttccttatgttgctgaagcggttcgtatgttggaaagaggcgacgcttctgctcaagacatcgacactgcaatgaaactaggagctggttatccaatgggccctttggaactggccgattatactggtttagacactggtgtgttcgtcctcgaaggttggcacaaaaaattcccggaaaatccgctttttaacccagtagagctccaaaagaaactcgtaaaagagggtaaactaggaagaaagactggacaaggattctataagtacacaaaataagatagcttgttataacctatt

SEQ ID NO: 13153 - DNA, 850 bp, Diabrotica virgifera
  misc_feature (6)..(28): n is a, c, g, or t
  misc_feature (219)..(292): n is a, c, g, or t
  misc_feature (297)..(362): n is a, c, g, or t
  misc_feature (380)..(398): n is a, c, g, or t
  misc_feature (407)..(421): n is a, c, g, or t
  misc_feature (423)..(439): n is a, c, g, or t
  misc_feature (442)..(460): n is a, c, g, or t
  misc_feature (475)..(495): n is a, c, g, or t
  misc_feature (633)..(682): n is a, c, g, or t
  misc_feature (687)..(795): n is a, c, g, or t
  misc_feature (798)..(843): n is a, c, g, or t
tcgtannnnnnnnnnnnnnnnnnnnnnngatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnctcatcc

SEQ ID NO: 13154 - DNA, 168 bp, Diabrotica virgifera
  misc_feature (5)..(81): n is a, c, g, or t
  misc_feature (94)..(153): n is a, c, g, or t
  misc_feature (163)..(163): n is a, c, g, or t
ggggnnnnnnnnnnnnnnnnnnnnnnnnnnnnnnnnnnnnnnnnnnnnnnnnnnnnnnnnnnnnnnnnnnnnnnnnnnnnnaagacgagaagannnnnnnnnnnnnnnnnnnnnnnnnnnnnnnnnnnnnnnnnnnnnnnnnnnnnnnnnnnnaataattatnttatt

SEQ ID NO: 13155 - DNA, 930 bp, Diabrotica virgifera
aggaaagaaagtataatatagctaccaaatattccaatatctgcaacattttcagaatcaaactgtttgactgagctcttatagcatgtagttatcgccaatactaataagtaagctttagctaaggtttacggtagtctaggagatataatatatttgatattgaaaattaatacttagagcagaacataaatgacactctacagacagataatcggcaagaatctagaaccagcaaatgacaaaattgcaaattagtgatcttcgtttatgttatcttttataataaataacgaaagaacgcgagaatataagtaatacatgtcatatgccagttgtcatggcatatcacttgtttcattcgtcgcttatcaggatgtctgtctgttacaagatgagagatgtcgctgcggtagcagtttacaaaaaaaccattttaggtcttctaaatgttacaaataggggggatagaatgaaaattcttttttataacgaataaattgtggttgatacgaatgttcaaatctaatgattgtagaatactgtttaaagcgcaaaaaacgtttaacgagatcttctctagagcctcgtagattagatcggctgaatcttcatcaacatcgttcgtctttgcagcgaaaaatcgcgttactttgtaaaaatttgtaaatatttaggattaagaacaaataagaagtatttaataaagagcgaggctagtgtatgagattctgctgtagattaagttttgcttaataactttttaggttaagtacaaacacttgacaaggtggcaatgcgttcggttcaaaaaatggggaagggtttggtatttatcgttcaatgaaatgcctgaaacgtcaacacaaacaaaaagggcaacagtaatatatacctgtcaatttttctacttaagtttactttttggct

SEQ ID NO: 13156 - DNA, 134 bp, Diabrotica virgifera
  misc_feature (7)..(43): n is a, c, g, or t
  misc_feature (78)..(100): n is a, c, g, or t
  misc_feature (108)..(129): n is a, c, g, or t
taacagnnnnnnnnnnnnnnnnnnnnnnnnnnnnnnnnnnnnntgcgacctcgatgttggattaagtttataattggnnnnnnnnnnnnnnnnnnnnnnntgttcgannnnnnnnnnnnnnnnnnnnnnagttt

SEQ ID NO: 13157 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13158 - DNA, 800 bp, Diabrotica virgifera
  misc_feature (762)..(787): n is a, c, g, or t
aacaaaaataatacaagagtaatattcatattattcagcatcaaataaaaatatgagtttacctactgattttggacctgattcaggcggtagaatgaagggtatttgtatagtgaaacctcttgtgtatggtaatatagcgagatattttggaaaaaaacgggaggaagatggacatactcaccaatggacagtttatgtaaagccttataataatgaagatatgtcgacctacataaaaaaggtccaatttaaattgcatgagagttatgcaaaccaaaacagaatagttgttaaaccaccctacgaattgagtgaaactggttggggggagtttgaaattgttataaagatatatttccatgatccaaatgaaagacctgttacaatgtatcacattctaaaattgtttcattcaggtaatacgcaagacataggtatagaacaaagtaaaggtttggtgtcagaaagctacgatgagattatttttcaagatcctacacaactcatgcaccatttattgacaaatgtaaaacacttacctgtaggtcgatgggaccataataccaactttgaggagaaaaaagaaaaaacgctgaaatcgattttggaagctaaacaaaaaattagaaacgaaattttgaatttgaagaacaaactgaagttggcaaaagaaacaatttcctcttttaaagaggaaatagcgaaatctcaagacaatcagtttgtaatgtagtattagtataaaatttgtatatgtannnnnnnnnnnnnnnnnnnnnnnnnngtatgcctttctt

SEQ ID NO: 13159 - DNA, 132 bp, Diabrotica virgifera
  misc_feature (7)..(39): n is a, c, g, or t
  misc_feature (50)..(112): n is a, c, g, or t
cgtaacnnnnnnnnnnnnnnnnnnnnnnnnnnnnnnnnnctatagagttnnnnnnnnnnnnnnnnnnnnnnnnnnnnnnnnnnnnnnnnnnnnnnnnnnnnnnnnnnnnnnncttggggtgatcacaaataa

SEQ ID NO: 13160 - DNA, 902 bp, Diabrotica virgifera
  misc_feature (99)..(129): n is a, c, g, or t
  misc_feature (881)..(881): n is a, c, g, or t
gaaacgaataaaacttccaaacttttagtaatttattcctgaaattggtgttagtttttatgttcttttacatttgcttgttcaactcaaattagatgnnnnnnnnnnnnnnnnnnnnnnnnnnnnnnngatgagcctcacgatctggatgagggtatatcccatcattggtccaaaagaacaacatgtaggggaacatgtagtgaaagaagtaatggatatctgtaagaaacatattacagatgttctacaaatgtacagaccctacactagagaggcttttatactctggagagacacttgttattgcaaggaaatagttgaggatgatgagatgtgcaattttgttcatactttgagtagaagaatgaatttgtgtgcaaatcagacttgggatacgatttgcaactttctagtatacgaataccatggaaaacgagatgaattgaagaatataattaggtttaattcaaaacttgatatcttaattgagcgcatatgggatttttactcattagagcgactgtttctggtaaaaaccttaagacatatcttagaaaatgctgataataaatttgataggcactataaaaagtttcaagcatttctaagtgctgttgatatgtctaaattgtggaagatgtctgtccaatcatttaaagaactgaccaaagaaatcagtaagcaatcatgtcatttagttacagaagatcttttgaaggaatggattcatagaaataacagggaacaagtagaaatggtgtttatattgatggatatattacctcgttataaattggtgcaaggagatatcgaaaaattcctttctatttgtatcagacatttttttggtagagctcctttgtatccagattcattanaatatctagaaaagatgattt

SEQ ID NO: 13161 - DNA, 237 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t
  misc_feature (200)..(236): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngagaggnnnnnnnnnnnnnnnnnnnnnnnnnnnnnnnnnnnnna

SEQ ID NO: 13162 - DNA, 91 bp, Diabrotica virgifera
  misc_feature (3)..(37): n is a, c, g, or t
  misc_feature (57)..(87): n is a, c, g, or t
ccnnnnnnnnnnnnnnnnnnnnnnnnnnnnnnnnnnncactaagttttttagtatcnnnnnnnnnnnnnnnnnnnnnnnnnnnnnnnccgt

SEQ ID NO: 13163 - DNA, 745 bp, Diabrotica virgifera
  misc_feature (3)..(52): n is a, c, g, or t
  misc_feature (90)..(157): n is a, c, g, or t
  misc_feature (159)..(173): n is a, c, g, or t
  misc_feature (175)..(187): n is a, c, g, or t
  misc_feature (432)..(450): n is a, c, g, or t
  misc_feature (554)..(573): n is a, c, g, or t
aannnnnnnnnnnnnnnnnnnnnnnnnnnnnnnnnnnnnnnnnnnnnnnnnntgaaaatataatattatgaaaataaaattatataattnnnnnnnnnnnnnnnnnnnnnnnnnnnnnnnnnnnnnnnnnnnnnnnnnnnnnnnnnnnnnnnnnnnncnnnnnnnnnnnnnnncnnnnnnnnnnnnngatatagattatttagaattaagaaaataagttgaaattaaatatgaatatttgggaatggaaaaatataatattattgtgttatatagttttaaataaggaattagtgtaattaatttgaatagagatatgtgagattatagatggggaaaaaagataaaagtgtgatagtagttttatatgggttagagaaggctgtgatttgataaatcatttgtgagtgtatattgtagaagattgatttnnnnnnnnnnnnnnnnnnnaagagtttaatgtaggatgtaatttaaaaatgcgtatgagagtactatttggagaaaaaacctgcaagtgtggaatttgttttaaggaggtttttaaggaaggnnnnnnnnnnnnnnnnnnnngagtgtataatgaagaaaaagtggaaaagtggtgaatttggttttaaagaatgtattattgcaggaatttggaaaaaacatatgaaaggtagttattgggaaaaaaactttagaaggtgtggaaatttgtttttaaaatagtttggttaattttcaggttagtttggaaaag

SEQ ID NO: 13164 - DNA, 722 bp, Diabrotica virgifera
  misc_feature (661)..(697): n is a, c, g, or t
attttatttatattctcttctatttccaattcacatgatatcttttaataatctgaaaacaacattgcatatgctgctaagtgattagatttgcgataaaagattttatattttatagaagatgatgtattgtttgtacctcgcgtgtcgacaatgattaatcagctattatatatgctttagtttcggatgtaacagacctaaatgcttaggattctactcctgcacctgctgtctcagataatgtttttgaagaggattgtgattctgctcccgcctcctctaattattttaaaaactaggttaaatatatttattaacctgacatctatcctgaatcatttttatctgatcagaattaaaaatttttacctgctgaacttagatttttatattaattccaatttttattatcagctacgattttctatttcattatttccacagtataatatctgataatacttatttatatatattagtatttttgtctcgtctaaacactttattttcctgtaatttttgatttgtgattgaaagtagtgtagatattattcttattaataaaattggatatttatgcaacatatataggtgtaatataggaactcggcatcatttttttcacctgattattagaaacatgcctttgtgtattacnnnnnnnnnnnnnnnnnnnnnnnnnnnnnnnnnnnnnaccgcgttattctgaccgtgctaac

SEQ ID NO: 13165 - DNA, 982 bp, Diabrotica virgifera
  misc_feature (14)..(483): n is a, c, g, or t
  misc_feature (749)..(768): n is a, c, g, or t
  misc_feature (801)..(825): n is a, c, g, or t
taacgcctggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttatttgttataaatttgatatgaaaaaagaaagttaaaatatgggaaataagtaatgagggtgatattagtattaaaaggttgagtaatgactgagaattgtaaatcatttgagagtgtataatgaagaaaaattcattcaggtgtgaaataagtattaaagaggttaatgtaggaagtaatttaaaaacacgtataacactacacgttggagaaaaaaaacgaaagtgtgaaatatgttttaagaagatttttaaggcaggnnnnnnnnnnnnnnnnnnnngagtgcataatggagaaaaatcgtaaaagtggnnnnnnnnnnnnnnnnnnnnnnnnnactgaaggaaatttgaaaaaaaacatgagagtaaataatgggaaaaaaaacctaaaagggtggaaaattggtttaaaaaagtttgggtctttcaagtagtttgaaaagcaatttaaggagggattattggagaaaaaacataaaaggtggaatgggt

SEQ ID NO: 13166 - DNA, 181 bp, Diabrotica virgifera
  misc_feature (18)..(45): n is a, c, g, or t
  misc_feature (74)..(75): n is a, c, g, or t
  misc_feature (115)..(136): n is a, c, g, or t
taacagcgtaatttttannnnnnnnnnnnnnnnnnnnnnnnnnnntgcggacctcgatgtttggattaaagttnnataattggtgtagcagctatataaattaagtctggtcgannnnnnnnnnnnnnnnnnnnnnagtttaaaccggtggaagcccaggtggtttctatcttaatttatt

SEQ ID NO: 13167 - DNA, 288 bp, Diabrotica virgifera
tgattattaaataacaatgcatatattcttcaactgtaattgatgtatgtataagctcgcagatttttagaatatattgggtggcatttacttattatattattattcacccagctgggtgttcacaaatcactagaaagaattctttcaggaggatgttatataaccataatgcctggtgcagaaatattccattttgcaaggagaaatatactttctcgtaacgagtcaatatacatcagggttgcatggtttgtggccatatgaattctcacttagtgtgtaaag

SEQ ID NO: 13168 - DNA, 936 bp, Diabrotica virgifera
  misc_feature (9)..(932): n is a, c, g, or t
cccgggtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 13169 - DNA, 520 bp, Diabrotica virgifera
agatgtgcgaatggaatggcgtataaacgtttttaaccgcattagtttttgatacaacggatacaactcgtttttattgaatttctgcaagaagtaaaatataattgttaactactatttactataatattattactagcttataaaatatgtcagaggatgaggtggataattttgaaattactgattatgacatataaaatgaatgtacagaagaccaaatatgtaaaaagagtgatgacagccctgcaatgatactgtatatgcagagaaaatagtgatgatgagagtaaataaccaagcacatgaattagatcatattgtaattgttagtatataataagattattagtatttaatttttttaaggaggaactttaagaaagaggtgtatgtatgatttaattattgaagaccaattcggaatagcaaatttgatattataaaatatgatatggatatatttctacatattctctattgctcatcttaaataaatgttgtagaaaaatatagattt

SEQ ID NO: 13170 - DNA, 666 bp, Diabrotica virgifera
  misc_feature (17)..(42): n is a, c, g, or t
  misc_feature (57)..(85): n is a, c, g, or t
  misc_feature (105)..(105): n is a, c, g, or t
  misc_feature (118)..(137): n is a, c, g, or t
  misc_feature (139)..(363): n is a, c, g, or t
  misc_feature (368)..(397): n is a, c, g, or t
  misc_feature (418)..(444): n is a, c, g, or t
cccaaccggggtccgcnnnnnnnnnnnnnnnnnnnnnnnnnnctttattagtattannnnnnnnnnnnnnnnnnnnnnnnnnnnnagtaatattataattattantaaatttaactcnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttnnnnnnnnnnnnnnnnnnnnnnnnnnnnnnattatttttgagataaaaagnnnnnnnnnnnnnnnnnnnnnnnnnnncactagtagagttttataagtgcattaatatgttgttttagaatcaaaattatttagattaaaaagagtagaaataggggagattaaaaaagatgacaaagtgtataatattataagattaaaaaatgcgttagggaccccgttcacttgattataccatgtgataaagtagctgtaatcatgtatgatttatctggtaacttctgaagaataatttctatt

SEQ ID NO: 13171 - DNA, 975 bp, Diabrotica virgifera
  misc_feature (911)..(911): n is a, c, g, or t
ctccatttgtctgaacttcatatgagtggtttcatttttcgataataaataccaaacaagagaaaactatatccatctggagtattgctaagtaaataagtccccatggattccgaagattctcgggaggcttcctctggaagtggaagcgaagatgatcaaggaagaatcagtcgtgctagcaaaaaatctgctggtagagactcctacaaatccagatcttcatcaaggtcatccagtgctggtagcagggctcattctgcttcttcacaaagttctgctgggagtagaagtagaccaccctctccagaagcagataggcttcaatctagatctaataaaagtagatcacctgattctcgttctagtaggagtaggtctccgaatgaggtatcagctgcaccaagaagtcaatctcccaatccaagatcacctaaagtaagatctaaagaaaaacaaggtccaagatcaccaagttcatcttcctcctcttcatctgaggatgaagaaccaaaatctcctgaaccggagagacctgtatcaggagggccaagatcaccaccctcttcccctcccaatgactatcccaaatctccaagtccagctccagatatgttaagccaccctagatcgccatcaccaaatcaagttagatcacctttaccaaaccatcctctttcatctccaccaaatcatcctaaatcacctccaatgaaccatccccaatcaccctcaccaaaccatcctagatctccttcaccaaaccatcatagatctccttcaccaaaccatcccagatccccttcaccaaaccatcccagattcccttcaccaaaccatcccagatccccttcacaaaccatcccagatccccttcaccaaaccatcctagatccccttcacaaaccatnccagatcgccttcacctcagagctcctctcgtagctcgtctccagaatctcatggacacaagtc

SEQ ID NO: 13172 - DNA, 935 bp, Diabrotica virgifera
  misc_feature (66)..(84): n is a, c, g, or t
  misc_feature (401)..(419): n is a, c, g, or t
  misc_feature (447)..(469): n is a, c, g, or t
  misc_feature (528)..(551): n is a, c, g, or t
  misc_feature (614)..(635): n is a, c, g, or t
  misc_feature (678)..(694): n is a, c, g, or t
  misc_feature (697)..(709): n is a, c, g, or t
  misc_feature (765)..(778): n is a, c, g, or t
  misc_feature (780)..(802): n is a, c, g, or t
  misc_feature (817)..(817): n is a, c, g, or t
  misc_feature (873)..(873): n is a, c, g, or t
  misc_feature (886)..(886): n is a, c, g, or t
atttgtttaatttcttgtttactttctcttattttgttttattgtggattgtggtaataataatgnnnnnnnnnnnnnnnnnnngcgaggaaacgtgtaaaatagaaatagagaatagtgagatggatgatgctgttttggatagctttaaatgtgaaattcaggaggaggagtccaaaagagaaataattacccatggcacatacgatcctttagacttgaagaaatgtcccataaaaactgaaatagaacaacatggaaataaacttatcccatttgaagaacaccaaaaaactgaaaaaggttatcttcaagaggaaaacaaaacggaaattatagagaaactcgttgaagatccatcctaccaaggaaatgatatgactcgacacactcaagaaaannnnnnnnnnnnnnnnnnnaacgttgggactggaaaaagacaatatnnnnnnnnnnnnnnnnnnnnnnngtgtattactgcaattaatttgaaaagacatatgagagtacatactggggaaaaaccannnnnnnnnnnnnnnnnnnnnnnncggcttagtcaagcctgtgatttgaaaaatcatttgagagtgcatactggagaaaaaccattnnnnnnnnnnnnnnnnnnnnnncagtttaatgtaggaagtaatttaaaaacacatataacactannnnnnnnnnnnnnnnnccnnnnnnnnnnnnnctgttttaagcagttttctacggcaggtaatttaaaaacacatttgagagtgcatnnnnnnnnnnnnnngnnnnnnnnnnnnnnnnnnnnnnnacaatgtattactgncagtaatttgaaaaaacacatgagagtacatactggaaaaaaaccctacaagtgtngaatttgttttanacagtttggtcatttcagtagtttgaaaagcacttaacgagtgcatact

SEQ ID NO: 13173 - DNA, 553 bp, Diabrotica virgifera
  misc_feature (36)..(36): n is a, c, g, or t
  misc_feature (58)..(58): n is a, c, g, or t
  misc_feature (213)..(246): n is a, c, g, or t
  misc_feature (349)..(369): n is a, c, g, or t
  misc_feature (439)..(457): n is a, c, g, or t
cctaacccgaggtccgatttttaacaacagtacttntctgcaaacccttatgagatgnctcctataagaaaccagtgacaacagccagaaagaagtctggtcccaagtttgaagtaagtgccgaacaaaaaaatgatatcaaagaagcttgtgatcaatttgaaaaagaatataatgaaaaaatagatgtgattgatctattatatagatatnnnnnnnnnnnnnnnnnnnnnnnnnnnnnnnnnnataaaaaaggatgggaggcaaagaaatgaaaatcgacaataaggagaaatagtgtagtgaagaaggaaaaggagtatatgaattagaaacatagttaaggtannnnnnnnnnnnnnnnnnnnnaagaaatattaataaggagaaacgaaaaaaaagtggagtatgaagatttagttggaggagaaaaatgagnnnnnnnnnnnnnnnnnnngtagaatatgatatgagataattttatagattattattgcgattataaagagaggtggtgagaaaatatagatttaaggaaagtagaaagaatgag

SEQ ID NO: 13174 - DNA, 777 bp, Diabrotica virgifera
  misc_feature (19)..(91): n is a, c, g, or t
  misc_feature (97)..(119): n is a, c, g, or t
  misc_feature (310)..(383): n is a, c, g, or t
  misc_feature (388)..(453): n is a, c, g, or t
  misc_feature (471)..(489): n is a, c, g, or t
  misc_feature (498)..(512): n is a, c, g, or t
  misc_feature (514)..(530): n is a, c, g, or t
  misc_feature (533)..(551): n is a, c, g, or t
  misc_feature (566)..(586): n is a, c, g, or t
  misc_feature (724)..(773): n is a, c, g, or t
ctcaccccccggggtccgnnnnnnnnnnnnnnnnnnnnnnnnnnnnnnnnnnnnnnnnnnnnnnnnnnnnnnnnnnnnnnnnnnnnnnnnntcgtannnnnnnnnnnnnnnnnnnnnnncatagaaaccaacctggctcacaccggtttaaactcagatcatgtaaaattttaaaagtcgaacagacttaataatatagctgctacaccaattataaactttaatccaacatcgaggtcgcaatctttattatcgatttgaactctccaataaaattacgctgttatccctaaggtaatttattcttatnnnnnnnnnnnnnnnnnnnnnnnnnnnnnnnnnnnnnnnnnnnnnnnnnnnnnnnnnnnnnnnnnnnnnnnnnnccccnnnnnnnnnnnnnnnnnnnnnnnnnnnnnnnnnnnnnnnnnnnnnnnnnnnnnnnnnnnnnnnnnntctatagggtcttctcgnnnnnnnnnnnnnnnnnnnctttttaannnnnnnnnnnnnnncnnnnnnnnnnnnnnnnngannnnnnnnnnnnnnnnnnncccttcattccagcnnnnnnnnnnnnnnnnnnnnnttatgctaccttagcacggtcaaaataccgcggccattcaaattaatcagtgggcaggcgagactttatatttaatacaaaaagacatgtttttaataaacaggtgaaaaaaatgttgccgaattcctttattaaacnnnnnnnnnnnnnnnnnnnnnnnnnnnnnnnnnnnnnnnnnnnnnnnnnnttac

SEQ ID NO: 13175 - DNA, 987 bp, Diabrotica virgifera
  misc_feature (11)..(11): n is a, c, g, or t
  misc_feature (20)..(21): n is a, c, g, or t
  misc_feature (29)..(31): n is a, c, g, or t
  misc_feature (43)..(44): n is a, c, g, or t
  misc_feature (50)..(51): n is a, c, g, or t
  misc_feature (83)..(110): n is a, c, g, or t
  misc_feature (112)..(982): n is a, c, g, or t
actcactatangggaaagcnntggtacgnnnctgcaggtaccnnggtccnnggaattcccgcggtcccttcactcgcgtccgnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgat

SEQ ID NO: 13176 - DNA, 928 bp, Diabrotica virgifera
  misc_feature (7)..(46): n is a, c, g, or t
  misc_feature (67)..(143): n is a, c, g, or t
  misc_feature (163)..(187): n is a, c, g, or t
  misc_feature (860)..(878): n is a, c, g, or t
attttcnnnnnnnnnnnnnnnnnnnnnnnnnnnnnnnnnnnnnnnnagcaacaggaaacacaaatcnnnnnnnnnnnnnnnnnnnnnnnnnnnnnnnnnnnnnnnnnnnnnnnnnnnnnnnnnnnnnnnnnnnnnnnnnnnnncgtatcagggactatccccnnnnnnnnnnnnnnnnnnnnnnnnncaatttactagagctaaacccttggcattcctaatggagaagcaacattcccagaccaagtctccacgaaccggtccgacgcccgctcatcagagggacgtcaatacccatgagcccagggcactcacccctccatcctcgcgaccggtctacatactttcgtcgtaaccgacctccccacccatcagggatcccccgttgagtcctcccccctctccaccgctgcgctcatgaccgccgccccctgaacaaggaaatatcgcatcgatccgcacccctatgcgcggccacacaccgttccgacaccagcactcccgcctctaccacatcctaccctgcataggcccattcgcccacctcttcccttgccctgcccagtgtaccccaacgccctcatcccctcagacgctaaagacacaccccccctcttaccggactggcaaccgcctccgacacctcccaccccaagcccgcgcccatgatagtcacgcctcctcatgccccactcctcaaccccccccacctgcgccgccgaccgaacgccaaacgccccaccaccgagcccccccccattccagcgatcccaaccccccagtccctcccccccccgcccgaccccctcgcgcctctccacctatgcacaaccggctccccccccgtcaccccccacctnnnnnnnnnnnnnnnnnnnccaccctcccccctcgatcactcccccctcccaaccccctctatctccct

SEQ ID NO: 13177 - DNA, 222 bp, Diabrotica virgifera; identical to SEQ ID NO: 7599
  misc_feature (6)..(28): n is a, c, g, or t

SEQ ID NO: 13178 - DNA, 691 bp, Diabrotica virgifera
atatattgcatataggtcacataatcttttaatatggctttcattcgaagtctatatagagatatccgattgattaaaaaacacgaaatgttaactgtaacatcttcatagatcactaatgaccggattctcctgcaccataataataatatatgaatgatgatcacatcttgaacgcaactcattttctttggttcttcattgttaagcagctcctacctgtatacggctacgtataatttcattgatgacttcaaaagtctgattatgtagaaatttgttttgtggaatttttcttaaaggatccggacgacctattctattatccaccactatgacgctcttatggtcacactacgctttaaaccattacatttcccacgtatcacctactttaagacttttacctatcttcttaactgtttctcgactccatcattatctaatataaacgaatttttcacttggacttccaggatgactatttacagtatcattacgaatttatgttactattttactctgatatgactatatatgaatcacctttgtcaacatctgattctatctatggacgaacattatcttatcgcagcaaggtaccgtggatcacatgccattatcgaaacaatcttcttatagagtctgctaaatcctctctaattaacagcagttttgatcgacacgtcgc

SEQ ID NO: 13179 - DNA, 915 bp, Diabrotica virgifera
  misc_feature (31)..(48): n is a, c, g, or t
  misc_feature (383)..(400): n is a, c, g, or t
  misc_feature (405)..(423): n is a, c, g, or t
  misc_feature (798)..(821): n is a, c, g, or t
gcgtctggaatttttggcaatttgtttactnnnnnnnnnnnnnnnnnnggcaatatagtaaattatttcaacataagtgcagatcacgggtggatggtacacaaattagaagagagaagagatgaaaatctatcttataaatattttaattaggtaataggggagaatggggaaatgggaaccacttaactataatctttaataaaaaacaaattttaggttatataaaaaatcggtccaggttaagtgctagtttaaaatgttaattatccttcgctattattattgcgtcaatttatttagttatgttaaatttattatgaaattactaaaaatagtgaatggctccaattgccccaataggtcgggtaatagaaaccacnnnnnnnnnnnnnnnnnntctgnnnnnnnnnnnnnnnnnnnataccaaaaatagtaataaattgttttcaactcattttgtttaaacaaaagtcacagagataatcgttagctgtgtaaacccccgaacaatctgcatgtacccatcgaccacaagctgtacagcgataccacagttctgccacttttcccagaatcatagcagataaaacataaatctgtttcatcttaattatccgagttatcatcacaaaggtctttatcactgacattttcttcatccgatgagtcttcaaaaacttgacgttttacgtttgatcgtttatcggttttatttgtggatttttttgactttcttgtttgtgtttttacttttgttttttcgtttgtgtttttacttttgtttttttcgtttgnnnnnnnnnnnnnnnnnnnnnnnncagccttttctcggttttcttttttatcccgcttattttcttaatttttcttccaataattctttttatttggggttactggaaaaaattttca

SEQ ID NO: 13180 - DNA, 925 bp, Diabrotica virgifera
  misc_feature (460)..(483): n is a, c, g, or t
  misc_feature (772)..(772): n is a, c, g, or t
  misc_feature (792)..(792): n is a, c, g, or t
atttctcacaataatttaatttagaattctaattgagaaataagtgaccatttaatttgaaaatagttattttcctaagaagtgcagatagtcattattttccgcacgcgactgcagtttgccgaacgacgcgaagcgggagttcggcaaccagtcgagtgcggaaaagagactttctgtaagagttaggaacaatattttttacgagtctttaaaaaattaccaaatcttaatcaattaatttaattaatatgaaaatacatacacaaattaattctttgagaaggttgtcaaaaccaaactttcaatataattagttagcatgacgacgatcttggtttccatgacgatgattcaaaacgactgttattgtctaccgatttgactttcgaatattatgtcaaaataattatatttcatcgaattgtcgcgttaatttcaggaacacaatacaagatannnnnnnnnnnnnnnnnnnnnnnntatctaaatattagtttattgcatgtattataattactttaaggccatattaacatatctaaattaacacgcgtgcggaaaagtaacacgcgtgcggaatagtgaaactttctaaactaaaatgggtgcgcgaaagtagacatttttgcacgctcgtagaaaaatgatttattgacgtttcgacttccacttcggaggtcgttatctaaatacaaaatactcgacaaactgaaaagtcgccgaattgcgtcccagtggggatttcaatgatctttgaaatttcccttanatagatggactagctggttntcgcttcagagatgtacactctgctctgctgaggaagcctataaggcagaaatagtgtcctgggattgtgcatccctctgaatcgaaaacaatgtttttcttagatgtcgaatgtctttctcctagacgaatg

SEQ ID NO: 13181 - DNA, 880 bp, Diabrotica virgifera
  misc_feature (830)..(830): n is a, c, g, or t
  misc_feature (846)..(846): n is a, c, g, or t
  misc_feature (865)..(865): n is a, c, g, or t
ggagttttaagtgcagtgtttggtgtaatgagacatatatatttaaaatcctctaagaatattaaaaggttagaaggaataatgagaagcccagtttttacacatttaagagctacaattgaaggtctgacaactataagagcctttggagcgcaaagcactcttatggacgaatttgatcatcatcaagactatcattcaagtgcatggtatatgtttatagtttccagtactgcatttggattttacttggattgtttctgtacaatatttttagcagtacttactttttgtttattgttattcggagaaacttttaatttaagaggaggtgaagtaggtttggcgattactcaagcaacagcactggcaaactttttacaatggggtatgcgccaatctgccgaagtaaccaatcaacttatgagtgtagagagaatattagaatacaaaagtttagacaaagaaccacaaccagtcggtcctaaaaaacctgcgaaagaatggccacagaaaggagaaattacttttaaagatacatgtttaaggtattttgaagggggaccattggttttgaaacatcttaacctaagcattcaacccaaggagaagggtgggagttgttggcagaacaggtgcaggaaaatcttctttaattcaagcactatttagactggctccaattgaaggaactatcaaaatcgatgagatcgataccaaagatattaccctcaatgatctccgtttgaaaatctctattattccacaagacccagtcctattttcaggaactttaaggtacaacttggacccattcgaagaataaacangacgaagttttatatnaagctatagaagatgtagnagtaagagatcctgc

SEQ ID NO: 13182 - DNA, 99 bp, Diabrotica virgifera
  misc_feature (2)..(83): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnngggggattaaaaaata

SEQ ID NO: 13183 - DNA, 872 bp, Diabrotica virgifera
gctgcccccggggtccgatgacagacctgttgttcttgaccgtccttcatttgacctcccaacgtcaagagacagagatgcaaccgtagttgtcggaggtaatgacagacctcttcttgaccttccaacatccagagacagagatgcaaccgtagttgtcagaggtaatgacagacctgttgttcttgaacgtccaacatttgacctcccaacgtcaagagacagagatgcaaccgtagttattggaggtaatgacagacctcttcttgacttcccaacatccagagacagagatacaaccgtagttgtcggaggtaatgacagacctcttcttgaccttccaacatccagagacagagatgcaaccgtagttgttggaggtaatgacagacctgttgttcttgaacgtccaacatttaacctcccaacatccagagacagagatgcaactgtagttattggaggtaatgacagacctcttcttgaccgtccaacatccagagatagagatgcaactgtagtcctaggaggtaatgacagacctgttgttcttgaccgtccaacatttgacctcccaacgtctagagacagagacgcaaccgatgtcattggaggtaatgatagaccccttcttgaccgtccaacatccagagatagagacgcaactgtagtccttggaggtaatgacagacctgttcttgaccgtccaacatccagagatagagatgcaactgtagtccttggaggtaatgacagacctgttgttcgtgaccgtccaacatttgacctcccaacatccggagacagagatgcaaacgtaggtgtcggaggtaatgacagacctcttcttgatcttccaacatccagagata

SEQ ID NO: 13184 - DNA, 935 bp, Diabrotica virgifera
cataaacatgaactcatgaacataacatttgatttttgatttaacatatttaactgaaatatagaaatataaaaataacatcatgtttaatcaaactgaagtaaaagaagttagtgagacgacttgcaaagaagaaatagataaggaagtagaggatacctgtaaagttgaaattaaggaggaacttatcaccgaaagtgcaaatgatacatttgagtatttagacgttaagaaatgccatataaaagccgaaataggacaagatgatggtgtctcttgtgaagatatgaaaactgatgccagtagtctattattagagaatcatgatagaagtgatattaatttgaaccaatatataacttccactaccaatgtgaatggaggacaacgttttatatgtattatttgtcagaaaccattgtcaaacaactatcatttagaactacatatgaagagacacactggggcaaaaccttaccagtgtgaaatttgcaccaaacagttttcagcaaagcctactttaaaatcacatatgacagtgcatactggtgaaaaaccatttgaatgtgaaatttgcaacaaacaattttcaaggaagatatatttaaaaacgcatataagagttcatactggtgaaaaaccatttaaatgtgaaatttgtaccaagcagttgtcaacgaaacaagcgttacaatggcatatgaaattgcacactgataaagaaccattaaaaagtgaaatttacaccaaacaatattcaacaacgtttaatttaaaaacacatatggcagtggatactgataaaaaaccttttgaatgtgaaatttgcaccaaaaagtgttcaacgaaaacacaattaaacacgcatatgagagtccatactgaagagaaaccatttgcatgtgaaatttgtaccaaacagttttcaacgaatc

SEQ ID NO: 13185 - DNA, 786 bp, Diabrotica virgifera
  misc_feature (648)..(665): n is a, c, g, or t
  misc_feature (780)..(780): n is a, c, g, or t
aacagtttgaacctgcaccagctccagcatcagtcacaagatgccgactattatgaaccacaacctcaaccacaaataccaataagaaaagcagcaatcgcaagaccaagacctcagcaacaacctcagccacaacaagctttcgaagactattctcctccacaacagtttgaacctgcaccagctccccctcgtccagctccagcacaatcaaatttcgatttcgactttggaccagtagctcgcccatccccagcaagggcattcgctccagcaccagcccccgcaccccgtccacgacctttgcaaattcctggtgctcggccctctcctatcgatgatgggtttggtccagctccagcatcagtcactagaactcaagttccaagagtaacctacgctcaaccagctccaattccttcgagaccagcaccatcgtatgacataccctctgccaggttcgctcctgcccctgcccctgcaccaaggcctgcacctgtttatcaaccaaggcccgcaccctcaattccagtcgcaggaaggtcaggaggaattttggaccagttaagtaaggactacgctttgccgtcagatggagctgcacccttacatgatattagttttgggtactattaaatataataggannnnnnnnnnnnnnnnnnttgagatattattaagcacaagcgttatatttagactgagtctatgtgttaacatcacagaactgaaatttgtcttcagttttttgtaaattattgtttaactaatataacttanaataat

SEQ ID NO: 13186 - DNA, 879 bp, Diabrotica virgifera
  misc_feature (101)..(118): n is a, c, g, or t
  misc_feature (217)..(236): n is a, c, g, or t
  misc_feature (742)..(766): n is a, c, g, or t
  misc_feature (776)..(776): n is a, c, g, or t
  misc_feature (815)..(815): n is a, c, g, or t
  misc_feature (834)..(834): n is a, c, g, or t
caaaatttattgtaataaaacatacatatttacaaatcatcatcgactacaataatcagttctttgtgtctgtacagtatgtacaaagggttacaaatagnnnnnnnnnnnnnnnnnnctttgatgtaagtaacatagtgatttacgttaaatgaaatgaataaataagtaaacattttttcagtcttcatatttgaacgttttaacgcaaatgtgnnnnnnnnnnnnnnnnnnnngtaatgtataagaaggatgactatagaaaatataaaatattgtggttataaaaataaaggcatttcttcaaagcacttttatagtagttgatacagataaacttctcgattgttaatatcgtaatcttaaaatattgctatagtgcattgaaaaaatactcccaatattggtgatgaggtaagagacacacagactgcgccattccaaaattatctgaccttcgtttataatttcgcgccaaacagtttctgttttcatcgtttttcatcgttattaaaaaatgctacgatcaaattaaataccttgaaggtgaagtgttgttcagcttattgggaaatattaactataccccgagctgggtgactcagtaaaagcatagtggaaagtttgaaattatgatggaaagtcagatacttttggcacagaccttttattatttctgaaatcctgcattcatttccttgtctaccacaagtcataaacattgaggtactggttggatacnnnnnnnnnnnnnnnnnnnnnnnnnactttcttanagcacttgtataaagtaatgttaatttatttgcacctanaaaggataccctcttttcngtatagtaaggtaacgttttttggaaatgattagcagtcttaacc

SEQ ID NO: 13187 - DNA, 596 bp, Diabrotica virgifera
cctcttacgcgccggtcctgtctagttttaatgactaagtccttttcgggaagacaggctaacagataacatgtttagtacgtatccaaacacttcatatcccaaccaaaactcacttacaaaactgcatgctggtgtcaacgttcgcactattgagcctcataagatgaaaaattctcaatgaacaattatatagtccaacacagaatataggacagaagtttaatagaaaatcaagtacttgaaataattgtttccaagggtgaagtactccgattctaagggactctaattatcgatgacatacacccagtttgtgaattcacaggagatattctcttaacacctttctctagaggacaagattgagaatagtattcgacggatctggaaaacctattgacacaggtccctcatttctgactgaaaactagctacaaaattttggatactcaaacaaccgtggtcccattctaccctagaatatatccatattggaatactgccatacgatagaaaaactcgattgcccgtgtttagaacattcgaaatttctcagatgatagacagccacataacgatatagctgccaaaat

SEQ ID NO: 13188 - DNA, 947 bp, Diabrotica virgifera
  misc_feature (801)..(801): n is a, c, g, or t
atgcagttgcttaaacgatgatactgttcaagcctgtcccgttggcggttcttgcgttaactttcttttcttctaaggactttcgtgcaacggctagcgataaggtgttcgacgaggttcaatattacgagaaactcatcacggatgaacttcaaaaagctctcaattatgaaacgcagaccaatgcgaagatgtatgagccggacgacaccacgatcagagactttggcacgttcgatttcatcatcatcggagctggatcaactggttcagttattgcaagcagactttcagagatttccagatggaaaattttagtgttggaagccggacactacccaaacaatttcacgatgatcccaggcatgtttgcgattcaggcaatgaccagctataattggggattcaaaagtacgccacaaaaaactgcttgtttgggtgccgttgacaatagatgcgtcatccctagaggaaagggagtaggcggcacatctttaataaatcaaaacatctacagccgaggcaactccatcgattacgatagattggcagaattggtgaacgaccagagttggagatacgaaaacgtgctaaattatttcaaaaaatccgaagactttcaccaaaacaatccacaggcaccagtcgactggaactaccatggcaaaaatggttacctttccaccaacttccacttaccaccgtcaaatttcactgaaatgttcctgcaagctaatcgagagcttggtaggaacattacggattacaatggcaaagagcagataggtgccaccatcttgncaatcaataccaaaaaaggacgaaggtatgatcaagcttcggccttcattacaccagtaagagaaagaagtaccttatcatctccgaaggaaagtacgtaattaactagaaacaaaacacaaaatagtcaaaagtgttctttttac

SEQ ID NO: 13189 - DNA, 925 bp, Diabrotica virgifera
  misc_feature (5)..(24): n is a, c, g, or t
  misc_feature (626)..(648): n is a, c, g, or t
  misc_feature (837)..(854): n is a, c, g, or t
ggccnnnnnnnnnnnnnnnnnnnnggaacgcgttttcgctactgtttcaccttaagtacctgctaaaagcgtttattttatatgaaacattttttatttaatttcgtatcaaattaacaataccaaatattatgtatttgcaaaaatgtaaatataatatatatatagtacaatcattgaagcttaaaataaatccaaacctcgcaattctaattaccttcatcgatcttcttgaaaatttgaaattaaggttattttaccctcctcttcaaacctgacttagttgtaaagtatgctttttaattttaaggggtgaaaactaccccttactccaatacattgaaaactaatgaattatagcagtaatggcctataattatgttcaaatatgttaaatgttgattattttcaatcatgacattaatattttgatattttacagctcacgaacccttaaaacaacccctcataaaaagattatttcaaaaatatggtaaagacacataattttttttttactttggatcgtaatgggagaatttctttccatcaagtacaagaaatctgacacttaatttttttcataatgcaaccaccaaaaaccacccctaagaatgaaacttggnnnnnnnnnnnnnnnnnnnnnnnggaagcagttatagacacatcaatatgtttaaacatgttaaattttttggttgtttttttacaatgtaactaatagttcgatatttttatacgagtatgtaactacccttaaaaactacccctaatacagttatttaaaaattaatcaaacgggacctgtggggtatgttttcaagactgatagtgtgnnnnnnnnnnnnnnnnnncagctaagtactttcagcatttttatgccatcatcagagctatgttcttataattgtactaccctcaaatg

SEQ ID NO: 13190 - DNA, 796 bp, Diabrotica virgifera
  misc_feature (25)..(45): n is a, c, g, or t
  misc_feature (417)..(463): n is a, c, g, or t
tattgtccaacctgatcatggacgnnnnnnnnnnnnnnnnnnnnntaaaaagggataccaaatgggaaaaaaacaacttaaaataatctgctatgcgaacgatgcaatactaatctctcaaagtgaagatgatttacaacgtatgctgcaccaattcaacataattaccagaaaatttaacatgttaatttcctcacaaaagacaaaatgcatggttataacagcagatccaataaaatgtaaattggagatggaaggtcagataatagaacaactgatggagtttgaatacctaggcatcacactatctagctacggaaggctcgaaacagaagtggaagatcaagtgaatagagcaaacagccgcaggttgcctgaatgacacaatataaagaaataaaaatatcggaaaagaannnnnnnnnnnnnnnnnnnnnnnnnnnnnnnnnnnnnnnnnnnnnnnatacgcggcaaaatcacgacccgataccgagagggcaaaaagattgctcgaaacagatgaaaacccttcgaaaaatcgatggtaaaactctatgggacagagttggaagtacagatatacgacggagatgcaaggtgtataacattaattactggtaagaaacagaaaaatagaatggaatgaccacataagccgaatgacaacaaataggatagtcaagacagcgagagactcttccccaataggaagacgatcagtgggaagaccacgaaaacgatggaacgacaacttactagaggcacattgaaaaaacagacagagtcatgtctatac

SEQ ID NO: 13191 - DNA, 920 bp, Diabrotica virgifera
ggtgaagtgaagatgttgtgtagttcgtacgcgtttgtgttggtttcgctacttgcgggttattgttgttataaccctctttgtgacctgctactcgttcaattaccagaaggaaaaataagaggtcacgttttagaaagccaagatggcaaggactttttcgcgttccaagaaattccgtacgcagcgcctcccgtgggcaaaaatagatttaaggatccgttacctccagttccatggacaggcatcctgaacgcaacacaaaacaagagagtgtgcatgcaaaataacgcatcagcattaaccggagtacctgaggatatggaaatatcagaagattgtctttacatcaatgtttatactccaagggtaccaggaacgtcacaagagcttctgcccgtattattctgggtccatgctggtggatacttttatggatctggtgcgctgcaatattacgaccctaagtatttcatggattatgatattatagttgtaacaatgaattatcgcttgggaccattaggttttttaacaacagaagacaacgttatccccggcaatctaggactgaaagatacagtccaagctctaaaatggacatacgataatattaatacatttggaggagacaaacataaaattacagtaatgggcgaaagtgcaggctcaacaacagcaggatttatgcatcttagtaaaagaactcaaggtatggtagctggatacattttggaaagtggtacaccaatttcccccctatgcttaccaaccaaatgccagacaatacgcttttaaattggcaaaattgctcgacaatacctttacatctgaagattccaatcaacttctggagtcgcttttaagcaagaccgcggaaagaaattacagataccatggtctctaatgacggatttact

SEQ ID NO: 13192 - DNA, 904 bp, Diabrotica virgifera
  misc_feature (650)..(666): n is a, c, g, or t
  misc_feature (672)..(692): n is a, c, g, or t
  misc_feature (744)..(780): n is a, c, g, or t
gctgaagtccaggctcttcttagcggtgataagacggccccagtttcaaacgaaaaagagggtattgataatcctacattcgataaaaactaggttaggttttaatatttgtacctgaattttgtactagaaaaattttaattactgactttcttcaacatttttgttatctcgtatattataaattttcccaaacaactatagaatatgacaagtggtagttgtcgattttttatcaaaaacccttaggctgcaagtgtacagttgatggtattttcttaaagaggactacataatatggactgtaaatattttatgattttacgacctcttaaagacaatattatcatttataaaatgtgagcgttttggttggaaactttaaaatgtctacattaggttaggtaatgttaggattttattttcaataatcattataataatgacgtaataatgacatgatgatgtcatccaatgtttttattacaggtcgccagaaatatctgaaactgctaaggtcagacagatcgaaaactttggttacgcgacgttgtcagatctcacagtaaaattaatttctgctttctcctgcgtaaattttaaaacattgtgtatcatgtcacgggattgtgcacttagtgttctatttnnnnnnnnnnnnnnnnnattcannnnnnnnnnnnnnnnnnnnntaaattgtattttagatacgattactcgacgattttatttggcaatttcatnnnnnnnnnnnnnnnnnnnnnnnnnnnnnnnnnnnnntcgattgtacactgctggaaatagatctttcctcataattttccatatatttcgattttgaggctcttgaattcattgctatgaaaaggacgacctttgcttcccgaaggtataatctctttgt

SEQ ID NO: 13193 - DNA, 714 bp, Diabrotica virgifera
  misc_feature (2)..(515): n is a, c, g, or t
  misc_feature (522)..(559): n is a, c, g, or t
  misc_feature (596)..(617): n is a, c, g, or t
  misc_feature (625)..(647): n is a, c, g, or t
  misc_feature (677)..(708): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggattaaagtttataattggcnnnnnnnnnnnnnnnnnnnnnntgttcgannnnnnnnnnnnnnnnnnnnnnnagtttaaaccggtgtgagccaggctggttnnnnnnnnnnnnnnnnnnnnnnnnnnnnnnnngaaagg

SEQ ID NO: 13194 - DNA, 241 bp, Diabrotica virgifera
  misc_feature (2)..(240): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnng

SEQ ID NO: 13195 - DNA, 692 bp, Diabrotica virgifera
ccttacgcgtccgccccgcttttagtggcagtgtatgcccctttgtgccttgtctctgctaatcctcctaaagtagtatctagaaactagtattactgataatccattttttaccccatttaagatctacttgtgcatcccgaagatctagaagttgctttgatgcatttagaacatatatggacgactgtgattaccattgacaatattgttgaaccgcgaaatacacagctgctagcagcgagtactgccttggggttggacttgaagagattgtaccctccgcttcggacgaagacttagttgttgcttaagcttcttcagagtaagaatgtaaaaactacccgcggactccaattctttgctgtctactgaaggatagcactgagtgaactattaacatggaagaatatgtcaaaggtgtcttatatcctatcatgatattaatatattagagattttaaaagtcacaaagcctttagacaacccctcataaatacgttatttgacaaacatggaatggatgcttcagatttttgttgctacggatcaagatagtgggatgtgctttctttaaaggacagaaggtgtgacactgaatctttttcatagtgccaccccctgaaaccgcccctaataatgtgacttgataaaaaattgaacattcatgtgtgtgaatcagctatagacac

SEQ ID NO: 13196 - DNA, 869 bp, Diabrotica virgifera
  misc_feature (825)..(852): n is a, c, g, or t
gttaacgggaagtttttctctgtcagatatctattagtatctaatctgtcagataaacttcctgataactagttatccagaggtgaaaagaaagaaagagagggccataatggataaaagatcaaacgccaatagcatgtaatataatctttatataaatttattaacaaactgcagtccaataaaaataaaattagtttaagcgctagctttaaatgtcgaacaataattttaaacaaacacacacacaatttagtcgcattagattagctcctggttgaaaatgtactgccacagcttctatatcaatatcaacagcacactcatttgccagtatttcaacgttttctctattatgtactactgcaatatgtaaaactgaacaagctgatattattctttgaataaaaggtaacttgcatctcattacatatggtaaaatgggaaatctcttcacaataccaaatgttctttcaataacaattcttgaagggatttgtgatggattataaaaacacaacttctgtctgaaaattctggaatggtgtcattcggtagttgtagttgaggaatggatatccactattccctaataatatattctccagaaattccccattacatatacccataatgcaaaagtatttaaaaactcctaaaatagtatttccaatttattgcacttccatattattgaacgatgagtattatgggatatattatgttgttctctaaacatctttaaatgacaaaataattaaatttaacgttttactcttcaattatcttattttaatttatatcgacaaatggaattttataggnnnnnnnnnnnnnnnnnnnnnnnnnnnntgtcatttgtcaaaata

SEQ ID NO: 13197 - DNA, 916 bp, Diabrotica virgifera
  misc_feature (847)..(847): n is a, c, g, or t
  misc_feature (868)..(869): n is a, c, g, or t
  misc_feature (898)..(898): n is a, c, g, or t
gacctgctgaaaggcccactgcaaaacgcccagaagataatcttcgtccagaaggtgagtttgaaagacctacaccaactaaagtcggacctgctgaacgtaggactccaattaagcacgatgataacttacaccctgaaggtgattttgatcgtcccgagaagcccagatataaacctgcagagcggcctacacctaaaaagcctgaagataatttgcatccagaaggtgaattcgagcgacctgaaagaccaggatatgtgccagctgagcgaccacaacagaaacgacccgaagataatcttcgacctgaaggtgattttgaaagaccaactcctactaaaattggacctgctgaacgtaggactccaattaaacatgatgataacctacgacctgaaggcgattttgagcgtcctgaaagacctggttatgtaccagctgagcggccgagacaaaaacgaccagaagataatcttcgaccagaaggtgattttgaaagaccaagtccaactaaagtcggacccgctgaacggagaactcctattaagcatgatgataacttacgtcctgaaggcgactttgaacgtcccgaaaaaccaacatataaggcagctgagcgccctactcccaaaaagccagaagataatcttaaacccgaaggagaaattcaagttcctgagaaaacgcaatacagacctgcagagagacctacacagaagaaacctcaagataatttaagacctgaaggagaatttgagagacccgaaattatagaggttggtcctgcagaacttagaaagccaataagacacggcgataatttaaaacctgaggtgaatgacangtactagaagagatgattacnnaagtgtcagaggagatagagttgaaattngtaaacatgaagataatc

SEQ ID NO: 13198 - DNA, 670 bp, Diabrotica virgifera
cccggcgggaccgggccgggattcccggggccgccccacgggccgggtggttgctaaatagtaaaatattaagtcctaaacagatgagaaagatgttattcttatcgagtgctggttacgggtggcgcagatataatgttatccccgtatatgtaataccagagattttggccattgggagtgagggatgagcagatcataactagaaatgtattaattgagaattcactaaggcacgaaaattggaagttatatgcgtatgtgcgaatatcgtcaaacgcatctgcgtcgggtggtgatgcgcgtgccgtacgctctcgaatctgatatctttcctaggattgttatcgaggatcaagttacggaggaatcaaaagtcgaatacttgcaagattatctatttttagagctgaagattgagaaagtggagaattattcccgaataccctattgatttaccgatagaggaaccagcaagatcttgcatgtgttctttatgagcgctagtaactcttaccgattatatactcttgactgcgataagaatttccaaaaccagctcacgcctaaattccgtgtcgttacagaacattcggagcagcatcatagatgatcagcagaattggatatacccctttcaaagcgacccctggcgcatttgggtccccct

SEQ ID NO: 13199 - DNA, 201 bp, Diabrotica virgifera
  misc_feature (11)..(48): n is a, c, g, or t
  misc_feature (50)..(64): n is a, c, g, or t
  misc_feature (69)..(71): n is a, c, g, or t
  misc_feature (79)..(79): n is a, c, g, or t
  misc_feature (89)..(89): n is a, c, g, or t
  misc_feature (102)..(125): n is a, c, g, or t
  misc_feature (132)..(132): n is a, c, g, or t
  misc_feature (134)..(197): n is a, c, g, or t
tgtagaggggnnnnnnnnnnnnnnnnnnnnnnnnnnnnnnnnnnnnnngnnnnnnnnnnnnnnngttannnaagcttanatttttttanaagacgagagacnnnnnnnnnnnnnnnnnnnnnnnnaaataangnnnnnnnnnnnnnnnnnnnnnnnnnnnnnnnnnnnnnnnnnnnnnnnnnnnnnnnnnnnnnnnncttt

SEQ ID NO: 13200 - DNA, 893 bp, Diabrotica virgifera
  misc_feature (44)..(70): n is a, c, g, or t
gtaaaagttttataaacgtataatatacaggcttattcgtaagnnnnnnnnnnnnnnnnnnnnnnnnnnnaacgaaaaagcattgcttcaatgttacaatagaggttgtggtcaaaaattcgatccagacaaaaataatgaagactcttgcagacatcatcctggtgaacctgtattccatgatgcatacaagggatggagctgttgcaataagaaatgtacagattttacggaatttttgaacatacaaggttgtacactatccaaacattctaacatcaagccagtagaacctgaaaaaccagtagctaaagatgtagatgtaaatgaagtcattgaggttaaacccatagttcaatcaacaatggaaaggccttcctttaatactcctttagtcacaataaaggcacaagtagcaccatctcttcaacaacaactcaaaatattagaaaccaaacaagaggtaaagacaacaaacttatcaggagaaattgttataggaaccacatgtaaaaatggaggctgtggaacaacatatgaagggccacaaacaaatgacacaacttgtacttatcatccaggagtgccaatatttcacgaaggcttaaagttttggtcctgttgtcaaaagagaacaactgattttgatgcatttttaaatcaagttggctgtgaaactgggactcacatatggagtaaagaagcggcaggtgatgaaactgtacaatgtcgggtgggattttcatcaaaccggctcccaaccgtggttgtctcaatttatgccaaagagtattgtctaaaggagagcatagttaagcttaatcaagtaaggatgtatgccaaactggtcttcccacaacagtctaatgcaagttttcttcttgataatgagc

SEQ ID NO: 13201 - DNA, 958 bp, Diabrotica virgifera
  misc_feature (7)..(865): n is a, c, g, or t
  misc_feature (867)..(879): n is a, c, g, or t
  misc_feature (881)..(925): n is a, c, g, or t
ctataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnncnnnnnnnnnnnnnnnnnnnnnnnnnnnnnnnnnnnnnnnnnnnnntggggcgaataaaaatagaaaatgaactttttt

SEQ ID NO: 13202 - DNA, 281 bp, Diabrotica virgifera
  misc_feature (6)..(37): n is a, c, g, or t
  misc_feature (39)..(208): n is a, c, g, or t
  misc_feature (214)..(274): n is a, c, g, or t
taatcnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtnnnnnnnnnnnnnnnnnnnnnnnnnnnnnnnnnnnnnnnnnnnnnnnnnnnnnnnnnnnnncattttt

SEQ ID NO: 13203 - DNA, 432 bp, Diabrotica virgifera
  misc_feature (2)..(45): n is a, c, g, or t
  misc_feature (321)..(357): n is a, c, g, or t
gnnnnnnnnnnnnnnnnnnnnnnnnnnnnnnnnnnnnnnnnnnnnatcaatggacgagatgaagaaaagaatgatagaaaccgacctgactcacaccgtcttgagattcagatcctggaacattttatatgtcgaacaaacatacataatataaactgttacaccaattgataaactttaatcaaacatcgagttaacattatatattatcgtttagacactctgctaggaagtggcggctgaaacgataaggaaatctaacataactaacgaagaaagtgtagattctgttctcccgactaacaatatcttagtaattgnnnnnnnnnnnnnnnnnnnnnnnnnnnnnnnnnnnnncatgagctcaaccccataatctcattaaaattctaatttcaaccaaaaatcaggattaaccatttttctgatatt

SEQ ID NO: 13204 - DNA, 686 bp, Diabrotica virgifera
  misc_feature (356)..(377): n is a, c, g, or t
tgggacccccggagggaccgggccgggattcccggggcggcccccggggccgggtggattgaaggactctaatattttggtttattgtcattgttggttgatgtaataatttaaacagattttaactggtaattatagaccgaagatattttagagctaaaaaaagtactttaagattcgattgcaaatgataagaagtttattttcttctttcgaccctacatgtaattttaattgaccaagaggctgattaagaagggtattaggacaatgaatgattccatctagattttgattaatcccctctcgttagagttattgatgattaaagattatgatgagattacataagagannnnnnnnnnnnnnnnnnnnnntatgagagccgaggaagaacgttaatttttatctcactatgtagattgattgtatttaataattttcttggattattcccgaatatgtgtactggaacgaggcatataactttaacaataagattagctgtaacattatgattgagatttataatatatggatgaatatgtaatagtatacatatgttaggtcattgagcgcctcgaggaagtcctgcgattgtaagaccattgatagtttggattgaatcgatgaaaaatggaatccgccctgggacattcagccgtacgtctagctgttaagataat

SEQ ID NO: 13205 - DNA, 927 bp, Diabrotica virgifera
  misc_feature (187)..(215): n is a, c, g, or t
gctgtattgttctattattttgccgtcaaacccatgagttactggaaggaaaggggaataaaacagacaaaacctgtatggttgcttggcgatagttggggtaccttactgaagatgcatagcttagtggactttatccaaaatgtatatgaccaagttccggatgtaagatatttcggattgtacnnnnnnnnnnnnnnnnnnnnnnnnnnnnnagacccagatctgatcaaacagattgccgttaaagattttgaacatttcacggatcataggataatgttccctaaaaattccgatcccttaatggctaagaatctattttcattaaaaggtcaagtatggcgtgacacgagaccgatcctcagtccaacattcaccagcagcaaaatgcgagccatgttcgtcctgatgtctgaatgtggtgagaatttcataaaatatttcctggacaatgacaaagatactatcgaaacggaaatgaaggatacttttagacgattcacgaacgatgttattgctacgactgcttttggcgttaaaacagattctttaaagcacagaaataatgatttctttgttatgggaatgaaagcagtagattttgggttctggaaaagtctcaagttttttggatatatgctcatgccgaaggttttagggttcttcaaagttacaatttttggcaaagaattaagtgatttttttatggacctgattaataagacagtcagaattcgagaagagaaaggcattgttcgtcctgatatgatccacttactaatggaggccagaaagggaattcagcagaatgaagagaaggttatagatactggatttgctgtagtagaagaagcagatttaggacatggtaaaggtgccaaagaaatcaccaatgaagatatagctgctcacgctctgattttc

SEQ ID NO: 13206 - DNA, 714 bp, Diabrotica virgifera
  misc_feature (31)..(67): n is a, c, g, or t
  misc_feature (117)..(135): n is a, c, g, or t
  misc_feature (266)..(296): n is a, c, g, or t
  misc_feature (313)..(354): n is a, c, g, or t
  misc_feature (529)..(549): n is a, c, g, or t
  misc_feature (618)..(639): n is a, c, g, or t
gttggattatacaaattggttatatatatgnnnnnnnnnnnnnnnnnnnnnnnnnnnnnnnnnnnnnattatcattcattaaaatatatcccataattggctgccgacgagtgtgcnnnnnnnnnnnnnnnnnnncacattctgagagatatcctgtgtgttccacacactcaacacacacgcgcgctcacagagagagtgataaagaaaagacaaacatatatatgcacatgtatgtgcgtatatatatatggaggtaatagttnnnnnnnnnnnnnnnnnnnnnnnnnnnnnnnatctatataaatgtggnnnnnnnnnnnnnnnnnnnnnnnnnnnnnnnnnnnnnnnnnnctataactcagtgtgtcttacattgtgtgatatatagcgcgcgatatatagagagctactagaaaaacatattcacacacacctcctgtcacactgtgtgtgtatataaatagatagatcaaaaataatctgtctgtgcgtgtgtctgtgctatctctctctctcacaaacaagnnnnnnnnnnnnnnnnnnnnnccatgtatctcacccactcactatcaagaacgatcgcacgatatatatacaatatacacacgagagagnnnnnnnnnnnnnnnnnnnnnncgggcgcgcgctcgggcgcgcgctcgcgcgcgcgcgcgcgtgcgcacacatatctctcatagagacacacatata

SEQ ID NO: 13207 - DNA, 887 bp, Diabrotica virgifera
  misc_feature (8)..(701): n is a, c, g, or t
  misc_feature (708)..(731): n is a, c, g, or t
  misc_feature (734)..(746): n is a, c, g, or t
  misc_feature (815)..(835): n is a, c, g, or t
ctcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnntcnnnnnnnnnnnnntgcgacctccgatgttggattaaagtttataaattggtgtaacaactatattatttaagcctgtccaannnnnnnnnnnnnnnnnnnnnctgagttaaacccggggggagcccggttgggttcctatctttattttataaa

SEQ ID NO: 13208 - DNA, 218 bp, Diabrotica virgifera; identical to SEQ ID NO: 7300
  misc_feature (6)..(28): n is a, c, g, or t

SEQ ID NO: 13209 - DNA, 915 bp, Diabrotica virgifera
  misc_feature (467)..(484): n is a, c, g, or t
  misc_feature (877)..(898): n is a, c, g, or t
attgattcaagctggagtagtatcagtcacacaaccttcagaaaatgacctcttggtaactttggaccgatcagcaattcagggagcaggtagggtagccataggtcagttcctgttgcaattacaaatttacaaagcaactggaaatttggaaaaagcccaggaactgtacaatcactacgccgaagtgacagaaccatggttgagttggaggtcaattgtactagccaataaacaaccaagaaaaatgtttgtccaagctaatacctctacagcagaaaatggcgttagcctgaaatcatacgaaccatcgctagaaggtttggtccaatcttgggtggaaaggttttcaacaccacaaccgttgtatgatgccttgttagaactttcgaaagctgatgctgctcatttttaaaaatgccgtaaattattaacaggttattataaccgttttgtattacaactgnnnnnnnnnnnnnnnnnnggataatttattcgcttcttcacttttaaggagctgtcctagtgtgggagtgtgaaattcatatacgtttttggaaatttctaaaataaaaagaactctaccagttgttttgaaaatttgcatgggcagttactataaaaagaagtacacgtaaacaaaatttcataaatcgtttaattttcaatatctttttatgaaaattgttctaaaggtacttcttattttagaaattcccaaaaattatatgagtttcgtacttttacactaggatagccccttaatcgataatttagctggtactaatgaaaagaaagacatcagttagttgtaagtcataatttttataccagtgatattttgtttatccttcaaactacttaccattgaaagaannnnnnnnnnnnnnnnnnnnnnacccttgctatagttat

SEQ ID NO: 13210 - DNA, 921 bp, Diabrotica virgifera
  misc_feature (496)..(514): n is a, c, g, or t
  misc_feature (598)..(616): n is a, c, g, or t
  misc_feature (682)..(700): n is a, c, g, or t
tctgattgtacgtgggccgaatcctattcgtacaacctatatcctatggatgctggtacagatgatggaataggatacatgacctccgatcctctacgattctcacgaaaacttatcatgccaataactcctaacaatcccaatgatccaagatcaccattttacgatgaagatggtacacccatgaatccaatagccaaactgcattttactagacagcgcgtttacgaaaaaccttgcgattctaacgaacaagaagaatcttcgggagaggatgcctgcgctactactaagtggggagattggacaccctgttcagtaccctgtggtctcggaaagaaaaccagaatgagaagttacgtagatattaggaaatcgcagaattgttatgttcaactagttcaacaccagacatgccaaggtacagcaaaatactgtaaaatcagttcaaggaaaagtaatagacgaaatcgtctcaaaaatcgtataaaatcannnnnnnnnnnnnnnnnnngcaaagctacggaagaagaagaaggtaaatccaaggaagagtctaaatcaaaggatgaggaggaaactaaagaagataaaggtnnnnnnnnnnnnnnnnnnngttccgatgaagaagcaaaggattctgatgaagaaggggagtccaaagaagaaaaagatagtaagnnnnnnnnnnnnnnnnnnncggaaggtgatgataattcaaatgatgaaaaagatagtaaagatgaggaagacgaagaaaaggagaacaaatctaagaagcagaaagattcagacgaagaaaaaaaatcgggagaggaagaaggtgacagtgatgaaaaagattcgaaagacgaaaagataaatctaatgataaagaagattccaacgaagagaagtcggaaagaaaatccaaatctgatg

SEQ ID NO: 13211 - DNA, 428 bp, Diabrotica virgifera
ctcaccacagggtccgtgtaatttaactgttattagtagtaaacatcgcgttttacagtgctggaatatttctttgatataaaattacaaagacaaaaaataactgacaatgagttacgacgatgttatatctttacttggagaatttggtaggtatcagaagaaaatctattttttgctatgtttgcctgccattctttgtgcctttcacaagttaggcaacgtgtttttagtagcagaaccaaattatagatgtaaattaccaaatgaaacagataattctagttatcatttaaatgagacgacgttgtctctgtattatccgagagatactctccacaaaaaatactcatcttgcgagatttatgatacaaataacataacaaaaccatgtgaatcttatatttttgatcatgaaatatatggat

SEQ ID NO: 13212 - DNA, 94 bp, Diabrotica virgifera
  misc_feature (16)..(49): n is a, c, g, or t
  misc_feature (51)..(86): n is a, c, g, or t
aagaaaaccctattgnnnnnnnnnnnnnnnnnnnnnnnnnnnnnnnnnngnnnnnnnnnnnnnnnnnnnnnnnnnnnnnnnnnnnngggggggg

SEQ ID NO: 13213 - DNA, 418 bp, Diabrotica virgifera
  misc_feature (15)..(43): n is a, c, g, or t
  misc_feature (51)..(79): n is a, c, g, or t
  misc_feature (83)..(128): n is a, c, g, or t
  misc_feature (152)..(180): n is a, c, g, or t
ttcccggggtccgcnnnnnnnnnnnnnnnnnnnnnnnnnnnnnttcctttnnnnnnnnnnnnnnnnnnnnnnnnnnnnnctcnnnnnnnnnnnnnnnnnnnnnnnnnnnnnnnnnnnnnnnnnnnnnnttttattactataaatgtaacttnnnnnnnnnnnnnnnnnnnnnnnnnnnnngtttctagtttaagggtttatacagattatatcggcgggttgatcttctgattctagttatcctgtagtgaagaagcactatttttgatgccagacgccatatctgacgtcggaatgatgacagtgctgtacagactgaaatgaaaaattggtcatttgaagtaataaatgatgcaggtataccaaggatgaaagttgaattcaagggcgatgaccagttcctgctacccagaagaag

SEQ ID NO: 13214 - DNA, 449 bp, Diabrotica virgifera
  misc_feature (2)..(75): n is a, c, g, or t
  misc_feature (88)..(109): n is a, c, g, or t
  misc_feature (118)..(278): n is a, c, g, or t
  misc_feature (414)..(432): n is a, c, g, or t
cnnnnnnnnnnnnnnnnnnnnnnnnnnnnnnnnnnnnnnnnnnnnnnnnnnnnnnnnnnnnnnnnnnnnnnnnnnttctatttttacnnnnnnnnnnnnnnnnnnnnnncaaagacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaagaaaaaattaccttaagggaaaaaccggaatttttttggggaagccaaatcgaaaaaaaagattgggaccccccgggtgggttaaaagttttatatggggggggaaggcttattttttttattctggtccccnnnnnnnnnnnnnnnnnnngttctcgtggattaaaa

SEQ ID NO: 13215 - DNA, 83 bp, Diabrotica virgifera
  misc_feature (2)..(19): n is a, c, g, or t
  misc_feature (39)..(79): n is a, c, g, or t
gnnnnnnnnnnnnnnnnnncgagaaaaccctatagaggnnnnnnnnnnnnnnnnnnnnnnnnnnnnnnnnnnnnnnnnncaca

SEQ ID NO: 13216 - DNA, 887 bp, Diabrotica virgifera
  misc_feature (109)..(128): n is a, c, g, or t
  misc_feature (422)..(444): n is a, c, g, or t
atgtcatgctggtgacgtcatccatctgggcgtgatagctcatttgaaaggttgtttgattctctattcagtactatgaacattggtataattgtgtatacaggatgcnnnnnnnnnnnnnnnnnnnncattgattgggacaaggagaggaatgtgtgtgatttatttaatttgaaatacattttgctgttgtcagaagacaggaaggaatgtttgtttaacaaataaatattgttcttcccttaaattcaatattaaatctgccacctacccgcctcttggcaatttaaacacttaatttaagcgaaaaacaatgtttattttttgaataaccattttttcttttttctggcagcagtgaaatgtattttgagttaaataaattgcatgcatcctttttttgtgtgtcaattaatttaacnnnnnnnnnnnnnnnnnnnnnnntaccctgtcgatggtatagttcacaaatgtggtaagtacaatttttttagaaaatgaggtaagtacacaagtacattattttgacccaaagtttattgtgcccaaatgtggtaagcaaataatgaaacgtgtaagaaatacaagttgacataatgtgttaactgctaaatataagacaaattaagtaagccaaatgttgtatgtgcccttaccacaaatggtttctcttcactgttctaacatgaatgatacttctgatgatgaataaatatttgtattcattctttttgcggattaaacaattgttccttatatttcttatttaatttcatttagaagcttgtagtatatacctgtcaaatggggtatgtacaatataagaaactccacatgtggtaggtacatacctataagtacaaaaatctatgtttaagtatttaaaa

SEQ ID NO: 13217 - DNA, 510 bp, Diabrotica virgifera
  misc_feature (298)..(325): n is a, c, g, or t
  misc_feature (472)..(491): n is a, c, g, or t
attccaactgggcagttggtaaaccaagcagaaggggttctaaagaatgcatccaagtagaccagatgggcttttggagtgatgaagattgcaacaacgttcggtattttatatgcgaagtacaaatgtctccaggaaagccagttcctactaaaccaagtgtatccaccggacagggacagtgtcctgaaccggttattaatgtttatattaataccaacttagacggtgattcgtcatcaaaccttatttcttccaaagatgttaaattaagtgatagtggttaccaagttcttgnnnnnnnnnnnnnnnnnnnnnnnnnnnncgctgctggtggaaatggaaatatcgcaaagactactactgaatcttactatgatcaattaaatggtttaggaggactatagtcgggtaatagactttggagtgcaaggatgttaatttgtatatatatgtaataaacgtacactgnnnnnnnnnnnnnnnnnnnngatacaaacagagcaaccg

SEQ ID NO: 13218 - DNA, 685 bp, Diabrotica virgifera
  misc_feature (331)..(348): n is a, c, g, or t
  misc_feature (603)..(621): n is a, c, g, or t
tttaatttatgttgatataatgactaatttttcaaagaaagtgagtaaatattgtatattatgaataatactgagaattgacgaaagaatatcttattttatataaaagaagaatttatttgtatatgatcctcgagtatcatggatcatcaatgactactactgtgtctattatattcaaatttttgaaagatacaaatttaaaatttgtcttgtatactaatgattacattccatttttttagaaaagaaatagtgattcatttgtcatgatatacaaatttttcaaaagataaattaaattaatctagtaacaatccattcttccctnnnnnnnnnnnnnnnnnnatgattcaatagttttagggtcgcccttaactctatgagtttatcaaaactctcttatttttcaatagaaattacgattactcatcttcctatttttccatatgtaattatcatattcttgtatatatcatcagctttactctttgtatagattgtgtattagatcataaacgtactgtatttagagttacccttgatgatactattagtatctccttctggcatattgaatagacacatatacagctactaatnnnnnnnnnnnnnnnnnnngtccccggtgtattacaaacatgcctgtctgcattacctatcctccctcacctgctcactgatt

SEQ ID NO: 13219 - DNA, 498 bp, Diabrotica virgifera
  misc_feature (20)..(138): n is a, c, g, or t
  misc_feature (146)..(199): n is a, c, g, or t
  misc_feature (203)..(228): n is a, c, g, or t
  misc_feature (271)..(271): n is a, c, g, or t
  misc_feature (273)..(321): n is a, c, g, or t
  misc_feature (348)..(419): n is a, c, g, or t
  misc_feature (441)..(490): n is a, c, g, or t
gggcggggcggcgggccagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccacnnnnnnnnnnnnnnnnnnnnnnnnnnnnnnnnnnnnnnnnnnnnnnnnnnnnnnaagnnnnnnnnnnnnnnnnnnnnnnnnnntcccccccttcctttccctcctctcctcgcgacaagaggaacncnnnnnnnnnnnnnnnnnnnnnnnnnnnnnnnnnnnnnnnnnnnnnnnnnggtggtggtgggggtgttgtgggggtnnnnnnnnnnnnnnnnnnnnnnnnnnnnnnnnnnnnnnnnnnnnnnnnnnnnnnnnnnnnnnnnnnnnnnnnatatagtcccgaacaaaaaatnnnnnnnnnnnnnnnnnnnnnnnnnnnnnnnnnnnnnnnnnnnnnnnnnngggggggg

SEQ ID NO: 13220 - DNA, 492 bp, Diabrotica virgifera
ccgcgcgctataatagagtgtttaaattctttagacacgagtttttagatgcacgatcaaatgtgttgagacactggaattgttagatatttgggattattggtcaatatatggaactgcacttgctcggactagatttacatcaatgcattgaaactttattgatcttgaatgatagaccagctaccaacgtactaccaaaacacttcgggctatctcgaatcctcccgaacatcttcgcttacatcatttccatctcaacggatctcagatgctgcttgagacatcgatgaatattagttgcatagatgaccactatcgcttatatagccgcttactatatcgatcatggaagtaggcatcggagttcaatgtttcctacgcttggatatcccattctagatttaagtcctactcgttaatatgagatagcgagacatattacgagaattatatgcataccaagaagcaaacgaaacttatgattgttgc

SEQ ID NO: 13221 - DNA, 252 bp, Diabrotica virgifera
  misc_feature (12)..(47): n is a, c, g, or t
  misc_feature (50)..(177): n is a, c, g, or t
  misc_feature (179)..(249): n is a, c, g, or t
agctcaaccaannnnnnnnnnnnnnnnnnnnnnnnnnnnnnnnnnnnatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnatg

SEQ ID NO: 13222 - DNA, 827 bp, Diabrotica virgifera
  misc_feature (612)..(629): n is a, c, g, or t
gtatacgcgtacgtttcttttaccgggaactgtttacagggaattttaaataattctcttgttataaaacatttcaagaatttgtgactattttggttaagggatgaaagctttgacttcaactaacagtccgctgtgttgagaaaattaatggcaaattctctctatatttgaagcactgtcgagtgtacaagacaagcaaaaatatggcttttaacagataatgtggtttatgttcatttagagaaatagacaattattagtgcaaaaatataagaaaattacaaattttattgattctaaattatagtggtaagatttttctttggtatttacacacttaggcaaaggtttactcaaattattttttgtacttataccaagtggaagaaaagacatgtttttcgtatgttaagtttgagataccctgtagggagaacaaggtataagtggtaaccaacaattattatgattaagattagtgcaacgttaaagctcagtataataggattaatcatttttacaatgatttttctgcgttttcaaggctcactgttacaacgcaacacttactcgttaaccacaaaattattgttaaatggaaagaccttnnnnnnnnnnnnnnnnnnctataatcgtctattgaacatcagctttaatttttctatgataaatcaagtgtgccaggaaagtgctcctgtgttagtgcttatagtagttcattctgcaccttcaaatttcaagaagaggcagacaataagagatacatggggacaagtagaagaaactaaacaaatagtgtttatgaaagggaatccgagttctcc

SEQ ID NO: 13223 - DNA, 1219 bp, Diabrotica virgifera
  misc_feature (14)..(637): n is a, c, g, or t
  misc_feature (682)..(700): n is a, c, g, or t
  misc_feature (702)..(718): n is a, c, g, or t
  misc_feature (725)..(760): n is a, c, g, or t
  misc_feature (779)..(848): n is a, c, g, or t
  misc_feature (851)..(939): n is a, c, g, or t
  misc_feature (1040)..(1057): n is a, c, g, or t
  misc_feature (1065)..(1082): n is a, c, g, or t
  misc_feature (1132)..(1159): n is a, c, g, or t
ttccacagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcataatatttagtttttttaattgaaactggaatgaaagggnnnnnnnnnnnnnnnnnnncnnnnnnnnnnnnnnnnngaaatcnnnnnnnnnnnnnnnnnnnnnnnnnnnnnnnnnnnncgaaaaaaccctatgaagnnnnnnnnnnnnnnnnnnnnnnnnnnnnnnnnnnnnnnnnnnnnnnnnnnnnnnnnnnnnnnnnnnnnnnggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttaggggataacagggtaattttattggaaaagttcaaatcgataataaaaaattgggcccccgaaggtggaattaaagtttataattgggggaaacgnnnnnnnnnnnnnnnnnngtctcacnnnnnnnnnnnnnnnnnngtcttgggggtataaaacggggggggggcccccggtggggcttccttttnnnnnnnnnnnnnnnnnnnnnnnnnnnncatacagccaacggggggcacaaatatattgtaaatatataatctttctttttatttttt

SEQ ID NO: 13224 - DNA, 236 bp, Diabrotica virgifera
  misc_feature (179)..(203): n is a, c, g, or t
cgaaccatatcaaactatattatataattggacttttgatacaaaacaacctgaatcacaccgggataaaatccaatcaggtataaaccgaaaaaaactacaaacttaataatattatgatgatacgcaacattattaactttaatccatgatacgaggtcgatatctttattatcgannnnnnnnnnnnnnnnnnnnnnnnnctgttatccctaaggtaatttattcttataatc

SEQ ID NO: 13225 - DNA, 685 bp, Diabrotica virgifera
ggtttttccgctttcaagatagtcaataaatattaaaccatgcgcatcccaaaatactgatgccttaaccttgtcagccgactgttgcatctttccacgctttagagtcagttcttcacgtgcagtccactcggctgactgtcgattggactccggtgtgaaatgatggagccatgtttcatccattgtaacatatcgacgcaaaaattcggttttattgctattgaacagcttcatacacttcttagaatcaccaattcgttattgttttatgaaatattgtgagccaagccttggctttaacagtattttttttcgccaaaaagcaaagctttattaatacacgaaatttctttttatccattttctttaaactaacacaagttccttcactcaaaatgctatatctcaaactaatacttcgacagctgtcaaatttatagaccattccagaatgacgtcatttgacatcggctgatgggcaaacatcttgtaaacaaagtacgtttagtgcagaaaaccattgtttaaattaaaaatatgattaaaataccagcgttttgttcagttgtaaagtgttccaataaaggtaaaagagataaaatgagttttttaaaataccagccgcatttaaaagatcgagatgttttaataaatgcactgtcaacaatagcgacgtaagttt

SEQ ID NO: 13226 - DNA, 199 bp, Diabrotica virgifera; identical to SEQ ID NO: 6505
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(193): n is a, c, g, or t

SEQ ID NO: 13227 - DNA, 462 bp, Diabrotica virgifera
  misc_feature (2)..(25): n is a, c, g, or t
cnnnnnnnnnnnnnnnnnnnnnnnnatcctttattagtgcaattagataaggaatgtgagaaaattttttaaaattgttcggaggacgactaatgggatgaagaagaaacacaaatgggggtccgatgagatgcaaggacccaatgcaagaatccaaacaatataataagactccccaggcaaaagtttgtttgttggtgtagagtggagctagggaatcggagaagatagaacgattgcggcttaagaagtggacgaggaaaaagatcgggtcgtactaagctggaatgctagatctttttcaattagtgaaagagacaagaaacatacaatggggatttgtgtagaattgataggaggaaaggagcatcgaaacagaagagatacagggacgcatcatgggaagaagactgcttcgcacgaaagaatcctatgtcatgccttaggtcttctagaaataat

SEQ ID NO: 13228 - DNA, 639 bp, Diabrotica virgifera
  misc_feature (25)..(44): n is a, c, g, or t
  misc_feature (338)..(353): n is a, c, g, or t
agaatgtctatctgcgtctgcaccnnnnnnnnnnnnnnnnnnnntgataatatttacaaactaaaagccttagatccaaaaatacagaatctgatcaacatagctacagaaggaaggctcaatgcctactgcccttacagtaatttcaaagttggagccagcgtgatgtgtgatgatggaacgatattctcaggctgcaatgtagagaacagcgcattcaccgtaggcctatgcgcagaacgatgcgcctacgtaaaagctatcagcgaaggaaaaatgaagttcaaggcggtatgtgtagtggcgcagcaagaaaattcattcaccactccatgtgnnnnnnnnnnnnnnnncatgagcgaattcgggaatgtagatgtctatatcacgaagcctagtggtagtgatgttttagttttaagtttagataaattgctaccatatcagtttgagactgtagaccatacttttacttagaacatgggtggccaacattttcagcaggcggacaaaacaattttatttattttccaaagcaaacaagaacaagaagtaactgttttttttttaagaagatataacaaaaatgagaatcaaacatatttattagacttacacataataaaacataataataat

SEQ ID NO: 13229 - DNA, 111 bp, Diabrotica virgifera
  misc_feature (7)..(107): n is a, c, g, or t
aaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 13230 - DNA, 1144 bp, Diabrotica virgifera
  misc_feature (795)..(795): n is a, c, g, or t
  misc_feature (823)..(841): n is a, c, g, or t
  misc_feature (847)..(883): n is a, c, g, or t
  misc_feature (901)..(956): n is a, c, g, or t
  misc_feature (1031)..(1064): n is a, c, g, or t
  misc_feature (1079)..(1118): n is a, c, g, or t
gtccttttacacagtaaagaagaactgtcctttactgtgctgtcctttactgtggtccttttatacaaattgttaaacacagtcacttaaattgaatcctaatttaaaaacataagtacaaaaatatgtaagtgtaaaagttaatggattggtgtatgtagtgtgaagtatttagtgcaaatgtgactattttgtgtcaaaaagaagggcagattgtagggtaactgtaaacattaggctaccttatttaaataatcaagtgtaattaaaaatgaatcaaaatcaaatggtagtcaaacaagaaattatcgaggaaacgtgtaaaatagaatataatgacttagatggtgcccttttagatggccttaaatgtgaaattctggaggaatctaatgggcaaagtacacatgacacttatgaatacttagatgtaaaagaatttcccatcagtacagaaagagaacatgaaaataaacttaatccatttggagaaatccaagaaacagaaaaagatatggaagttaaaacggaaattaaagaggagtttggggaatatgagcaaaaatatgaggagaaccaactatccacagcaatagaccttggagaatgtaaggatgaaccagtggatagttcagacttattcagcaaaaatgccgctggtgatatccggagatgcggaatgacggatgaggatgcataaagcggtatatattgtattctaccccgtaggcggccccctgcaaccctgtatagttagtatgcatgatttttaaaagtgtatatattgaatcatangttgtatttatgtttatttttagttagnnnnnnnnnnnnnnnnnnntgtatnnnnnnnnnnnnnnnnnnnnnnnnnnnnnnnnnnnnnctaataaaaacgtatttnnnnnnnnnnnnnnnnnnnnnnnnnnnnnnnnnnnnnnnnnnnnnnnnnnnnnnnnccgaaaattattccaaaaaggggggccggggaaattcccggcccaacggaaaagggggcgggattccggttttcnnnnnnnnnnnnnnnnnnnnnnnnnnnnnnnnnngcaccccaaaaccannnnnnnnnnnnnnnnnnnnnnnnnnnnnnnnnnnnnnnnggttatacattttaaagggggggggt

SEQ ID NO: 13231 - DNA, 382 bp, Diabrotica virgifera
  misc_feature (305)..(322): n is a, c, g, or t
attgacaccatcaaacaaaaagttaaaggtcaagaagcacgggatgcatcagccttcaacttttggatggctgggaggaccttgttctctaagtcaacaacactttgacggctgatgcatcccatgctattgacaccatcaaacaaaaagttaaaggtcaagaagcacaggctgaaagaacaaaaagagcgatgaagcagttaaatagacaaacaagagcgatcaaaaaacattgatgatgtcttagccccaaagacaaagattggtgtaatttttgaaacttactattatctataactgattcnnnnnnnnnnnnnnnnnngttaatgcattttaccacaattgtctcatattcttaaaataaacacagtttatcactaag

SEQ ID NO: 13232 - DNA, 686 bp, Diabrotica virgifera
  misc_feature (23)..(37): n is a, c, g, or t
  misc_feature (39)..(105): n is a, c, g, or t
  misc_feature (125)..(173): n is a, c, g, or t
  misc_feature (181)..(227): n is a, c, g, or t
  misc_feature (229)..(286): n is a, c, g, or t
  misc_feature (294)..(566): n is a, c, g, or t
  misc_feature (574)..(671): n is a, c, g, or t
catttattacaaagcccggttannnnnnnnnnnnnnncnnnnnnnnnnnnnnnnnnnnnnnnnnnnnnnnnnnnnnnnnnnnnnnnnnnnnnnnnnnnnnnnnnngaaagttaattaaaatgggnnnnnnnnnnnnnnnnnnnnnnnnnnnnnnnnnnnnnnnnnnnnnnnnngggatcgnnnnnnnnnnnnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnngaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctttttgaattaa

SEQ ID NO: 13233 - DNA, 845 bp, Diabrotica virgifera
  misc_feature (2)..(24): n is a, c, g, or t
  misc_feature (27)..(43): n is a, c, g, or t
  misc_feature (45)..(65): n is a, c, g, or t
  misc_feature (313)..(330): n is a, c, g, or t
  misc_feature (354)..(375): n is a, c, g, or t
  misc_feature (435)..(450): n is a, c, g, or t
  misc_feature (452)..(464): n is a, c, g, or t
  misc_feature (559)..(575): n is a, c, g, or t
  misc_feature (577)..(589): n is a, c, g, or t
  misc_feature (591)..(618): n is a, c, g, or t
  misc_feature (642)..(662): n is a, c, g, or t
  misc_feature (678)..(695): n is a, c, g, or t
  misc_feature (808)..(838): n is a, c, g, or t
annnnnnnnnnnnnnnnnnnnnnngannnnnnnnnnnnnnnnncnnnnnnnnnnnnnnnnnnnnncatatttcattcctataaaagaaaaagttatattttgcgccaagcagtgtcatgtacgatcaagtaatagattccatatatgctctgaaatgcaaccgctagagctagaaaagccctaatttgtcgataagatcattcaagtagctactcccagcaactcgtacggcaatcaaatcaaagtatgaaaacatgaatcagaaaaatatttagtgtatcatacttacaactatctgtatagtcagaaatgnnnnnnnnnnnnnnnnnnaccaataggctacgactgagcatnnnnnnnnnnnnnnnnnnnnnnctaagattcaaacataaagcaagactcatgtttctcatagctaaaaatactgaatcatgnnnnnnnnnnnnnnnncnnnnnnnnnnnnnataaactatatattacaaaagaaagccagatcacttaaatcacaggaacgatgaccacattacgattaggaaatagtataattaagcaactgtcnnnnnnnnnnnnnnnnncnnnnnnnnnnnnngnnnnnnnnnnnnnnnnnnnnnnnnnnnntttttgtataaaataccacacgcnnnnnnnnnnnnnnnnnnnnnctggctggccgcggcnnnnnnnnnnnnnnnnnncagcatatcctcaccttctctccggcacccggaaccatcgggccggatccaacaacacctcgcccctcacccgcttaccacgaacccaccctccccgccccaccctccacccnnnnnnnnnnnnnnnnnnnnnnnnnnnnnnntcccccc

SEQ ID NO: 13234 - DNA, 68 bp, Diabrotica virgifera
  misc_feature (5)..(23): n is a, c, g, or t
  misc_feature (40)..(62): n is a, c, g, or t
tccannnnnnnnnnnnnnnnnnnaaaattaccttaagggnnnnnnnnnnnnnnnnnnnnnnngaagtt

SEQ ID NO: 13235 - DNA, 443 bp, Diabrotica virgifera
  misc_feature (42)..(91): n is a, c, g, or t
  misc_feature (93)..(172): n is a, c, g, or t
  misc_feature (174)..(193): n is a, c, g, or t
  misc_feature (215)..(345): n is a, c, g, or t
  misc_feature (354)..(418): n is a, c, g, or t
aaaaaagcccccttttttttggggaaaatttttccccttccnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnaaagaaaggggaactttatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaaaacnnnnnnnnnnnnnnnnnnnnnnnnnnnnnnnnnnnnnnnnnnnnnnnnnnnnnnnnnnnnnnnnnctcacccacctcgacacagcccgcg

SEQ ID NO: 13236 - DNA, 241 bp, Diabrotica virgifera
  misc_feature (120)..(137): n is a, c, g, or t
  misc_feature (176)..(220): n is a, c, g, or t
ccttaaggataaacgcggaatttttttggaaaagtcaaatcaaaaataaaaatgggaacccccatggtggattaaaggtataaattgggggagcaacttttttattaaatttgggtccannnnnnnnnnnnnnnnnnggactttgggttttaaacccggggggggggcccggggtnnnnnnnnnnnnnnnnnnnnnnnnnnnnnnnnnnnnnnnnnnnnncccaaaaaggggcccccaaaa

SEQ ID NO: 13237 - DNA, 1143 bp, Diabrotica virgifera
  misc_feature (439)..(456): n is a, c, g, or t
  misc_feature (502)..(525): n is a, c, g, or t
  misc_feature (692)..(713): n is a, c, g, or t
  misc_feature (781)..(812): n is a, c, g, or t
  misc_feature (896)..(913): n is a, c, g, or t
  misc_feature (1030)..(1049): n is a, c, g, or t
gtatgagtatccatatctagcgagaagccatgttattatatcttatctgaaatctaaacgctggaaacactaattggcaaaatgtaaagaactataattttattgatgtttaatgtttgtgagctctgaatattaatctatttatattaaatgaaacaaaaaatatacgtactcgtagttatttgttgtttagcttccgacgggcggtttcgatctctgcatattctagagagcgaagccggtcgtcggaagttggacagtaaatgattgcgagtatatctgtttttacttcattcaaaatgaactcgcatatgcaactctttcaacatatttatattagttcttctaatgaaagtttgggaatgatgttccacgatttaggtgctgtgcatttatttactaggtaataggagtgatagtagatcgaaagcagtaaggnnnnnnnnnnnnnnnnnntgtctttaagaataattccaagtgtgttctagaatgtaattggcgnnnnnnnnnnnnnnnnnnnnnnnnatactgtacgcggtttgttgaaatttttcaagtagactgtggtaacgtatattagagcctcggaaaaggatttaataataaaacctgttgttctgaacgaataagtcactaaccgtttaatctcatctatatttttgacgaaatcgaaaatatgtagtagaactacnnnnnnnnnnnnnnnnnnnnnnaattagacggtttaatgatactcagaattgcagaacacattgtattgaattactaaaaagtaaaattnnnnnnnnnnnnnnnnnnnnnnnnnnnnnnnngaattaaattataagtacccgcagttcttcctattcctctactcgttcagggttcgtcacttaattttcagaactgggggcgannnnnnnnnnnnnnnnnntgcttttccgcaccattacctgcctcattgggcaaaaaatgccccctaaaatgtaacccagattgcgggacttgccttccttgctgcatcccgccccaccccggaacttccctggtnnnnnnnnnnnnnnnnnnnnttaaattttcttccaatcccttttaaaaaaccaatcctttgggggttgccccaaaaacccaaccctccatagaaaaaaggaacaaaatctttaa

SEQ ID NO: 13238 - DNA, 515 bp, Diabrotica virgifera
  misc_feature (3)..(513): n is a, c, g, or t
tannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncg

SEQ ID NO: 13239 - DNA, 222 bp, Diabrotica virgifera; identical to SEQ ID NO: 7599
  misc_feature (6)..(28): n is a, c, g, or t

SEQ ID NO: 13240 - DNA, 700 bp, Diabrotica virgifera
  misc_feature (308)..(327): n is a, c, g, or t
  misc_feature (568)..(629): n is a, c, g, or t
  misc_feature (653)..(670): n is a, c, g, or t
  misc_feature (672)..(684): n is a, c, g, or t
cttaacctaaaagtggtgcattttgtaaccatcgtttttgtgtattgtttaaagttttcagttgcaaagtgtagatctcataaatataacactctattttgaaaatggcaaacacaaacacagacttaacggaagaagacgcagcagacctacagtttccaaaagaatttgaaaatgcagaaactttattaatatcggaggttcacatgttattagaacatagaaaggatcaaaatgaatctgcggaggacgagcaagaattttcggatgtatttatgaaaacattaacgtatacagatcgatttagnnnnnnnnnnnnnnnnnnnnccatatcagctgtaagaaatttactaatgcagaccaaaaagcttcataaatttgagttggctgctatcgcaaacttgtgtccagaaaccacagaggaggcgaaatctctaatcctttccctggaagggcgatttgaagacgaggaacttcaggcaatcctggatgatattcaaactaaaagaagtatccagtactagagaaaaaagtcaatagtcatatttaatttcagattttttctttnnnnnnnnnnnnnnnnnnnnnnnnnnnnnnnnnnnnnnnnnnnnnnnnnnnnnnnnnnnnnntaatgttagtgtttacggtggtgnnnnnnnnnnnnnnnnnntnnnnnnnnnnnnngattaaatatatcatg

SEQ ID NO: 13241 - DNA, 259 bp, Diabrotica virgifera
  misc_feature (7)..(130): n is a, c, g, or t
  misc_feature (150)..(176): n is a, c, g, or t
  misc_feature (181)..(215): n is a, c, g, or t
  misc_feature (222)..(256): n is a, c, g, or t
aaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttttttatcggcgaatnnnnnnnnnnnnnnnnnnnnnnnnnnngaacnnnnnnnnnnnnnnnnnnnnnnnnnnnnnnnnnnnccttttnnnnnnnnnnnnnnnnnnnnnnnnnnnnnnnnnnnaaa

SEQ ID NO: 13242 - DNA, 880 bp, Diabrotica virgifera
tattgacataatcttaacagcatgttggaatggtctataaagaagataaactcaatttttgaaactgattttgcaccaaaaatctaagagaaaataggagggagaaataagaatcaaattaaacaatttatggcaaaacatgtcaaacctcaatataccgttacatttaacgatgcaaaagaatacatttttagttcagaatcaggtgaaatttcaaatagtgaaggagatctatctcaagaagaaaaaactactccaaataatttaaccaaatcatccagtgctgcaggtattggctgtgaagctggggatgtacaaagtgcttcatcaattagtaccagtatcttagacgacggcgacgaagtaaaactattgaaaaataagatcattgagttagaaaatagaaataagcttttaaatttggaagttgaaaaagttaacttatgtttaataaatgaacgaaacaaaacaaccaaactagagaagaaactacagtttgtcaaagataatcaagatgttttcataaaactaaaagaagcttatataaacatgaaatataatgaagcggctggtagaaagatggtagaaattcgagaaaaaagtgttcaaacatgggaaggtattttgtgtagaaattgtattgacgcagaacaattacgaagacagctggagagtgtccaaaagacttataaggattcttttattgttacaccactacagcttgaacaactgttaagtacgctaaaataccttaaagagttaattgacagaagagagaagacatgggatgaaatggctgaaagggatgacaagctccaagcgcatttcaacatctagcgcatgaaatagttctctacgagaaatattgcaaatcagacgt

SEQ ID NO: 13243 - DNA, 144 bp, Diabrotica virgifera
  misc_feature (7)..(44): n is a, c, g, or t
  misc_feature (64)..(77): n is a, c, g, or t
  misc_feature (80)..(97): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnaagacctgacagactttcaaaattttacatgatctgagcttaacccg

SEQ ID NO: 13244 - DNA, 338 bp, Diabrotica virgifera
aggatcagggatcatgactatataacgaccaatatagtggtaattacgatcacgcaaagtatggtttgcattatgacggcaccactggaaaatatttgcaatacacctctgagacacagacctatgagtatcatctcctaggccgcagtacctagcctcggatgcagatcgcgtagaacatgctatcccccaaaaggaacaggaaacacaaaactaaagcacagacttcgtctgatatggacgagctaccgataactttccataatacgaacataaacactctacgcaactcacgccctggatatctctaacagacggccacctcgcattgcgcatcc

SEQ ID NO: 13245 - DNA, 198 bp, Diabrotica virgifera
  misc_feature (9)..(102): n is a, c, g, or t
  misc_feature (151)..(168): n is a, c, g, or t
tgggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttagggaattacagccgtaaattttatttggaaaagttcaaattcnnnnnnnnnnnnnnnnnncaaccccccaaagggtggatttaaagtttt

SEQ ID NO: 13246 - DNA, 896 bp, Diabrotica virgifera
  misc_feature (46)..(65): n is a, c, g, or t
  misc_feature (598)..(598): n is a, c, g, or t
ctgctcagttccaattgttgctaaaaatctgttctacttatttagnnnnnnnnnnnnnnnnnnnngttaattagttgtaaattagattgtttttgcttgcaaacagtgaacttgacacttagttggtggattcgacttgataaaaattcggtttgtaaaggaaacattgtaaactgttgttttctaaattttcactaaatattttaatgtccagatgtacatatggaaagaaatttgttatgagtacactttaatttagtaaaggtgtatgtaaatcacttctttttatgtaaaaatcttatattgtaataacaactaatacttaatacaaagaaaatttctttatttttactgcttcaaagcgtgtatagcagtataacagaacaatagtaaaacgtaagtaaaacgattgcaaaatagcaatttggtattatacagtcactaaatatgaataaatctaaatatttacaatttctataaacgaaatattttcaatgtatataatacgggaaaactttatgaacaatatcaaattaaggatgatggaatacaaacttaataaatcggtgcaccttatgaaaagcttttattctccaantatatgtttttctgtgagagctttctcttagtttaatataaatgtatgtgtatataaatatacattttgagtaaatataataagataataagtaataaaacttaatctattttgcacctccaactaaatgagtaggtacttgggaatttgtaaacaagttgtaaactaaagtgaagtgaaaaaagtaccgaaataaataaaactgttttctatatcaaccttattatacacactttaaagtgtctaatacaggtcagtacttcttttttttgccttcttttatcttcatggccccatg

SEQ ID NO: 13247 - DNA, 908 bp, Diabrotica virgifera
  misc_feature (317)..(334): n is a, c, g, or t
cgatctagaggaatcatattcagctactgataatacagaggctattgaaactgctgaaaacactcagaagagtctagtagacgacattaaagaagcagcagaaattgctatgcaaaaaactgggttcgtctatgaagaaacttcaggactatattatgactataatactggatactattataatgcagaatatggtttgtattatgacggcaccactggcaaatatttgcaatataactctgagacacagacctatgagtatcattcgcaggttgcagtacctagcttggatgcagatcgagtagaaaatgctattnnnnnnnnnnnnnnnnnncataaaattaaagtaaagacttcttctgatatggacgagttattgctatctttcaataatatgaacataaatactctacgaactaacgccctggatatatctaaaagttggccaccttgcatgcgcatcatagtcgaatcaacagaaataccgggattaaagaaaggttcactgcacataattacttgcagtggaggatcactaggtcgggaaggggcgcattccattcttctgaaagaccccaacgctagtaaacaccatctcaaaataacctttgacgaaaaaggtggacagtaccaagcagtggatctggggtctaggaacggaactttgcttaacgggaaaagaatgtcgccgtccaaacaggaaagtgatgctatggatgtagtgcatggcagtaagatccaaataggccagactgttttgttgtgccatgtacatgatggtaaccagacgtgcggacattgtgaacccaggacttattccagttgcagaaccagtaccaggaagaatatacagttacaggaaatcaaataaccataaaaaaaatttgaagggtttgaaaatgcgctac

SEQ ID NO: 13248 - DNA, 138 bp, Diabrotica virgifera
gcagggattcattgattttatctgatactacaatttttggttaccttacatcttgtgagaattatataggactagggtttggtgacttttcaaggttattaatatagttctagaacacaacgctaaatcgcccaattg

SEQ ID NO: 13249 - DNA, 940 bp, Diabrotica virgifera
  misc_feature (413)..(426): n is a, c, g, or t
  misc_feature (429)..(441): n is a, c, g, or t
gatttggtcaagtgcgaaatattaaaaattcgcgacatccactgacgagtgtgtaagtgaaagtactcgagatttttttgttatttacatactttttaaacaatgccgtggattcaaccgaaattatctatttttcataagttttttttacgggttttaaaacagggccctatccctgaacatatcgctattataatggatggtaatagaagatttgccaaaaataaaaagatcgaaacaatacaggctcattcgttgggatttagtaccttgattgagtgccatgaatggttcagggaattggggatcagggaacttactgtgtatgcatttagtactgaaaatttgaaaaggactaaaaaggaggtcgacggtctgatgcagttagcggaggaaacattttctgatgtacnnnnnnnnnnnnnnggnnnnnnnnnnnnnggaattcgtttaagaataataggcgatgtaacaaagatgcccgaacatgtaagaaaagccatggatcgagcttgtgaagtgaccaaagacaacaacgaattcatctttaacgtggcctttttctatgtagctcgagacgaaattgcagcttccgttaaatcagttgtagaaggtgtccaagaaggttgttttaagtgtgaggatatctcagaagatttaatttcaaagtctttgtattctcaatttgataaaaaccccgatatgatgattaggacatctggagaagttaggttgagtgattttctgctttggcagctttctgaaaagtatttgtattttactgatgttttgtgggctgatttttccttgtggcatctgtttaccattatttttagttaatcaaaggtcttggggatttattaattttgcaaaaaataaggaaatatggcaaaaatccattggcaaatccattttaatccatattaaattccttttgatt

SEQ ID NO: 13250 - DNA, 118 bp, Diabrotica virgifera
atagattacccgcgaaaaatcattccaccttgtgcacaaaattaaaccaaattttattcattacctgtgatatataaactactttaaataactaaaatgggtgtaccaaccggagatg

SEQ ID NO: 13251 - DNA, 539 bp, Diabrotica virgifera
agagaaaataaggatattagaaggtttcccttaaggtatggtgcgtggggtgggagaggcagagaggagagagatatatattaattagaaagaaattgaagaggatgtaataattttggaaactatagaaatgtaaaatgatggaatagttttttaaaaagaaactgtaattggtgttaagatattagcaatagtttgagatagaaatatctttgaggatagccacaagatttttaattagaaatgtttattttactaatataagtcattttcagggattagctaaaaaaggagagattattaatatttgaatttcatataaaaatactgattaaaaattgttatatattgaaaaggtgattaagtatttgtttatactattatgtatatgtttaaaaaacttcaaattaaagtataaattatgattatttaattgaaaggaggaagtgtatattaatatatataacttggatatatagtataattatataggtatacttattgacaacggtattgttgcatatataaggatatgatga

SEQ ID NO: 13252 - DNA, 140 bp, Diabrotica virgifera
  misc_feature (2)..(83): n is a, c, g, or t
  misc_feature (105)..(122): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnncgggctcaggaaacataatcannnnnnnnnnnnnnnnnnaagctcgcaatgaaaggg

SEQ ID NO: 13253 - DNA, 326 bp, Diabrotica virgifera
  misc_feature (26)..(26): n is a, c, g, or t
  misc_feature (151)..(172): n is a, c, g, or t
  misc_feature (198)..(220): n is a, c, g, or t
cccctttaagcgtccgatttacttgncacaaacaggagagcaccctttaaaattgcagtaaactgatgggaaacggatacttttgtgcaatgtgaaaaaaaagcaagtagacgactgactcgtattccaacatctattaacgactgaacgnnnnnnnnnnnnnnnnnnnnnnggacgtgagcgactgaacaaaatacnnnnnnnnnnnnnnnnnnnnnnntatacccgcaacgaaacagaacaagaagtgtgcgaagcgaactctacacagacacgactagcaattccttactcaggagcgccaacctgcgcagcccactgcagat

SEQ ID NO: 13254 - DNA, 459 bp, Diabrotica virgifera
  misc_feature (27)..(27): n is a, c, g, or t
  misc_feature (32)..(32): n is a, c, g, or t
atctattaggggtccgagataattagnattgngagagaaaacccttttatgataaaagaaaagtttattttatggtgtagggagagagaggataatgaaaagagaatatggatatcttagaacggaaaaaaattgtacttggaaaagtggggaaaatcgaaagataaaaaaagagaaatagaggtacagacggagatggaaggagtgcaatgatgagagaaagaaaaaaggggggagggtgtgatagttattggataatttggagactgagaataactagaaggtgaaagaacggtctcgaatgggtgacgagtataaaaagtgattgaaaaatgaaaagaagaaggaaagtaatgtgacgaccatggttgaaaggggtaagggggaataaaggaaagaataaggagagggagatatgaaaaacggatacaaaattataaggaaaggaagttaggggtg

SEQ ID NO: 13255 - DNA, 854 bp, Diabrotica virgifera
  misc_feature (109)..(138): n is a, c, g, or t
  misc_feature (805)..(805): n is a, c, g, or t
attaactgaagctacaacatcagatatgtttggtattgttacggattccagtacacaaactgttcgtgccgtaaaaagggaacaaacgttagggactattaactttccnnnnnnnnnnnnnnnnnnnnnnnnnnnnnnatttaaactaaatcaaaataataaagtgtagtacctattcgttaagtagttatttaaaaactgaaaagactgagttagttttaatgactttagttaatgacttttccgtatgtgttaaaggtggtcctgtgatggtatcgtttcctcatttgttgtatggagataaggaataccagcaaactgttataggcatggaagcaaatacaatgaagcaccagtctttcattattttggaagagctaagtggtctgccgttatacgctgctcaaaggatccagttcaatatgtttctaagaccagtagaaggtatggaaagcctggcaaatatgagcaaagccctgatgccattaatttgggtagaagagagtctcatcattgaagacaaatacataagtcttttgcaagagagccttttcaaaaccctcagcaccgtcaacatactcaaatggttcgtgatagtaattggagtagcttgcttactgatatcagctttgaccttgatctatagacaagcaccttgatctttccaggaacatcctctgccgtttgttcattgagaagaatgatcactgagtttgtcactttggcaccttacaccatattttggtaacaaacacagaaattttgtgataataatattgtatatcatttattattttgtatctgnttaagtaccagaaaatatatggaatttaattatcaataaaatctttgat

SEQ ID NO: 13256 - DNA, 682 bp, Diabrotica virgifera
  misc_feature (37)..(37): n is a, c, g, or t
  misc_feature (311)..(338): n is a, c, g, or t
  misc_feature (435)..(465): n is a, c, g, or t
ggtgtttgtattttatattgatttaattataagattntggaacaacaaattcaagcaatttttttggaagtgtgagttggaagttgtagttagttcagacatgtcaaaatttcgtattatcaatcatatattttaattttgtagcaattttttatctggtattctagaggataaatgttctacatgaaaaatttcacaacgcaaagaataaccccaagataattttattacatgagatctgttaatgaagtttaggtaatggcaactgtttatgaattagatgtatctttatacattgagaatatatctannnnnnnnnnnnnnnnnnnnnnnnnnnntaagtattttaagggatgagcttaaaaaggagagtttattaaaatttaagctctatataaaaattatgattaaaaattgttatatattgaaatatgnnnnnnnnnnnnnnnnnnnnnnnnnnnnnnntatgtttaatcaattttttattaaaccacacatttctacttatttaattttaggcttgatgataatattaccatatcaatagtgggatatttagaataaatatatgggtgtaccaaaggacatccggcaccatttctttacacctgggtatcataggacatgtcgtttttgcattagacctaaagtcacagcagccccctggttatttttgaaaagg

SEQ ID NO: 13257 - DNA, 537 bp, Diabrotica virgifera
  misc_feature (3)..(183): n is a, c, g, or t
  misc_feature (204)..(250): n is a, c, g, or t
  misc_feature (293)..(331): n is a, c, g, or t
  misc_feature (347)..(399): n is a, c, g, or t
  misc_feature (436)..(468): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccccctccctctacccgcnnnnnnnnnnnnnnnnnnnnnnnnnnnnnnnnnnnnnnnnnnnnnnnctatttctcctctcacgttacttagcaacccaacgccgagggnnnnnnnnnnnnnnnnnnnnnnnnnnnnnnnnnnnnnnnatccccacccctcctnnnnnnnnnnnnnnnnnnnnnnnnnnnnnnnnnnnnnnnnnnnnnnnnnnnnnttatgtttacaaacaaaaaaaacaaacaaccccctannnnnnnnnnnnnnnnnnnnnnnnnnnnnnnnnagggtcgccctccccctccccctccttctcctctctcctaccaaacaaaaaaaaggacgcgggggagcg

SEQ ID NO: 13258 - DNA, 66 bp, Diabrotica virgifera
  misc_feature (2)..(14): n is a, c, g, or t
cnnnnnnnnnnnnnatctattattatttttacgtctcataactcttcgattacccccctcatcccc

SEQ ID NO: 13259 - DNA, 114 bp, Diabrotica virgifera
  misc_feature (30)..(30): n is a, c, g, or t
  misc_feature (34)..(34): n is a, c, g, or t
tcactaagagggtccgaataaaaatggganaaanaaaaagagacccttttattccatttactataaatttgaaagaattacaaaatagctgaaagcggtgggggtggcggaaga

SEQ ID NO: 13260 - DNA, 908 bp, Diabrotica virgifera
  misc_feature (551)..(640): n is a, c, g, or t
gcatatgcttgtctcaaagattaagccatgcatgtctcagtacaagccaaattaaggtgaaaccgcgaaaggctcattaaatcagttatggttccttagatcgtacccacatttacttggataactgtggtaattctagagctaatacatgcaaacagagctccaaccggagacggaaggagcgcttttattagatcaaaaccaatcggtggcgggttcgctcgtcatcgtataacttggtgactctgaataactttaagctgatcgcacggtctcgcaccggcgacgcatctttcaaatgtctgccttatcaactgtcgatggtaggttctgcgcctaccatggttgtaacgggtaacggggaatcagggttcgattccggagagggagcctgagaaacggctaccacatccaaggaaggcagcaggcgcgcaaattacccactcccggcacggggaggtagtgacgaaaaataacgatacgggactcatccgaggccccgtaatcggaatgagtacactctaaaccctttaacgaggatcaattggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcccacgtcgctggttcatcgtacgcggtgtcaactggcgtgtcgtgggacgtcctaccggtgggcttagctcgcaaaggcggtccaactcaatcccgccgcggtgctcttgactgagtgtcgaagtgggcccggtacgttttactttgaacaaatttagaagtgcttaaaggcaggccaaaacttcccctggaatactgtgtgcatggaataatggaataggaacctcgttctaattttgttggtttcggaaccccgagggaatgg

SEQ ID NO: 13261 - DNA, 135 bp, Diabrotica virgifera
  misc_feature (3)..(108): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcacgaagtatcagtgagaaagag

SEQ ID NO: 13262 - DNA, 1439 bp, Diabrotica virgifera
  misc_feature (17)..(46): n is a, c, g, or t
  misc_feature (192)..(210): n is a, c, g, or t
  misc_feature (214)..(238): n is a, c, g, or t
  misc_feature (251)..(340): n is a, c, g, or t
  misc_feature (403)..(422): n is a, c, g, or t
  misc_feature (424)..(459): n is a, c, g, or t
  misc_feature (461)..(522): n is a, c, g, or t
  misc_feature (529)..(573): n is a, c, g, or t
  misc_feature (575)..(599): n is a, c, g, or t
  misc_feature (601)..(625): n is a, c, g, or t
  misc_feature (675)..(675): n is a, c, g, or t
  misc_feature (686)..(717): n is a, c, g, or t
  misc_feature (731)..(766): n is a, c, g, or t
  misc_feature (831)..(857): n is a, c, g, or t
  misc_feature (861)..(894): n is a, c, g, or t
  misc_feature (903)..(922): n is a, c, g, or t
  misc_feature (971)..(994): n is a, c, g, or t
  misc_feature (996)..(1047): n is a, c, g, or t
  misc_feature (1054)..(1073): n is a, c, g, or t
  misc_feature (1087)..(1087): n is a, c, g, or t
  misc_feature (1100)..(1115): n is a, c, g, or t
  misc_feature (1118)..(1155): n is a, c, g, or t
  misc_feature (1162)..(1214): n is a, c, g, or t
  misc_feature (1340)..(1379): n is a, c, g, or t
ccccccccacccgcccnnnnnnnnnnnnnnnnnnnnnnnnnnnnnncacaatcatacacctactcttttaccacaactaccgaaaacttttatttcctgatagttcacttaccactgtgacacaccattcttatttttatcacccgagaactcccctccctcgcaccccccccatccgcgaaccacccccgnnnnnnnnnnnnnnnnnnnactnnnnnnnnnnnnnnnnnnnnnnnnnacccccctctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccccctcacccccccccgcctaaaccaccccacccccagcccccccccacctcccctctnnnnnnnnnnnnnnnnnnnntnnnnnnnnnnnnnnnnnnnnnnnnnnnnnnnnnnnnannnnnnnnnnnnnnnnnnnnnnnnnnnnnnnnnnnnnnnnnnnnnnnnnnnnnnnnnnnnnntccccgnnnnnnnnnnnnnnnnnnnnnnnnnnnnnnnnnnnnnnnnnnnnntnnnnnnnnnnnnnnnnnnnnnnnnngnnnnnnnnnnnnnnnnnnnnnnnnnactcccccctcccccccctccctccacccttctccctccccctccccccncccgccccccnnnnnnnnnnnnnnnnnnnnnnnnnnnnnnnntccatcctcttctnnnnnnnnnnnnnnnnnnnnnnnnnnnnnnnnnnnntctctcccccatacccacctcccttctcctactccccataccccaacactcctctcccccttctnnnnnnnnnnnnnnnnnnnnnnnnnnnccgnnnnnnnnnnnnnnnnnnnnnnnnnnnnnnnnnntccttcctnnnnnnnnnnnnnnnnnnnngcaccacccctcttccccccgccctcctctccacacccgctcccaccannnnnnnnnnnnnnnnnnnnnnnngnnnnnnnnnnnnnnnnnnnnnnnnnnnnnnnnnnnnnnnnnnnnnnnnnnnntcccccnnnnnnnnnnnnnnnnnnnnctcctccccccctnccacgcccctcannnnnnnnnnnnnnnntannnnnnnnnnnnnnnnnnnnnnnnnnnnnnnnnnnnnntcccctnnnnnnnnnnnnnnnnnnnnnnnnnnnnnnnnnnnnnnnnnnnnnnnnnnnnncccctccccctaccctcctcccctaccctcctcccacccccccctcgccaccgcacctaactgcctcgtaccctcctccccctctcgtcctcctctcctcctccccccgcccgcaccgccctccannnnnnnnnnnnnnnnnnnnnnnnnnnnnnnnnnnnnnnnatctctccccacgccctcctcaccccccccctccctcccgccctcccccccgtcgaccct

SEQ ID NO: 13263 - DNA, 125 bp, Diabrotica virgifera
  misc_feature (8)..(95): n is a, c, g, or t
ggggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttagggaaaaaaagcggaatttttttt

SEQ ID NO: 13264 - DNA, 824 bp, Diabrotica virgifera
  misc_feature (766)..(766): n is a, c, g, or t
gtgacaactgttccataacaacaaattgactacttaactatttttagtttgaggttgtgatatcttgctcactaaaaataaccatttatttttaacaaaaagtgttggtaaacctttaggaaagaaaatggaacgtccatgtaagaaattccgatttgccatcgacaggggaggtacattcacagatgtcttcgctaaatgtcctaacggaaaaatcagagtcctgaaattgctctcagaggatcctcaacattacaaggatgctccaacggaaggaatcaggcgtatattacacgaggaaactggtcatgcattggatagcgaaggcaatgtagacagttccctaatagaatggattagaatggggactactgttgccaccaatgcactcttggagagaaaaggagaaaaaatggcatttattatcaacaagggttacaaggatttacttctaattggaaatcaagctagaccaaaaatatttgatctgaacatcaggcgaccagaaatcctctattcatccgtagtagaagtagactgccgagtaataccgatgctagaaggaaaatgtaaactagagcctcaatacactagtaagtggaggattgtcgagggaaagacaggagaaaagttttatgttacaaaagaactcgataaagaagaagtaaagcaaagcttgttgaaacttaaagaaaacggtattgaaagtatatctgtagccatgttacatagttacacagtgtacgagcatgaattggaaataggnaaatagctaatgagataggttttaagcacgtttctctttcacatcagtcatctcgatg

SEQ ID NO: 13265 - DNA, 130 bp, Diabrotica virgifera
  misc_feature (106)..(124): n is a, c, g, or t
gtttctaaaacttctatcttttgtcctgctcgttaatgcctcgaatgggggattagagaaacgggatgaaattggcatgaaaggttgggtgggtgaaagattatgnnnnnnnnnnnnnnnnnnntttaaa

SEQ ID NO: 13266 - DNA, 503 bp, Diabrotica virgifera
  misc_feature (143)..(161): n is a, c, g, or t
agcgcactatgttacagtgaatgatttgaatgtgaatgattgcatgctcgtatcctataataaaagtatctacttaataactgtagtagataattgtgtcacagtaagttaactaaaagcgcaagtgaaacgaaaaggaaaannnnnnnnnnnnnnnnnnngaaaaagtggatatgttaaaagattggataaagcaacaaccacatctaccgcataaaaataatgatgttttacttacacgtttcatttactgctgcaatggaagtattgaagttgcgaaaaaactaatcgatctgttttattcaatgagacttcaaataccagaactggtttcagataaggatcctgctcatccagatatagataaaggttggcgagatatggacctcataccattacacatattgaccaaatagaagtattacctactagcgtatcgtcttaagacgaaatgatgcgcgacgaatttaatttcataacgtgctgcaacagctgttacctgt

SEQ ID NO: 13267 - DNA, 72 bp, Diabrotica virgifera
cgtataacttttttattcccaatatcaactccaattagtccacacctaccagcgaagataatatcacccatg

SEQ ID NO: 13268 - DNA, 401 bp, Diabrotica virgifera
  misc_feature (37)..(66): n is a, c, g, or t
  misc_feature (149)..(173): n is a, c, g, or t
  misc_feature (191)..(217): n is a, c, g, or t
cttaatacttcttaaacatttttattaaaacagtgcnnnnnnnnnnnnnnnnnnnnnnnnnnnnnncacacaaacacattaaaaatgccacaaatgatttctgaacattaattgtcggaaaattttttaactaaatacgtattttctgnnnnnnnnnnnnnnnnnnnnnnnnnctaacaatcataaaatgnnnnnnnnnnnnnnnnnnnnnnnnnnncacgatccggcgatgccaagcgactcaccccgcccatgctattgagatggctatagaggacaccattaaacaaagcgccgacaaagcgaccaacaacagttaccaccagcaggtatacctttctgctgaaggcggcaagatattgacgacttggaaaacaacattgaacaactcctagactcca

SEQ ID NO: 13269 - DNA, 149 bp, Diabrotica virgifera
agggcgctcttgagggcggacgcgagggacaaaaagaaaaaaaccaaacaaacgaaggaagaggaaggaagaacaacgagacccggagcaccaaaaaagaaagcaaaagagaggaagagagagaagagagaaaagaaaaaaagccagaa

SEQ ID NO: 13270 - DNA, 62 bp, Diabrotica virgifera
  misc_feature (2)..(16): n is a, c, g, or t
  misc_feature (18)..(30): n is a, c, g, or t
cnnnnnnnnnnnnnnncnnnnnnnnnnnnnctatcctcacccaccattattcttatctttta

SEQ ID NO: 13271 - DNA, 542 bp, Diabrotica virgifera
  misc_feature (314)..(341): n is a, c, g, or t
  misc_feature (423)..(461): n is a, c, g, or t
  misc_feature (463)..(476): n is a, c, g, or t
  misc_feature (513)..(536): n is a, c, g, or t
caatgaaatggtattccttttccaatatcgtccaactcttcccgcaaaaagaccaacctccgctattcccccctccccccctcgccccctacgccccctcaccgtccaccccccgctcctcttctgggcggtccctggcgcaatggtttctttacttttcccaccaccatcttcgaatcagtacctaaacgtaccacttatcataggactctcgcatctgcgttcggaacccccttcttactacgcccactcctcgcggcgcactccactcgcccaccccccggacacaccccccgtccctgacgtcggcgcgnnnnnnnnnnnnnnnnnnnnnnnnnnnngtatgacttctcacatacctcaggtctgtacttctgtctccctccccatttccatttccccttcgtcctaccatctctcgannnnnnnnnnnnnnnnnnnnnnnnnnnnnnnnnnnnnnnannnnnnnnnnnnnnaccctccctcacccccccctattcctcccccctcaannnnnnnnnnnnnnnnnnnnnnnncccccc

SEQ ID NO: 13272 - DNA, 530 bp, Diabrotica virgifera
  misc_feature (127)..(148): n is a, c, g, or t
  misc_feature (251)..(272): n is a, c, g, or t
aaatttgtcagtctgtcattcttcaatccaaagagtagcagatgacaagaataaattaaatggaatttagatgaggagattagttaaaattttgattactaaacatgcatatatgtaaattaaaaannnnnnnnnnnnnnnnnnnnnntaccagaacacatggtttgacattggggttaggttagatataaaaaacattacaaaaaatgttataagaaactaggtatggatgaaatataatgactgaaacnnnnnnnnnnnnnnnnnnnnnntgaaaaactcaccccatggggtaacagaagacgcaacagagagagaatctcctgcgaacgtaaacctaccaatggtgatagaatgtggaatactagttgcacaaatagcatcctccagaagactgggacagacgcggacttttattatgcaccacggatcactcaggatctcctactgcttgccaagcaagctccacccacacattctgctcttaacatccaccctaccggaaatcctctattcctgcccgggacaac

SEQ ID NO: 13273 - DNA, 393 bp, Diabrotica virgifera
  misc_feature (5)..(52): n is a, c, g, or t
  misc_feature (153)..(178): n is a, c, g, or t
ccccnnnnnnnnnnnnnnnnnnnnnnnnnnnnnnnnnnnnnnnnnnnnnnnnttatttgatggaaatatttattgcttcttgcgtatcaaggagtattaattaagaaataattagatataaattattagctgccgagaggagctagagtattnnnnnnnnnnnnnnnnnnnnnnnnnngttaaataatggtagtgacgagaagcgaaatgacgtgatacatatatctgaggatttactcatagacatttaacttagtgtattcacaggaagattaatattgaatgaatctctacatcacaaaactacatatttttcgggacgagcttatcaccaaaattctattactatctaattttctacgataaattccggacaaaaattgtcatataata

SEQ ID NO: 13274 - DNA, 436 bp, Diabrotica virgifera
cttccttttcgagcccaaagacaacaaacaaagggcgcaccccttcaaagaagaacaaaaaagagagaccaggagcaaggagcggagagagaaaaaccgatgcagacgagagaagaagccagcgaggaggccgcgcgcaggagggatcataaagaaacaaatatatatttagtaggtgcgggtcaagaagagataaagtacgaaaatgatcattgccgtactatgtgtttccagtaattgctctgaaatgacgtgcaacaccgcattgaaagatccctaggaatgaaacgaagtcatttaacttgatttaacagcacttgctttggagtgagatattcctgtataaggaacactacatatgtgttagggatggggtaatacagatgctctattgccacttagtatataaagagaaaataaggttataaattatcat

SEQ ID NO: 13275 - DNA, 114 bp, Diabrotica virgifera
  misc_feature (13)..(42): n is a, c, g, or t
  misc_feature (44)..(57): n is a, c, g, or t
  misc_feature (59)..(84): n is a, c, g, or t
  misc_feature (86)..(105): n is a, c, g, or t
tccataaagggannnnnnnnnnnnnnnnnnnnnnnnnnnnnncnnnnnnnnnnnnnngnnnnnnnnnnnnnnnnnnnnnnnnnngnnnnnnnnnnnnnnnnnnnntgattaaaa

SEQ ID NO: 13276 - DNA, 352 bp, Diabrotica virgifera
  misc_feature (25)..(25): n is a, c, g, or t
  misc_feature (53)..(53): n is a, c, g, or t
gagctaaagggccccgattccgctnaggatatggtttgcccttccaacgagangacaaagacggaccaggcaacagcgggacgaaacggcacgcaagggggagaaaaacgactccttgaacaaagagcaagaaggggagctaaaaaaactacagagttgcctgctgttcaaattcaagtgacaggtctcagtttggtcggagcttcaggacctgcaatggaagtattgtgtcttctgaatatggtcacacctgatgagttataataagaataaaaatatgtagatgttcttggtgatatcaaggaagattgtattaaatatgaagttttaagaaatatttagagtatgagac

SEQ ID NO: 13277 - DNA, 878 bp, Diabrotica virgifera
  misc_feature (93)..(109): n is a, c, g, or t
  misc_feature (330)..(348): n is a, c, g, or t
  misc_feature (388)..(410): n is a, c, g, or t
  misc_feature (445)..(463): n is a, c, g, or t
  misc_feature (665)..(665): n is a, c, g, or t
gtgtcggttcttgtgagagatatgtattctttgacggaaggtgcaaggtgcatagtgcataattagggaatccaacgatctgtcaaactattnnnnnnnnnnnnnnnnntggcatgcaatacattgaaggcatatgatagtatactgttattttagtattttaaagtaattttcgtattttatgtccatgtaagtattgctaaatacttctgtgacatagtaacaaatattgcttacgtcaataaactttaataagtagttaaaaagttttaactaagtaatttggaagattgaagaaagctaggttaacaaattttatgttttataagnnnnnnnnnnnnnnnnnnngagcatccctaaaatagattttaggtaaaatcatcggggnnnnnnnnnnnnnnnnnnnnnnngtacttagtaataccacattgtatcttaaatttgnnnnnnnnnnnnnnnnnnngtatccaataaaatcgcttgtgtgcagtgttgccagagaaatttttgtaaatgcaccggaatgactggaatagtgacacaaagtactaaaccaacacattttgtacaaaaacttaaaaaaacgtcgtttaatattatttgaagcaaatttcttatgtcacaaaattttaggtttttactttaggagactttagtatcaaaangtttggttgttaattgtatcaaattggtacaattttaacaactctggcaacgctgaattgcctgccatacgtcctgtcattaaaaatcacgtggtttggattgcctaattggttgcctacgtttaagacattgtttcatcagaaattatgttttttggaaagatgttttaatatcaaaacaaataaacttttacattaatcaatatgataatt

SEQ ID NO: 13278 - DNA, 623 bp, Diabrotica virgifera
  misc_feature (51)..(51): n is a, c, g, or t
ccttgtgaaaatccactaaccctacggattacaacaatattctctcaattntccaactctacaactggacccaccatgagtgatacggacaatcattatagcatcctcacgaagcaagaaaggcgagacccagtttatgtatattatttatataaaccagtaggacgtttagccatcacaccacactgaagtatttaataatatgtgcgaatactgataactgcggcactgatgcattctctcccaccgcaggagatctcaaaaagacgattcccacttgagcggtcacatcaagaatacggaagaggtgatactgactccgaaggcgaaaaaatctaatgaactaacgcccgtgaagctcctacaactgtacctactcgcggaaaacgaaaactctgctgaaaaacgtatagaatcttggggcttaaaacccgaatataatgcggatgctgctacaggacttagggtacctcctgatcacagatgcctaggattagatgccagatgcgaatatcgaatgatagcgtgcatctggcggaagtctgaaactgtataccgtagataatttaaatagcgacctggaagactttcggcctgttgaattatgcgctgcacacaggata

SEQ ID NO: 13279 - DNA, 576 bp, Diabrotica virgifera
  misc_feature (13)..(468): n is a, c, g, or t
cctcaagcgtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataacaattatttcgattgataacacaatcttctgacagatgtaaataagcgcctcgttgaaatttgttgagtcgggatattattaataagcacgtggaagatttt

SEQ ID NO: 13280 - DNA, 432 bp, Diabrotica virgifera
  misc_feature (412)..(426): n is a, c, g, or t
aatgtagttgataaggaaacgccagcctccgttgggttgtaacaagtcgtggtttagttgtaaaatcagtcacaatgtaaatattcccacaaatgtaataacagtctgcttttagaaggtgacggggccacaagttaaatgctgtatgctgtatgacctttgaattcaacatttatttccgacatttttggtgttgtacctgttcgattttgttttcatacagaatgcatatgattcgaatactgttggatgtccctactgttttttttactatttggtaaaggcagaaatggagactaagcctgtggacaagactgaaaggaaaggtcctacaaatgaacctcctcgcagttatggaatatggtggtgcattctggggagaattgtgtgacttaaaattgcccacaaaatnnnnnnnnnnnnnnnatgact

SEQ ID NO: 13281 - DNA, 186 bp, Diabrotica virgifera
  misc_feature (2)..(181): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccac

SEQ ID NO: 13282 - DNA, 331 bp, Diabrotica virgifera
gtctagttgccccttcctatgacactacaatgactgatcaagttatagcagaatttaatggaatgcaaaagagaaataactgtttccccgtacaaagactttctgttcgagctaaaaattcgagaaaaagcacggctcattaaaaccaaatgccacagtctcaaaatgatccgagatcttttacccgctgtcaacccataacgagcagaataaatctgtgcactcctaaataaggtcaaaaactattacgaagaagaagcgtaaggaccgcctttcttggtataaggaaatcattatgatgaagtcaggactcatgaaatggcgaaaccca

SEQ ID NO: 13283 - DNA, 188 bp, Diabrotica virgifera
gcgagtttcaactttgttaaaacgctgacttaactacaaagggtccttattttagagagaattttcacaaaaactaatcgtaagtataagataggtcgtccttgacgagaaagtaacacacaaattgcttcacattctgcgctattctgcggcgtaactaatttgagtctgtattcatacgaaaatgt

SEQ ID NO: 13284 - DNA, 222 bp, Diabrotica virgifera; identical to SEQ ID NO: 7599
  misc_feature (6)..(28): n is a, c, g, or t

SEQ ID NO: 13285 - DNA, 141 bp, Diabrotica virgifera
  misc_feature (3)..(111): n is a, c, g, or t
ggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttagggggataaacaggcggaaaatttt

SEQ ID NO: 13286 - DNA, 765 bp, Diabrotica virgifera
  misc_feature (2)..(565): n is a, c, g, or t
  misc_feature (572)..(609): n is a, c, g, or t
  misc_feature (629)..(642): n is a, c, g, or t
  misc_feature (645)..(667): n is a, c, g, or t
  misc_feature (675)..(697): n is a, c, g, or t
  misc_feature (727)..(755): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnngtacgaaagg

SEQ ID NO: 13287 - DNA, 884 bp, Diabrotica virgifera
  misc_feature (128)..(149): n is a, c, g, or t
  misc_feature (786)..(805): n is a, c, g, or t
ttttagtatatgtttaattaaatttttccttattaacttcacatattagtcaaaattgtaattattaactttatttaacttgaacttattaactttacttaactttaacttattaactttatttaacnnnnnnnnnnnnnnnnnnnnnncatatgaacttctggattctaatccctcagattagtttttggtttcacttgttattattactattataaaccacgagttaggaaaaggatctgtgtatccactcgtaggtttatttattcaataaggcttgtgatcccagacacggaaggtaccttacagtagctgcagtattcagaggtaggatgtcaatgaaagaagttgacgaacagatgctcaacatccagaacaagaacagcagctacttcgtcgaatggatccccaacaacgttaaaacagccgtttgtgatatcccaccaagaggtctcaagatgtctgccactttcatcggcaactcaaccgccatccaagaattgttcaaacgtatctctgaacagtttacagctatgttcaggaggaaagctttcttgcattggtacaccggagaaggtatggatgaaatggaattcacggaagcagaatccaacatgaacgacttggtatcagaataccaacagtaccaagaagccacagctgacgaagatgccgaattcgacgaagaccaggaagccgaaatcgacgagaactaaatttcatacgttaattttggaacttgaaatcaaagcctttataactttttatattttgtccccttctccnnnnnnnnnnnnnnnnnnnngaatgattttttgtacaagtcttctacatatccccgttttgtaaaatttcccaaataccctacctttaaaatcatttcc

SEQ ID NO: 13288 - DNA, 187 bp, Diabrotica virgifera
tggtaattgatcccaaaccagtaagattgtgagagaagatgttaatttagacacaaaccaaactattttctgacccatgtctgtgctcgagcatgatttacccagtctttacggattgtgttacaatttgcgatacacagaaacttgagagtataatggtacaaatacttatgttaaacaggaatgt

SEQ ID NO: 13289 - DNA, 612 bp, Diabrotica virgifera
  misc_feature (563)..(604): n is a, c, g, or t
catagccgtttcgctcactttaaatacattgttctccatatacgtgaatttttattttcataaatttgaatgacatgtcaacctagtctagtaaaacttgctgtggctgtggaaatttaacctaataaccccttgtttatttactttgaggtgtgatttttggggttgttgacgtgtatgtacctacctgtaaaataatcgatatgggcttggatcttatttatgattattttacctaccatatgtatctgacctacaaatctaattttttaatctttatattttggagatgcgagttgatgccagacttctttttctttatcactaggtattttcgtgaattggttgaacggatcattttttttatcattgttatgtaaattttgtgatctacgacgtccctcatactctatactatgatgttactgattattatacaggaacagctcgaatctgaaacaatcaatatcatgttcatattaacactgaatacaagtagaagagattagattattctcgattcattaacgggatcttgcatcccccttttttctttttcttannnnnnnnnnnnnnnnnnnnnnnnnnnnnnnnnnnnnnnnnncttgtttc

SEQ ID NO: 13290 - DNA, 269 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(131): n is a, c, g, or t
  misc_feature (161)..(188): n is a, c, g, or t
  misc_feature (201)..(257): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnagtttaaaccggtgtgagccaggttggttnnnnnnnnnnnnnnnnnnnnnnnnnnnngacaaaaggaccnnnnnnnnnnnnnnnnnnnnnnnnnnnnnnnnnnnnnnnnnnnnnnnnnnnnnnnnncgtctaaaggac

SEQ ID NO: 13291 - DNA, 256 bp, Diabrotica virgifera
  misc_feature (3)..(156): n is a, c, g, or t
  misc_feature (161)..(174): n is a, c, g, or t
  misc_feature (176)..(248): n is a, c, g, or t
gannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatannnnnnnnnnnnnngnnnnnnnnnnnnnnnnnnnnnnnnnnnnnnnnnnnnnnnnnnnnnnnnnnnnnnnnnnnnnnnnnnnnnnnnnattttttt

SEQ ID NO: 13292 - DNA, 577 bp, Diabrotica virgifera
  misc_feature (22)..(40): n is a, c, g, or t
  misc_feature (54)..(105): n is a, c, g, or t
  misc_feature (107)..(137): n is a, c, g, or t
  misc_feature (319)..(338): n is a, c, g, or t
  misc_feature (351)..(394): n is a, c, g, or t
  misc_feature (418)..(444): n is a, c, g, or t
ttataagggggccgaatttagnnnnnnnnnnnnnnnnnnnctttccggcgttannnnnnnnnnnnnnnnnnnnnnnnnnnnnnnnnnnnnnnnnnnnnnnnnnnngnnnnnnnnnnnnnnnnnnnnnnnnnnnnnnncctaatgaatagcagcgaaaatatattggagagatcaaatctaaaataaagatagtaaccacgaagttggataaaagattataatgggtgtaacaattatataattaagtctagatcgacttttataattttacatgatttgagtttaaaccaggagatgaagcaggttgaggtctatctcnnnnnnnnnnnnnnnnnnnngtacaaaaggacnnnnnnnnnnnnnnnnnnnnnnnnnnnnnnnnnnnnnnnnnnnncgacgaaaaaaaaagaagatatcnnnnnnnnnnnnnnnnnnnnnnnnnnngaaaaaaaagagcggggggacggtttaagagaaacaaagttaaagtacgggggattggaacgcaaaagttctttaaaggggccaccaaaattcaattaaagggtcggggtttaaaagcggggagaggggaaaa

SEQ ID NO: 13293 - DNA, 174 bp, Diabrotica virgifera
  misc_feature (2)..(21): n is a, c, g, or t
  misc_feature (23)..(146): n is a, c, g, or t
cnnnnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaactaaaaaataatctttaacttttt

SEQ ID NO: 13294 - DNA, 321 bp, Diabrotica virgifera
  misc_feature (38)..(56): n is a, c, g, or t
gtagaatttcagacttttgacaattccttttttgaacnnnnnnnnnnnnnnnnnnnaatcactttgcagtaaagttgaagaacgaaacgcggaatacacaactgaacaaagaagtatctcgctagaagcatgacgaggagaaagcatagaagcagtcgtaacgtcattcagacgctgaaaaccgaggccagccagaattggatttctagtacaaagacgtaaaggcgcaaattatcctaaagatggcacgagtgcgtagaacaaaatcctaatcatcggtatcccacaagacacaaccataaacacaccctcaacgacgac

SEQ ID NO: 13295 - DNA, 892 bp, Diabrotica virgifera
caaacgtgtgttcagttgtacgaaaagggcctagaagcttacttggaaaacagatgggagggttgtgtagttaattttgaaaaagcgctagaaaaatatcggaaatatcggaaaaaagtgcagaattgtcggttaaaatgtaaaagtgatgccgaatattcggaaccgctttacccagtggacatagaaaacctgctgttttttgaacgggctatcaaacaaactttgtgtattattgagtgccaaaatggtagtccagagattctggaaaaccataatgttaatatggaatccgggaatttgtttgaagaccagcggccttatgaatatttacatatttgttacttccagacaaagcaattggaaaaggcagcatcagctgctttcacgtttctggtagcacatccggataacaaggtgatgtcgaccaacttgaagcactatcttgaccacaacgttgaaaaaaaagatattgtaaactacgaagccaaagattatgtttacctatatgctcatggagctgatgcgtatgagaagaaagaatggcaatttgttgtgtttaatatggaggagagtttggtgcattatctccaagcagaagaagaatgtagagctcagtgtgagggaccattcgatcacggctggtatccagattttataccatctatatcaaatcatttcacagtagctttaagatgcaaacaaaaatgtagaaagaaattaagctcattgaacggagaaattcatgatgatttattacccagccattatcactatctgcaatatgcttattataaattgggcaatctcaaagccgcatgccaagcggtagcaagttacctgttgttctatccagatgatgagactatgttggataacatgagatattact

SEQ ID NO: 13296 - DNA, 558 bp, Diabrotica virgifera
  misc_feature (3)..(261): n is a, c, g, or t
  misc_feature (267)..(301): n is a, c, g, or t
  misc_feature (336)..(349): n is a, c, g, or t
  misc_feature (351)..(371): n is a, c, g, or t
  misc_feature (390)..(413): n is a, c, g, or t
  misc_feature (454)..(496): n is a, c, g, or t
  misc_feature (503)..(523): n is a, c, g, or t
ccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcnnnnnnnnnnnnnnnnnnnnnnnnnnnnnnnnnnncaaaattataaaacagcattaaactcatagtgagnnnnnnnnnnnnnngnnnnnnnnnnnnnnnnnnnnntggaggttaaacataaacnnnnnnnnnnnnnnnnnnnnnnnntaggaattatgattaaaagattttcatattttagaatatgnnnnnnnnnnnnnnnnnnnnnnnnnnnnnnnnnnnnnnnnnnngtctagnnnnnnnnnnnnnnnnnnnnncctttaatagactatcgcagaaaaaattaacatta

SEQ ID NO: 13297 - DNA, 779 bp, Diabrotica virgifera
  misc_feature (30)..(30): n is a, c, g, or t
  misc_feature (67)..(67): n is a, c, g, or t
  misc_feature (80)..(80): n is a, c, g, or t
  misc_feature (103)..(120): n is a, c, g, or t
  misc_feature (304)..(319): n is a, c, g, or t
  misc_feature (321)..(343): n is a, c, g, or t
  misc_feature (364)..(433): n is a, c, g, or t
  misc_feature (472)..(556): n is a, c, g, or t
  misc_feature (562)..(580): n is a, c, g, or t
  misc_feature (715)..(737): n is a, c, g, or t
  misc_feature (743)..(770): n is a, c, g, or t
gcgaagtcaacagatacaaacagacacaanatgaaacagtacatgattttagctgttctttctgtangcgctgtcctcgntcagggaaaaagcgtccaaaaannnnnnnnnnnnnnnnnnaggtctgaagaaaagtcagagaactagcagaatatttgaacaaaaaattcaaccctacccttcttcccgaatgggtcaaaagggccgaaaaacccaaaggtaaaagggccccacttgggaaaaaaaactttacaaaaatttcccaaaaaatttaaaaaagggtggttaggtggcaaaattgggnnnnnnnnnnnnnnnngnnnnnnnnnnnnnnnnnnnnnnnaaaatggggaaaacccccccnnnnnnnnnnnnnnnnnnnnnnnnnnnnnnnnnnnnnnnnnnnnnnnnnnnnnnnnnnnnnnnnnnnnnntctccggtggtgtgtaaaaaatttggggttttttgtggnnnnnnnnnnnnnnnnnnnnnnnnnnnnnnnnnnnnnnnnnnnnnnnnnnnnnnnnnnnnnnnnnnnnnnnnnnnnnnnnnnnnnggacannnnnnnnnnnnnnnnnnntccctattttctgttttcttcccgacccccggggcgggaaggggggtctctctcctcctccggagggggggggtcaacccccccccccccaaccagcccgggtgtgttttctctacccccccccgctgtgcgccnnnnnnnnnnnnnnnnnnnnnnntgctcnnnnnnnnnnnnnnnnnnnnnnnnnnnnggccccccc

SEQ ID NO: 13298 - DNA, 674 bp, Diabrotica virgifera
cttcaaaactttcctggatgtttttattttcttttatatagaagtagtttagtattaacgaaacaaattaatagatggaaatcacatcaaccatagtgccatactctgaatctacaattcatagttgactggagaattaatttcagtccgtaacacaatttttggaggaaatgcaaagtaattctaaagaaggagggaggaggtacagtttgggacccccaaatgggcaactgccttacttgcttcaaggagcccacgcagacggccctggacgacccaataactcataaaaataaagaaggtaattctgatacacataggcataaccaggggggttttgggggttataaccccccccccattgggatgaagtttgagctctatgtacttaacaccatagcccgcagagaactttcagtagttggaacccccccgttcagggagaagtaacctcccccccttaggatcgtcgtggatacgcctaggatggaagatgcattacttatctacatatagtattgttactaccaaaatgatatgacgtaggtcgaaattgttgacgtaagagaactgtcgaaacattataatgggagtttttattattgccatgtttataataaacatagaaggaaaaggtagtttttgtaataaaaatactatacctaatctttctt

SEQ ID NO: 13299 - DNA, 803 bp, Diabrotica virgifera
  misc_feature (295)..(341): n is a, c, g, or t
catgtttattgccggttctgcatcttctttgtatgactcttattagggatattactaactaaattatatagtctcgcacagatatcgtcgtctaaaggatattataccacatgggacgaataccggctttttgaaaagaagtgtggcatgtccatatattgagtgacaagaagattctgaatattaaagcgcatcgctagagactgacttgctttttaagagagacaaggttatgtgaatatgactgttgaaactccacaaagaccagaaagatatcccatcatgatgggcaaannnnnnnnnnnnnnnnnnnnnnnnnnnnnnnnnnnnnnnnnnnnnnntccctttagagagggacaataaaatctcctcgtgggcaaaactttgccaaactctactagatggataaagctataactgcatgttgattgaagtgaatatacttttgcgataccgcagaatttgaggcacctggtggctccacttaatccagaatataaatattatatagggcatactgtagaattttggaaattaccctataatacagttgacagtggaattgtgttaagtgaaggttcactcaaaagtctaagacgaaatattaacagaaatgattgtctatcattttctttttcgaatagagaagattattatctggggaaaagcttggcacaattaaatattacacctattgatataagggatgaaaatggttttacattattttttccaagtagtttaaattcgctaatattttatgaagatagtcagtaccaatcaagtatatttcctataaaatg

SEQ ID NO: 13300 - DNA, 434 bp, Diabrotica virgifera
  misc_feature (2)..(89): n is a, c, g, or t
  misc_feature (91)..(113): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnncgtgtatcacaggttattggggaagagtatatacgaatggtagagatcaaaatagaatgactgatgttttatgaatatgtaataataatgaaaatttttttacagatgagactcagatcatgtggaattgttgttgattttattgtgaaggtgtactgcataagacacatctacgagaacaggagatgagaactttcaacatgttatggacgaaagataggtacgccatagtgtaaatggaacaacttgaaaattcttggtaacccattctagtaaacgaagatgaaggataacagaacaaaaaacatagtctattcttac

SEQ ID NO: 13301 - DNA, 207 bp, Diabrotica virgifera
  misc_feature (31)..(55): n is a, c, g, or t
  misc_feature (147)..(173): n is a, c, g, or t
gtggtatattagtaatattaaacattgttgnnnnnnnnnnnnnnnnnnnnnnnnntgatttagaataaaatggttacagaggaggtacgaaacaaaattgtacatatcataaaacatccaaaagtagatgtagactatactaataannnnnnnnnnnnnnnnnnnnnnnnnnnggctattactagggaaaaccaacacatgctacaa

SEQ ID NO: 13302 - DNA, 747 bp, Diabrotica virgifera
  misc_feature (221)..(239): n is a, c, g, or t
ctctaacctaactgttttgaaatttgaaagatactgtgtttttcgtttttgtttgggtaatgttaatcaaatataatgtttttgtcggttaaaggaatagtttctagacaattactctgtaaattatgtatgagaacctataacacacaaggttctgtcagagttcgatttgctcctagtcccacaggctttcttcatttaggaggattgagaacagctcnnnnnnnnnnnnnnnnnnnaaaaaagcatcatgggaaatttattttaagaattgaagacactgaccaaactagattggttccaggagcagctgagcaactacaagaggatttaaaatgggctggaatagacatagatgagggccctttgcaaggtggaaatgttggcccatacttccaatctaaaagactagatatatataaggatcaagttcaagtacttttagaaaatggatctgcttatcgttgtttttgtacagacaagagattagaactactaagaaaggaagctctaaggaaacaagaaatccccaagtatgataacaagtgtagacatctaacaaaagaaaccttaaaaagccatttggatagcggaaaaccatattgcattaggttcaaaattagctataaagaagagagttttgctgatatgatttatggtaagataacctataatatttcactaaatgaaggtgatccagttattttgaaaatccgacgcctatcccaaccttaccattttgccaac

SEQ ID NO: 13303 - DNA, 141 bp, Diabrotica virgifera
  misc_feature (2)..(120): n is a, c, g, or t
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaagctttaaattctttta

SEQ ID NO: 13304 - DNA, 938 bp, Diabrotica virgifera
  misc_feature (33)..(45): n is a, c, g, or t
  misc_feature (47)..(62): n is a, c, g, or t
gaaagaatgaatgaagggcaaaatagcttttcnnnnnnnnnnnnngnnnnnnnnnnnnnnnncttagacaatccataaaattaaggcaactccgtaattatgacagaaacattagcagccgaagaaaaacctttaacaaacaatggacgagcagcttctagtcccgtaccaactaaaagaacatctggaggacttatgaaactatccagttatgtgctagctcttcgaccatggtctcttagtgcaagtttaattccaactctattaggatcgacaatagcttacaaatatccagggtcttcggattttaattatataactctattttttacgatattaacaattatatcagtgcatggggctggtaatgtagtgaatacatactttgactatgtaaagggcatagacaatcgaaaatcagacgatagaattcttgtagatcatatattatcgaaagatgaagttgtatcgttgggtgctatcttatattttgcaggatgtattggatttatcatattagcgaacatatctccagcaaaaatggaacatttagctttagtgtattttgggggcttatcgtcaagttttttatacaccgggggcattggttttaaatatatagctctaggagatgttttgattttaattatttttgcgcctatatcagttttatttgcatttatgtcacaaacaggtcacgtcgaatgggctacgatttattatgccttacctttagctttaaatacagagggtatattacatagtaacaacactagagactcagagcctgaataagaaaagtaggcatttgttacgctaactataattattggacattaccgcttcccctgttttgaatgcgtttttgctattaacgactaaattacgattaagggccccttccctggaatattactaagggggttatggtaacctcc

SEQ ID NO: 13305 - DNA, 559 bp, Diabrotica virgifera
  misc_feature (44)..(61): n is a, c, g, or t
  misc_feature (138)..(162): n is a, c, g, or t
aattttatagtaacgcatcaaatgcatttatatagaactatatnnnnnnnnnnnnnnnnnncgtttctcgttgttatcgaatgttgtgagtttgtgactgtaatttgatatattatggtataagtaaataaataaagnnnnnnnnnnnnnnnnnnnnnnnnngtcggacgctctaaatgagcccagcttaactaaccatgcatgactaagtcataattcatctaaagtgccaccaaaaatcagtattctagacataaattccaaatcttaggaatctctctagcaacaatatgaaaacacactcataacttcgtccaacagatatatattagaacaaactatatatgacatggtaagtaaatttcaactaacacccccttatccaactttcgatcatcctactattctaataaaatatcctcacttacatgcacccagaaaactatccctttatctacgaaccccagattggacaatacattttacctgccgtaagtataaactatactaccactgctcaaggaaagctaagcagctactagtttcgtccccctttttt

SEQ ID NO: 13306 - DNA, 464 bp, Diabrotica virgifera
acttttcattaagcccaagaactgactgtcactgtttttgagtcaccatgttggacgaaagctacgaacatcgtgagaaattatggccgactaccgtcagggtgtatcctaatacattatttgatcaagattatcttgtatgccatcaaagagaaactaatccttccctatttgtactttgctttattattatacgattgacgaatagaaaaccgtgataaaactaatgaccatatatgaataaagtgcgctgaagccatacacacataccatagtggtaatcaaatgtgacactatcacccctgatgacaaccgatcgattgtggtcacattgaagcagatagtggaagagccctaataaaagcatcacaaatctcctaccaggcacggtcttcagaaaaccattcatccgcgggaggatccctaggctgtccacagttcctgcaaccaccctatgatgatgc

SEQ ID NO: 13307 - DNA, 917 bp, Diabrotica virgifera
  misc_feature (13)..(45): n is a, c, g, or t
  misc_feature (861)..(896): n is a, c, g, or t
cccacacgtccgnnnnnnnnnnnnnnnnnnnnnnnnnnnnnnnnnctaccaacatgaattattggtcgtttttctgtgccctttttgccgttctttgttttgctgaagctgaaaactattatttcatcaaaaaatgctacaaagaagataaaaatttaaacatgtgcctgagacaatccacgaatttcttgattgctaaccttagaaggggtattcccgaactagatatttatgatccggaaccaatacttatagatcagattcaactagctttgggaacgggtccagatggttaccgagcaatttttagagacatagaagcgtttggagttagcaatcttactgtcaccgctgtaaggtcggatatagaaacaaaccaataccagtttaccatgtatataccaaagattacagccaaagcaagatacgaatccagtggagttctcatattagtacaagcttctggaggaggaaattattggggagagtatgagggtgtaaagatcaaggtatacctaaaaggatcaccaagagtgataaatgataaaacctatctcatagtgcaacaaatgaagatggatttcagtgtcaaggatattaaaatgggagttgatggtatacataatggaaatacagttctacaagccgcacttaatttatttattaactcgaattctcaagagctgttaaaggaaatgaaaccccatttgaagaaaaaattgttgattctcatgagaaattttgccgataaagtgttctcacaagaaccttacgaagccttcatagcataaagttcttaaatatagattttaaggtactggtaacaatttaagtttatctcccttacgcgcttcttacttnnnnnnnnnnnnnnnnnnnnnnnnnnnnnnnnnnnnggccgactctataaggaatcc

SEQ ID NO: 13308 - DNA, 549 bp, Diabrotica virgifera
  misc_feature (11)..(29): n is a, c, g, or t
  misc_feature (451)..(471): n is a, c, g, or t
cattaagaggnnnnnnnnnnnnnnnnnnnccttttttatgacctttaaaaagtcttgagagtgatagtaggtggatacttactagtgatagaaaagagatggagatggtaataatgttcctgctattaggaaggagatattggatgaaaaatgatgggtaggaacagaagtaaagaaaatgtgagggaacgggaagtataggattggtagtatatgtttgttttttgtttgaagaaggtgatcgaggttggaaaaagttggagggggactataattaaaaatgattagtttgattgtttggtgtctattggatagtagaaaataaagaccggagggacgggaaatgcatatggcggtgtctaaaaacccgggtaaaggggatatttttttggtaaaataagattatggtgtggttttttaaaaagaatggaaaatagaaaaatactacatnnnnnnnnnnnnnnnnnnnnnggggatttttctcttgttggggggggataaagaacaaattgctggggaaaaccaaaatgtgggtgttatcaataaaaa

SEQ ID NO: 13309 - DNA, 50 bp, Diabrotica virgifera
ctactattaataaatatgtcttatttagtccgattatttaggactaatat

SEQ ID NO: 13310 - DNA, 69 bp, Diabrotica virgifera
gtaatattttataacaactacatattacttaaatagtctttactcatgtgcctgttacttatatgaagc

SEQ ID NO: 13311 - DNA, 905 bp, Diabrotica virgifera
  misc_feature (278)..(293): n is a, c, g, or t
caaaaacaagtgaaaaaatgtctgaaggtgacgtagttaatacttcagaagaagtccaagagaatcaagaagttgtagaagaatctatcgctccagtcaagagcgtaaaaaacgtcgaggctgcaccaccaaacctattcgacatcttcaaaccaaaagatgcagcaaacgcagacaaggatggagcaaaaccagaagacaagcccgcagatggtaccaaacccgcagatgaaaccaaacctgcagacggaaccacagaggctaagcccaacatcttnnnnnnnnnnnnnnnnaaggataaagacaccacagaacacaaacctccagggtttaatcttttcgaccccctacatttgaaggacaaggcaaaggataccaaagatgataaacctccaaatctcttgggcaatatttttgacccactgcatcttaaggacaaaggaaaagatatatctgagaaagcttctgatgcagtagaaaaaggtactgatgacaaaccagcaccagtaaatcttctaggtaatcttctagatccattgcatcttaaggataaagctaaagaacaaacaagtcgccctactatgcaggatgaagccactgataagagtactgattcaactgaaaagccgcagcatattcttggtaatctactagatcctcttcatcttaaggataaacctaactcttctgaggaaaaaccaggcttaaatcttttggataatatgctggatcctctacacttaaaggacaaagctaaagatctcacagaaaaaatagcaggtgctgctgaaaattttgctgatcctttaaaattaaaagataaagacaaaacgtctaaccctggagatatattgggtaatattttagatccgctgcatctaaaggataaagccaagggaaatata

SEQ ID NO: 13312 - DNA, 1070 bp, Diabrotica virgifera
  misc_feature (807)..(897): n is a, c, g, or t
  misc_feature (1020)..(1040): n is a, c, g, or t
gcattgaaaaatttcctgaaatgtcctggttgtgagattcccttcacagaacccattttccagtgtttaaaaggccatgctctttgcaaagattgcaaagacaaggctgatggagatggttccaagtgtttcttttgtgatgctcatatagacaatacaagaaattacatagttgaagaaacaattgccaatctaaaactaaataaagattctccaagtactttccaagatgcagaagtagtgtgcccaacatcaaagtgtcatcaaaaagtcaaactatcagctatcactcatttcaaagagagtcatattgaaaatttccatttcaataaattttacttaaagaatgtatatggatactataacgtggaagtactggttaaaaatgagaaaacctatcttttattctttgatttcgatgaccaacaatttggagttagtgtatgttcaattgaagacactgacgaaacatttgacttaatgttactctcagataacaagaaatttttcatattggctgaagaccagaaaattatcaaattcaatgataaagaacattgcttcaaatgttcaagaggaacttgtaaaatttcggaccacatctataaagtaaagagaaaagaaatcttccgtcggctaactactaagttgaacagagatgccgtaaaatacaggactaatactttgaactaccagatcgtactaaaggagtacaaagaagataaaacagataagttgattaaacaattatttgaatgtcccatctgcaaagactacatgatacctccaatcccacaatgcaaagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaaaaattgcaaaagggggtttgaaaaaccttgcagcttttaatcctaaaagtttgaaattccgaaaacggagtaaaaaaggaaggccaaccccttgaaattggaatggtccttttgaatnnnnnnnnnnnnnnnnnnnnngtaaaaaaaaccctaaccccctttttgaaa

SEQ ID NO: 13313 - DNA, 576 bp, Diabrotica virgifera
  misc_feature (280)..(317): n is a, c, g, or t
aaattatcggcatatattatgcaggataaccaactacatgctaatctaagagtggatgaagctatggctgtcgcagctgcacttaaaattggcgccaaaagtccaaaagatcgagaagatatcattaacgaaatcctagacacacttggactgctggatcataagaaaacaatgacaagcgggttgtcggggggccaaaagaagagattgtcaatcgccttagaattagttagtaatcctccagttatgtttttcgatgaacctactagtggattggatnnnnnnnnnnnnnnnnnnnnnnnnnnnnnnnnnnnnnncttagctaaaggtggaagaactataatatgtactattcaccaaccttcagctagactgtttgaaatgttcgaccaactttatacactcgctgatggtcaatgtgtttaccaaggttctacgacattcttggtgccctttttggcaagtctgcagttacagtgtccttcataccacaatccagcctcctatattatagaagtagcatgtggggaatatggagatcacacgagaacgttagttaacgctatagaaaatggt

SEQ ID NO: 13314 - DNA, 490 bp, Diabrotica virgifera
acagatgcacaagtgggtgtaaatactactcattcgattaagtcgtgtatgagctcaacgacattcctcaagattgaacaacaataagatttactccgggaggaaaccaaaaccgaatagtgacatgaccgagtaaaggataacctactgttgtatgtattatgtacacacaccgatacaagaccgcagacgctgtgcgaaaaaactgaatgctcgctacaacaacctcaaaataactccccctaatctagatccgacgaaatcctcaagaggtcgtcaatgtgaagccaaattaccaaatatcaacgatactaatgaatttgcatcatgtcaccctattactactcacaaagcaacaaattttgcctgataaactttaacattgactttcaagaatattatatgatgttcagaagatattcccttgacggcatttatatgataaattatttatatggaaaaataagctcacacattaaaaattgaaaaa

SEQ ID NO: 13315 - DNA, 535 bp, Diabrotica virgifera
  misc_feature (18)..(37): n is a, c, g, or t
  misc_feature (51)..(69): n is a, c, g, or t
gctctgtaagttaaaacnnnnnnnnnnnnnnnnnnnncatattacaactgnnnnnnnnnnnnnnnnnnnagtcaaaagttaatataataaacaagtaatgaaaatattgattgaaaacacaaatctagagttaagtcactatattcttagactgtctacttagtacttattgcggggattttattaattaatatcacactcttagttttaatccaaataaaaatgtttaacgtcttgactgcgctatggaacaaattgacctcatattacattaacagttggctgagtcaactgtgtactaacacacagcagcaaatggggtatacaggacatattatatgccttgtaacaaactcaatgtaaatttataaatatctctaaatgcagcaaaggagttcaaaagagcttcctaatatcttgcgtgatagtagcaagagatacttaataggctcttatattttagcacaagaattataaaagtgcatgaagggataaaaaaaagcttaaaattctaaaaccataaactattatacca

SEQ ID NO: 13316 - DNA, 430 bp, Diabrotica virgifera
agaactagtcaaaaaagtccagtatgtggaaatggttggttttgatgtagacgcgggtgtcgtctatcctccttcaactaagtttgatatcagagcagagacagtcgaaaggctgaagaacattatgctttttccgtgaggaaagcaagaccaaatgcttatatgacctgataaaggatcaccaacaatgtgtatctgctatatcatgatagcttcaagagctcatgggctgtgcccagcatcatgatgcaagtaacaacgacctccatattgatttattttatatcattctcaacaatgcattaaaaattaaagagggtgaagacacattaccggataacgaagatgaatttgaactagcctcctcgtgacacgaagaaaaattaacaacgaacaagatgtgcttgaaggacgttaacattgaattcct

SEQ ID NO: 13317 - DNA, 694 bp, Diabrotica virgifera
  misc_feature (554)..(571): n is a, c, g, or t
  misc_feature (657)..(676): n is a, c, g, or t
tgattattaaatgggtgaataaattagtatggagcttcaaatatgctagtggaaatataatttgtaccaaattatcttagcaatgttagaaagttactatgtctggattcaaccgtgcacagaatagcttttggacgtaccttccctaaaactggtcagtttgtttctgttcattacactggtaccttggaggatggacaaaaattcgattcctctcgagacagaggagctccttttaagttccacattggaagaggagaagtaatcaaaggttgggacgaaggagttgctcagttaagtcttggacagagggccaaacttacctgcaccgctgattatgcatacggatccaggggccatccaggaatcattcctcccaacgcaacactcatctttgatgtagaacttattgcaatagagtaaacttaagattgccttagagaatgttagatgatgactacatatttctaagagtaagatttggttttatttagaactgaattttacacggtttgtgaattttatattaaagttattagaagtgtagaaagagnnnnnnnnnnnnnnnnnnatatcgttgttttcataagcttgacatcaaaattgacaataaaaagcaccaacccgacaaagaaattgttgtaatgtaaattcccnnnnnnnnnnnnnnnnnnnntagtcattaacaggttaa

SEQ ID NO: 13318 - DNA, 449 bp, Diabrotica virgifera
  misc_feature (18)..(31): n is a, c, g, or t
  misc_feature (33)..(58): n is a, c, g, or t
  misc_feature (131)..(179): n is a, c, g, or t
  misc_feature (197)..(257): n is a, c, g, or t
  misc_feature (259)..(271): n is a, c, g, or t
gatgagatgtgatactcnnnnnnnnnnnnnncnnnnnnnnnnnnnnnnnnnnnnnnnncatatataaacggatatatgtataaatacatatttcctaaataataaatatgaaatactttttaggggtgagnnnnnnnnnnnnnnnnnnnnnnnnnnnnnnnnnnnnnnnnnnnnnnnnnataaaaattgacgtatannnnnnnnnnnnnnnnnnnnnnnnnnnnnnnnnnnnnnnnnnnnnnnnnnnnnnnnnnnnngnnnnnnnnnnnnncaatgatttagatttagtaatgatgatactattcgcattcaaaacttgtatatttaacacacccatttacgctccatccaggaattcgggcacacttcttctcacctgtatattaacaacatgtcttttcggataaaaaaaaagtctccgcccgcacacagaattattcgaatggccg

SEQ ID NO: 13319 - DNA, 687 bp, Diabrotica virgifera
  misc_feature (541)..(561): n is a, c, g, or t
gggcgacacacccgtccccctttatggaaaaagaacgagtacatacctcaaaagagaagtgcccttatgtagaagtaagattaaatattacctgttagtttaagatgtgtatggggacaaagatgttccgtcaagattgtagtacgttaagcttcgatgctgtgaaaagcatcaacgaatggcgacaagtcctactaaaggaaaaaaaagagatgaatatattatattctattatggcttcgagattgaagagggctgtgtgaagaaataggatgcatgcaataacaaacctaatgagaaatccctcgaaaaataatccgacgaaatccacaagaagtagtaatggtgacgccaaatcgcggattttcatagatagtaatgattttgcatctatggaacgtataaaaaatcacaaataacaagttgtgtttgatagactttaacattgccttttaagaattttatatgatgctcaaaagctatttgcttagaggatttttatgattaattatttatatgggaaagaagccacaattaatannnnnnnnnnnnnnnnnnnnncgattccgacgccaaaatccggtggccggtgtcaaaatacaaaaatattactataatatactatatttgctgttgctaaggaaaaaaaattcttctactaacttaacctaaatctccctcacttta

SEQ ID NO: 13320 - DNA, 257 bp, Diabrotica virgifera
  misc_feature (4)..(49): n is a, c, g, or t
  misc_feature (51)..(77): n is a, c, g, or t
cccnnnnnnnnnnnnnnnnnnnnnnnnnnnnnnnnnnnnnnnnnnnnnncnnnnnnnnnnnnnnnnnnnnnnnnnnnccagaaacatttattttgctgtacgccgagccacagccgctatgtcgccagcacggcaaaccagcacagatatcttctcttcttctcactggttcccttcgttcccgacccccgaccccagcaacacgccgcaagcagcccacaaccccccgagcacccccctccccgccccttcccccc

SEQ ID NO: 13321 - DNA, 488 bp, Diabrotica virgifera
  misc_feature (21)..(37): n is a, c, g, or t
  misc_feature (39)..(166): n is a, c, g, or t
  misc_feature (184)..(281): n is a, c, g, or t
  misc_feature (284)..(306): n is a, c, g, or t
  misc_feature (364)..(400): n is a, c, g, or t
catttattacaaagccctgtnnnnnnnnnnnnnnnnncnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccttgggaatccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngannnnnnnnnnnnnnnnnnnnnnnttataccaaattttttaggaataaaaaataatcttttttatcacaagtaattttatannnnnnnnnnnnnnnnnnnnnnnnnnnnnnnnnnnnnggggatgggttaaaattaaaccattcatatcaaccaacgtcgacaatacaactatgcgataaaatgttttcttagtttaacaaaggcg

SEQ ID NO: 13322 - DNA, 375 bp, Diabrotica virgifera
  misc_feature (70)..(89): n is a, c, g, or t
  misc_feature (142)..(159): n is a, c, g, or t
  misc_feature (169)..(188): n is a, c, g, or t
gaagtattctgaaactttctgtacataaaattaatcttattaaagtaaatgcattaaaaaaaattagtcnnnnnnnnnnnnnnnnnnnngattttctataaatttcatttattataatagttatagtagaaaaagtaattcnnnnnnnnnnnnnnnnnngaagtaaagnnnnnnnnnnnnnnnnnnnncttacagcataaaaattatttccaactaaattattaattactaatcatttaggaaaacttcctaacacccttagtaaacgcgctacaggatcagatacttgctataaattctgacttatgtatattatgagcagttcacgctacaaactttcgttcattccaaaagaattgtgcagagttcatcaaa

SEQ ID NO: 13323 - DNA, 1081 bp, Diabrotica virgifera
  misc_feature (990)..(1025): n is a, c, g, or t
  misc_feature (1031)..(1058): n is a, c, g, or t
gcgatccagtcgtaattaaggattcagattctgattctgacgtggttgtcgtcaatcctccttcacctaagcctgatatcaaagttgaaccagtcaatagtctgaagaacattatcaattttcccgagcagagcaagactaaatggttagatgacgtgataaatgatcaccaacaacgtgcagctgccagacaacgagagcttcaagagctcatgggctgttcccaacaacatgaaaaaattaataaagatctccatattgagttactttctaacaaaatcaacaatgcattaaaaattaaagaggctttagtcccattaccggaaaaggaagctgaagttgaactacctcctttgaccgatgaacaactaagaatggtcagcagggccttcaagggcgatcccaatgaagtcctcagtcgaaagtttaacctgaacataacgcggcgagacctgttaacattatcaggtttaaattggctcaacgacgaagtcataaatttttatatgaatatgattatagaacgaggaaaagatccaagttatccatcatgccatgcattcaataccttcttttatactaaattactcaaagatggcgcagaatctcttagaaggtggaccaaaaaaattgatatttttgcttgcgatataatatgcataccgatacatttgagcatgcactggtgtatggcgattgtcgatatgagagcccaaactatcaagtactacgatagtatgggaaacagcaacgacagggtgtttaaacgcgattaaaaagtacctggaaaaagaacatttagataaaaaagaaatctgaactggaatacgtcagaattcgaatttaaaaatggttacagacattcccccaaaaaatggaagggaagcggattgggggaatgttccccctggcacttttggttgaaatttactaacaaaaaaacgctttcgattaaacggttttgccaaaaaacaatattgccctaatttnnnnnnnnnnnnnnnnnnnnnnnnnnnnnnnnnnnngggccnnnnnnnnnnnnnnnnnnnnnnnnnnnntttatcttttttttttggagggg

SEQ ID NO: 13324 - DNA, 106 bp, Diabrotica virgifera
  misc_feature (2)..(20): n is a, c, g, or t
cnnnnnnnnnnnnnnnnnnnatggcttcacaaaaaatgatcgttcgctctcctagtagcaatcgcagtctcaggctgtttgggaggcccttcagttcctagaagaa

SEQ ID NO: 13325 - DNA, 493 bp, Diabrotica virgifera
attatcaagaggtcaagtgtttagaagcatgtataaatacagctttgttgaagagatcaagtaaactgaaaatagctgtgatagtgaccagtaccaaaactgcattacgatgaagtggatagtgttaaccgttgatggacttcttgacccggtcgtagactacccagcttgcaaccagcgctcaatgctttgatgatcatccttcctaacaagaagatcgtcgctaccatccatgggcgccatcccggtctcatcactgccaccctgctcaacacaagtaacatacaattacacaaaaggccatcgcacaggtacacaactggaccatcgagctcctcacaccttaccaccccactctcactgaacataccgcttatcggacaatgcagagctcagacaattaccacagtgctaaagtgctccggtatgactatacaacccattgttccttgatagaaatacctgatggcagcctattaacccatgctcccac

SEQ ID NO: 13326 - DNA, 655 bp, Diabrotica virgifera
  misc_feature (54)..(83): n is a, c, g, or t
  misc_feature (91)..(126): n is a, c, g, or t
  misc_feature (221)..(244): n is a, c, g, or t
  misc_feature (281)..(302): n is a, c, g, or t
  misc_feature (360)..(380): n is a, c, g, or t
  misc_feature (387)..(412): n is a, c, g, or t
  misc_feature (447)..(473): n is a, c, g, or t
  misc_feature (495)..(516): n is a, c, g, or t
  misc_feature (536)..(558): n is a, c, g, or t
  misc_feature (570)..(608): n is a, c, g, or t
ctctaaggagttagaaaaagagtcagcgaaagcggagaaacactttttaaaagnnnnnnnnnnnnnnnnnnnnnnnnnnnnnnatattggnnnnnnnnnnnnnnnnnnnnnnnnnnnnnnnnnnnnaagggatgatgaatatagaaatatagatatgatagaatgattgagtttaaaagaggtaaaaaaataaaatgatgatggtagaataaatattttgnnnnnnnnnnnnnnnnnnnnnnnngatccgatgttaaatatatgctaattttgtaagaaannnnnnnnnnnnnnnnnnnnnngaatatatggataataaaatattgatatatgatgaatataagatatttgaagggatgnnnnnnnnnnnnnnnnnnnnngaaaagnnnnnnnnnnnnnnnnnnnnnnnnnnggaaatacgcatattttaaaatatagcatcaatgnnnnnnnnnnnnnnnnnnnnnnnnnnngttaagaagttttaattattgnnnnnnnnnnnnnnnnnnnnnngtagaaacgatgaaaatagnnnnnnnnnnnnnnnnnnnnnnngagaggtaattnnnnnnnnnnnnnnnnnnnnnnnnnnnnnnnnnnnnnnnctgtttcttatagtaatgtctttttgatatgaaaaaaaagtctgatc

SEQ ID NO: 13327 - DNA, 351 bp, Diabrotica virgifera
cccccttttagtgtacgttattactgatgcaatatgagaaccccccctttaaataatgattatacattgtgagaccgagattgacgaaataataatagagagaaacctgcaagtgaatgtggagtgtccaccactgtacagatatcagatcaagaagagagtgatatagaacaggaaaaacgagaagcaaatcaccaagaacatgaaatcctatatctttatcatttgctgaaacaaatgacgacatcacacacacaggagggcctgcactgatgtacccacaataaaaagaattacgcataaacagattcacggtagaaattgagcccttgccgctcccaaacccgcatg

SEQ ID NO: 13328 - DNA, 528 bp, Diabrotica virgifera
  misc_feature (77)..(110): n is a, c, g, or t
  misc_feature (225)..(242): n is a, c, g, or t
  misc_feature (264)..(291): n is a, c, g, or t
  misc_feature (300)..(320): n is a, c, g, or t
  misc_feature (386)..(406): n is a, c, g, or t
  misc_feature (421)..(436): n is a, c, g, or t
  misc_feature (439)..(460): n is a, c, g, or t
ccctttttgagtacggacgaattggccaagaaagggaagaacccttttatttaatgatagtaattaccatcgcgacnnnnnnnnnnnnnnnnnnnnnnnnnnnnnnnnnnctttgaaccttgtgaattggggatcattaatgagtaattatatatgtattatcatcgaatttaaaagagctacagaaataaaatgaagattgtagaataaaaatttgtaaatagnnnnnnnnnnnnnnnnnncgattcgatgttaaatataggnnnnnnnnnnnnnnnnnnnnnnnnnnnngtgattaannnnnnnnnnnnnnnnnnnnncttgatatatcatagagtattaaatatttgtagggatgagattagaaataaaatagtatgaaaagnnnnnnnnnnnnnnnnnnnnnggattggaaagatgnnnnnnnnnnnnnnnnccnnnnnnnnnnnnnnnnnnnnnntcgtttatatttgtaacggagtcactattaaagtataaattcagattatttatgagtagcaatgacga

SEQ ID NO: 13329 - DNA, 638 bp, Diabrotica virgifera
  misc_feature (2)..(613): n is a, c, g, or t
  misc_feature (615)..(637): n is a, c, g, or t
cnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnna

SEQ ID NO: 13330 - DNA, 608 bp, Diabrotica virgifera
  misc_feature (482)..(499): n is a, c, g, or t
cggtagatctgaagaatctactaaacattttttgttgctaaatacattttacaaactaaataaaatgtctggacgtggaaaaggaggaaagaataaagcagataaatataaatcccgttcaaatcgtgcaggactccaatttcctgtaggaagaatacatagattcttacgtagaggaaactatgctcatcgtattgggtcaggagctccagtgtatctttcagccgtattggaatatctagcagccgaagtgttggagttagcaggtaatgccgctagagacaataagaaaaccagaattataccaaggcatcttcagctagccataagaaatgacgaggagttgaataaacttctctctggtgttacaatagcccagggtggtgtattgccaaatatacaagctgttctactgcccaagaagtctggaactggaactgcagcttcgggaggaaagtcaacaaagagccaatctcaggatnnnnnnnnnnnnnnnnnntaagaatgttttttacctaattgtaagctctagaagtctgatgtatttgtttgtaataatatttggtagtcacttgtacaatattcgattcatgaatgtttgtttagtc

SEQ ID NO: 13331 - DNA, 730 bp, Diabrotica virgifera
  misc_feature (706)..(706): n is a, c, g, or t
tacatattagcataatataatatgtatggattaccgtgaaaggccaatgatttttttaattactttttgggtgtgaatctgtctttttagtttactcctcttggtttaaaaacaaaccgtagaaaagtcaccagattcatattctttttggttgatcataccggccttcgacataatattccaataattggtagaggacaatttcacagataaaaaactgattttccttgaaatcaatggcacttaattgaatcacaggggcgtaacagaggcccccgcagcgtgaagcttgaggggggccccaatatgtcagcggccccatcttgtcgtctaatataatgtaaaaatgtgttattgttacattattttacgcatacatacgcaacgttttttaagcaatgcagttttgaaaatgaagttgcccatcaaatagatacaaagtattcgctctgagcgttaacaaagtgtcaaagcaaaatcgaccgacctgctcatggtggtggttttttgaaattttatcagggcgcttaagtagcacacaaatttgtgtatgtttaaatgagacatttaaaaaaaatgtcgtgtcccgctagtgatattatgtattaatataaacagaaaataaaaacgcactctgatataaattcttctatttccaatattgattatcagtttgattttgtatacataacctcactatcgcagnttatgtcaataatctttattaacg

SEQ ID NO: 13332 - DNA, 514 bp, Diabrotica virgifera
  misc_feature (486)..(502): n is a, c, g, or t
accgaattttaagctttgcctaacgaaattcaccatcggaagtgcaaaacacaaatagtgacggtgtaaacagttcttaaaaggtctggcttcgaacgaccggtcggtgcttgcacgcgaccttggattccatcttttaagcgactccagtatagctggtcctcttaatgagactcaacaaccttgatagtggccttttcatgtagcctggtgcttccggttttcctccccgagttctagaaaccgcactcgtgcgagaccttcgcaacgacacagaacgtgtagagcggtttcctcttcttccagtcagaaccgacaggtgtcctcttctgtcaggcctatgagactcaagtgtctttgagtctacagtgtccagtcagcagacccactatcattctgacagtgctgcgagtgctcgaaagtaagtctgctgtaaatttagccgaatgtcctttgatgaactgtgtggcctgtctctgtcctggnnnnnnnnnnnnnnnnntcaagagacttc

SEQ ID NO: 13333 - DNA, 192 bp, Diabrotica virgifera
  misc_feature (2)..(30): n is a, c, g, or t
cnnnnnnnnnnnnnnnnnnnnnnnnnnnnngagatgtgttacactcttagatatatctaacaatatgccaatacataactaaccatgtatttcttgatacgcttttgataataaagatactcattagcaatattcgaataactcgattatccacaagctgccttacaaccacccattaatccataatttttc

SEQ ID NO: 13334 - DNA, 91 bp, Diabrotica virgifera
  misc_feature (13)..(13): n is a, c, g, or t
  misc_feature (19)..(79): n is a, c, g, or t
aattattttattngggggnnnnnnnnnnnnnnnnnnnnnnnnnnnnnnnnnnnnnnnnnnnnnnnnnnnnnnnnnnnnntcccaatttttt

SEQ ID NO: 13335 - DNA, 919 bp, Diabrotica virgifera
  misc_feature (803)..(803): n is a, c, g, or t
  misc_feature (848)..(848): n is a, c, g, or t
  misc_feature (897)..(897): n is a, c, g, or t
cttagcaacagcgcagttaaaagacatcactgtcgagatattcaaagacaacaagtcagtgactttaatgaaaacagtaacgtttctacacgaaccttatataacagatatctttatagaaaagcaagatgtgccagtgttgaagacgggaatatttgatggcttgtttctgcttcataccataaacataagaaatacgaacttagtgacattagaaccgaatatatttaaaggactgagacggatcagaaaaatcagtttgaatttcaacaagatctattccgtccctcagaatgtttttacaaatatacctgtgtatatagtagctcttagaggtaatgggataacacatattagcgaaaatgcgttctataaccttcaaaatctgagaaatttggacttgagtagtaataatatcgaactattgcccaagaatctttttgttaacaccaagaacctcaaatacatcgatctgagctacaataagctaagacacttccctgcagttccttacaaaccgtatcctttctttgatgtagctttcgccaacatggtacctggagagccatccttccttgatttaagttacaataacttctccttcatcagctactacctccttagaggcatccactatatcgatgagttgcgtctgcacaacaaccacatcaaactgatcagtgagtacgcttttgatgatttcacgaagattaatactttgaatctggatagtaacgatctgaacgagatgagtgaagggttactgaatattcttacgtacgtagacaatgtgagggtcgaanataacccgtggagtgatgcattcgtgtgcaaatatacggactggntgtcagaacatgaaaaatctaactatatgggagaggaagtgtcctttanaacagtaattataatattttta

SEQ ID NO: 13336 - DNA, 112 bp, Diabrotica virgifera
  misc_feature (7)..(7): n is a, c, g, or t
  misc_feature (11)..(11): n is a, c, g, or t
  misc_feature (17)..(108): n is a, c, g, or t
agcttanattntttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggg

SEQ ID NO: 13337 - DNA, 67 bp, Diabrotica virgifera
  misc_feature (2)..(66): n is a, c, g, or t
gnnnnnnnnnnnnnnnnnnnnnnnnnnnnnnnnnnnnnnnnnnnnnnnnnnnnnnnnnnnnnnnnng

SEQ ID NO: 13338 - DNA, 276 bp, Diabrotica virgifera
cccacgcgtccgcacaagctcacttcacccctcataacactagtgtatcagtaaactcctttcctttcatgaagtctgctcctattcataaatggggcatacatttttcaggtaaacctaatgaaaacgttgttagttttttggaaaaggtagagtgtctgcgtatagcacgtgggaacagcgagggtgagtgttactccgcagctggtgacttgtttagggattcagcctttacgtggtacctcaataatcgaggtagttttgcttcatggccag

SEQ ID NO: 13339 - DNA, 951 bp, Diabrotica virgifera
  misc_feature (248)..(268): n is a, c, g, or t
  misc_feature (675)..(692): n is a, c, g, or t
  misc_feature (884)..(884): n is a, c, g, or t
cggacgcgtgggcttgtgtgttggttaagtgctaaatatttgcaaatacattaacagatcacgcatttaattcagtggtttactactatttttcgttattagcttttcgtctgttctgggaaaagctcgacaaagtaaaatgaacaattttaaagtgttagttaccaatcctacagtgccagattctggaataactctactaaacgacaatggatgcaacgtcacacagctgcaaaccgaaagtagannnnnnnnnnnnnnnnnnnnncgaggaatggatgctctattttgggcatctggtattaaactggattcagaagtattagacgcagcaggaccacaattaaagacaattggacttatgtcagctggttataatcatgtggacgtagaagaacttaggaaacgaggaatccgtatgggaaacacaccaaaagtacttaacgatgcagtagccgatattgctatactcttaactttggcagcatctagacgtcttcatgaagctagattaagtatagaaaacggtaactgggtcacaaatgattgggcatggatgtgtggtcaagatataactaattcgacagttggcatcattggacttggtcacataggacaaactattgcaagaaggctaaagggttttgatattcaacagttgttgtatacaggccnnnnnnnnnnnnnnnnnngaatcgaattaggagctaaatttgtatcactgaatacacttttagaagacagtgacttcgttataatggtagtacctttaacgacagaaacacaccatatgtgcaatgaagaatttttttcaaaaatgaagaagaccgcagtattcattaatggtagtagaggtgaagtagttgaccaaccagcattaatanatgcacttaagagacgcactatttttgctgctggcctagatgttatgactcctgaaccactaccatc

SEQ ID NO: 13340 - DNA, 829 bp, Diabrotica virgifera
gtctaaacagactggttgcaataataatttagaattgttagtataccgtgaaattcatttgaataatttgataagatggatttcagtcattgcttccttgttttcattagtctcatagtttgtacgaactgtattatgtggaatttaaagccaaatagtcgaaaatgtttacgggaggaactccaacaaaatatacctgtagtcggggaatttgatgtctcagaagcccctggacaaacagtcaattacgttgtaacagattcgaagggtcatatattggcgaaaagagaagcaatttccaaaggcaaattttcttttaacacggagagttttgatacctacgaaatctgcttcatatcacaagttgctccacatatagctggtgtaactcaagaagtttccttaattaccaaacatggtatagaaacgaaaaattatgacacttatggcgaagctgcccaacttaaaccaattgagaaagaattgaaaagattggaagatctatctgatgccattgtccaagatttcgccattatgagaaaacgggaagaagaaatgagagatacaaacgaatctacaaacagtcgtgtactatacttctcgatattttctttgtgctgtctgatgggattggccacatggcaagttctgtacttaaggacttacttcaaggcgaagaagctcatcgaataacgagaaggaagtggtatctactacctagatttatttttgtaaaaagaactgtcacaattactgtaaaaacattgcgaagattttgtgttatttatttgtacatcttggtctgttttgtactaaataagttgttaat

SEQ ID NO: 13341 - DNA, 210 bp, Diabrotica virgifera
  misc_feature (8)..(35): n is a, c, g, or t
  misc_feature (44)..(80): n is a, c, g, or t
  misc_feature (82)..(104): n is a, c, g, or t
  misc_feature (114)..(114): n is a, c, g, or t
  misc_feature (133)..(154): n is a, c, g, or t
  misc_feature (165)..(165): n is a, c, g, or t
  misc_feature (167)..(209): n is a, c, g, or t
ataatcannnnnnnnnnnnnnnnnnnnnnnnnnnngaagggggnnnnnnnnnnnnnnnnnnnnnnnnnnnnnnnnnnnnngnnnnnnnnnnnnnnnnnnnnnnngctttaattntttttaaagacgagagacnnnnnnnnnnnnnnnnnnnnnntattaataagngnnnnnnnnnnnnnnnnnnnnnnnnnnnnnnnnnnnnnnnnnnng

SEQ ID NO: 13342 - DNA, 568 bp, Diabrotica virgifera
  misc_feature (5)..(94): n is a, c, g, or t
  misc_feature (106)..(156): n is a, c, g, or t
  misc_feature (158)..(223): n is a, c, g, or t
  misc_feature (225)..(334): n is a, c, g, or t
  misc_feature (336)..(561): n is a, c, g, or t
  misc_feature (565)..(565): n is a, c, g, or t
ttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngattgtgtatgnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggnaat

SEQ ID NO: 13343 - DNA, 683 bp, Diabrotica virgifera
  misc_feature (95)..(129): n is a, c, g, or t
attaatagtaaacagacataaataacataaaccttacgccaatcaataattagatatttatttacaccactataatgtattgataacaaatgagnnnnnnnnnnnnnnnnnnnnnnnnnnnnnnnnnnnagaaataatttccacaaaatttttgagtttagtatacactcacactatttccaaaaattctttctttttttaatgaaagattcagttaatttgagcagttaatagtgtgaggtaggaatttttgtgttgtatgtttcgtattactaatgtgtcaaaatgaatctcggctaagcgaattcagtatacctactaaagttatacagggtgagtggagaggaacgcgccaagctttgagtctgtatagtatacgtaataatgattaaaaataactcatatgttattcgattttcattttgtttccgagatacggggtaagtttttttacaaactaaggatttttttattaaactaaaagggaagttccctaggttggctgtataccatatagttaaaaaactctaacaagaggtggaaccacttctatgtggattggtatatttgttgaaacttgaaaggtcccaatggattgaatgaaatgtgtccggatctgagcgtattcactgattgatggactgatgggagagctaaagttctgagatggacatgtattatta

SEQ ID NO: 13344 - DNA, 680 bp, Diabrotica virgifera
  misc_feature (2)..(552): n is a, c, g, or t
  misc_feature (560)..(651): n is a, c, g, or t
  misc_feature (655)..(678): n is a, c, g, or t
tnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngacnnnnnnnnnnnnnnnnnnnnnnnnta

SEQ ID NO: 13345 - DNA, 516 bp, Diabrotica virgifera
ttttatagtttatcatgtatacaaatgaatgaaatattattgctaacatcaaacatatcatatttcttacagttaagtacatatttccataagtagtaaaataatacgttaagtaaatatttcaacacacaattagttgacagcgcttcataaaaaaaacgaaaccatcttacttatttacaataagtttgatttagttggacagatttgcaatatttaggtaataatatacaattgctggagggaatgtgtctttggggcatggtgtgtgactcgatttgagagacaagggacacaatatgacgaacaagtgcgccgtaatgcccttaacatgtgtgggactaggaaagttacccaaaaaaacacccataatgatgctaataagattagaactagtcacatgataatggataatataaggaactcctacacaataatattgctagaataccatcgtttgcctgaatagtcgtgtaataaatcagtgtatgtattactgaaaattacattagtatt

SEQ ID NO: 13346 - DNA, 602 bp, Diabrotica virgifera
  misc_feature (45)..(62): n is a, c, g, or t
cctttacgcgtccgccttttcatcttctggaatcggcttaccttnnnnnnnnnnnnnnnnnngtgctcctagtgggtcttatggaactcatctattttctgttccggaataatatccaaagaaagataaaattggagatgatatatttcgattccagaatttatcagggaacctttcgtcgacaataggaaaggacaacaggtgataagctagatgatatgaagcgtggaaacacggagaatatagtgtcgttgatgggactaaagaatatgttaaggcatcgtggagactcgtcgaggttgtattcaaatttaccattaaagagaagatgcggggcacatgtgcgtctatagaaatgttaagaagagtgtataatgttgatcgtaggagcgcagcagcaaaaatgaatgtatgtgaaaatgatatttagagtttagtgttgaggattaggaataggagcagttattgatggtactagaggaaaattcataaatatgaataaattaattgttatataaacatattcttgaataactgtgtttataaaagagaagaatgtaatgatgaagaaaatattattgtttacaatatttatgtttaat

SEQ ID NO: 13347 - DNA, 885 bp, Diabrotica virgifera
  misc_feature (2)..(52): n is a, c, g, or t
  misc_feature (60)..(72): n is a, c, g, or t
  misc_feature (74)..(106): n is a, c, g, or t
  misc_feature (108)..(121): n is a, c, g, or t
  misc_feature (371)..(399): n is a, c, g, or t
  misc_feature (581)..(608): n is a, c, g, or t
  misc_feature (637)..(667): n is a, c, g, or t
  misc_feature (669)..(691): n is a, c, g, or t
  misc_feature (693)..(715): n is a, c, g, or t
  misc_feature (747)..(768): n is a, c, g, or t
  misc_feature (782)..(811): n is a, c, g, or t
  misc_feature (816)..(841): n is a, c, g, or t
  misc_feature (854)..(866): n is a, c, g, or t
  misc_feature (868)..(881): n is a, c, g, or t
cnnnnnnnnnnnnnnnnnnnnnnnnnnnnnnnnnnnnnnnnnnnnnnnnnnngatagtcnnnnnnnnnnnnncnnnnnnnnnnnnnnnnnnnnnnnnnnnnnnnnncnnnnnnnnnnnnnnagcgtatcagggactattaatcaataattatccatttattctttccccatttaaaagagctccaaccttaaaacttccattgtaaaataaatatcttacataattctctcgtaccgaaatgttattcccttttacatatatctaattttttcagacataaattacacctatctattaacaacatatttataattaaacactttcatattattcacattacatatttttagggacgagctcaaaactaacnnnnnnnnnnnnnnnnnnnnnnnnnnnnncattaggatcaaaacttttcatattttcaaacatgctatcatttatttctatatattatcatttctatttcttataaattctttattacaatataacatttaaattatctaaatccagtactgatgatactatcagtattaaaaaactgtatatttactaaaaatatataggtccactaacnnnnnnnnnnnnnnnnnnnnnnnnnnnnctattaacaacatgtctttctgtatcagnnnnnnnnnnnnnnnnnnnnnnnnnnnnnnncnnnnnnnnnnnnnnnnnnnnnnncnnnnnnnnnnnnnnnnnnnnnnnccttttatcgaaagctggaatgaccgtctgcnnnnnnnnnnnnnnnnnnnnnnctcatttctacacnnnnnnnnnnnnnnnnnnnnnnnnnnnnnncttcnnnnnnnnnnnnnnnnnnnnnnnnnnctttatatcatcnnnnnnnnnnnnncnnnnnnnnnnnnnncatc

SEQ ID NO: 13348 - DNA, 324 bp, Diabrotica virgifera
  misc_feature (2)..(167): n is a, c, g, or t
  misc_feature (174)..(216): n is a, c, g, or t
  misc_feature (230)..(250): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaatgnnnnnnnnnnnnnnnnnnnnnnnnnnnnnnnnnnnnnnnnnnngtatttaactgcannnnnnnnnnnnnnnnnnnnnctgtttttatattgttatatgaagagaataatttgttgagccaatgctttttgattaatgggaaatacattacc

SEQ ID NO: 13349 - DNA, 519 bp, Diabrotica virgifera
  misc_feature (13)..(13): n is a, c, g, or t
  misc_feature (190)..(206): n is a, c, g, or t
ccctttcaagcgnccgattgatagaaattgtgtagatattttcctttctagaatcatataccaccagttaactgctctgataaacttattgtagctatcttggggcattaaatttataccctgtaatagataatgttcgagatcaagactccagagtgtattggtgaacctaattgtcatagaaaagcannnnnnnnnnnnnnnnnaaggagaagaaggatgtcatatacgtgattttccagtgtgtgatgggaccaaagatgaattaatgagatcggatgacccgacgagatgcttccagatctacaattaaagagagataggagattacatggcagcgaaacaaatgttaagaaggcatactgtgttgagtggaggagcaatggagcggaactgaatgtaaaagaaaaagctagctgtgtttagtgatgaggatcatggaacacggagtagaattgtagggaccacaaggaatacaggaatatgaatagacgaaatggagtaaaaagattcttgagg

SEQ ID NO: 13350 - DNA, 82 bp, Diabrotica virgifera
  misc_feature (22)..(34): n is a, c, g, or t
  misc_feature (36)..(48): n is a, c, g, or t
aaccccatagaagttttatacnnnnnnnnnnnnncnnnnnnnnnnnnncaaagtgatttcatataaaaaaactgtaaattta

SEQ ID NO: 13351 - DNA, 648 bp, Diabrotica virgifera
  misc_feature (11)..(449): n is a, c, g, or t
  misc_feature (456)..(493): n is a, c, g, or t
  misc_feature (513)..(526): n is a, c, g, or t
  misc_feature (529)..(551): n is a, c, g, or t
  misc_feature (559)..(581): n is a, c, g, or t
  misc_feature (611)..(642): n is a, c, g, or t
ctaaatatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnnnngaaagg

SEQ ID NO: 13352 - DNA, 218 bp, Diabrotica virgifera
  misc_feature (7)..(30): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(194): n is a, c, g, or t
taacagnnnnnnnnnnnnnnnnnnnnnnnnttgataataaagattgcgacctcgatgttggatnnnnnnnnnnnnnnggnnnnnnnnnnnnnnnnnnnnnnntggtcgannnnnnnnnnnnnnnnnnnnnnnagtttaaaccggtgtgagccaggttggttnnnnnnnnnnnnnnnnnnnnnnnnnnnnnnnnngaaagggacccaatatataaaaat

SEQ ID NO: 13353 - DNA, 200 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (163)..(194): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagcgcaggttggttnnnnnnnnnnnnnnnnnnnnnnnnnnnnnnnngaaagg

SEQ ID NO: 13354 - DNA, 894 bp, Diabrotica virgifera
  misc_feature (45)..(68): n is a, c, g, or t
  misc_feature (504)..(526): n is a, c, g, or t
aattactaacattctttttaattttacttgcatctgaactacttnnnnnnnnnnnnnnnnnnnnnnnncagaaaattcacccacaaacaatcattgccggttggaggaaagcagtagatattgccagaaaagctcttctagaaactgccaaagacaacagctctgattcagaaaagttcagagaagatctgatgaacattgccagaactacactcagctcaaagattctttcacaacataaagaatattttgccaaactggcagtagatgctgtgctgagattgaaaggtacaggtgatttacaatccatccagctgattaagaaaactggtggtactttggaagattcctttttggatgaaggttttttattggacaaaaaacctggtgtacatcaaccaaagagagtagaaaatgcaaaaatcctgatagccaacactcctatggacacagataaaatcaaagtatttggttctcacattaaggtagattcaatggctaaannnnnnnnnnnnnnnnnnnnnnnaaaggaaaaaatgaaagataaagtgaacaaaattcttaaacataatgctaatgtatttattaatagacagttgatttacaattatcctgaacaattgtttgctgatgcaggagttatggctattgaacatgcagattttgatggaattgaaaggctagcacttgtcacaggaggagagattgtctcaacatttgaccatccagaattggtaaaacttggaacttgtaagcttattgaacaaatcatgattggagaagatatcctgctccgtttcagtggtgttgctcttggggaagcttgcacaattgttatcagaggtgctacacaacagatcattgatgaagctgaccgttcccttcatgatgctt

SEQ ID NO: 13355 - DNA, 632 bp, Diabrotica virgifera
  misc_feature (2)..(21): n is a, c, g, or t
cnnnnnnnnnnnnnnnnnnnncaaggggcttcctatgactattctcctgggcggagtttgaacgggcacccgctccccctcgtccatgtttctgactgtcatttttctattccgacttgggaccagtagctcgcccatccccggcaaggttattcgctgcagcaccagcccccgctccccgtccacgacctttgcaaagtcctggtggtcggccgtctcctagggatgatggggttggaccggttccatgttcggttgctagaattcgagttccaagagtaacctacgctcagccagctccaattccgtcgagaccgagcaccatcggatgacataccctctgccaggttcgctcctgcccgtgccgctgcaccatggcctgcacctggttgtcgaccatgggccggaccctcatattccagtgggaggaagggcgggaggagatgttggacgagttaagtaaggacgacgctttgccgtcagatggaggtgcacccttacatgatattaggtttgcgtactatttagtataatgggaatgttatttacttcatcgttgagatattattaagcacaagggttgtatttagactgaggctgtgggtgaacatcgcagaattgaattttgtctt

SEQ ID NO: 13356 - DNA, 873 bp, Diabrotica virgifera
  misc_feature (109)..(127): n is a, c, g, or t
  misc_feature (450)..(481): n is a, c, g, or t
ggtggaaatggaacgcgctacaagaaatttgacctgagacgagtgtgttcaagtagtgatattcatagcgaaggagttagccaccatgctatcggctccttatattggnnnnnnnnnnnnnnnnnnngcacgataatgaaagacctcacattcaccaactgtaaccgaatatttacaacaggtatatcttcggacttcgaattgtccatcgcctagtccagatcttaacccgatcgaacaattatgggacataattggcagaagactacgacagcgtttgccacctcctagaaccttacaagaggtagagatagtagctctcgagatttggaatgatattgatcacgaccaaatagcatacctcatttgtaatataagtacatatctctattattatcgaacataggcgaatgaatcaaaaaacaaaatggtaagaaaccctaaggctannnnnnnnnnnnnnnnnnnnnnnnnnnnnnnngctagaatatttcacggggtgttccgaactttaaccttccgatgaccaacctttttttgttacacggatgaccaacgggggtaaaaaatgaccccaggtaatgttttcagcatttaaatcttcatctaacaatacatcctcgttttctgatactatttcatcttctatatcatcataaaaatcgctagcagtaacaatttcctgtaactcagtctcagtaagatatttgcgggccatatcttatatgtacacaaaatactaagaaactataataatatacgccaggaaataataataatgactaactgtagcggacaggaatgtcatgattcgtacataacaggcaccacagtctaaaaatagattttgataacgcgcagtgtagaactact

SEQ ID NO: 13357 - DNA, 522 bp, Diabrotica virgifera
aacaaaaatgcttgattcttgttgtatccacagtaggactggaatagtatagcaaacaatattcaagtcctactgtggatacaacaaaaatgcttgattcttgacttttgtcacattgaaaccaataccaaaacaaataatatttttaaacaatcaatccaacaaacgaaaaaaccatcaaaaccatcgaggtacactattttaaacatactgatctttttatggttcatataaagaatgctctatatcattaatgcgaaatcttacagtaaataattatagtgcctgaagctgggaagaaagggtatgaagagaaaagcatgaaatgctgggatttttagagattatgtaaaaatttagtcatataagagtagttctaagaatccatgtgttgatactataagatttattaagaaatatatatcatagctgagaaaaatttattgaattattgtttttatctttttaattgttgtttattatattttgctatgattatagatatttcgttttttattacac

SEQ ID NO: 13358 - DNA, 236 bp, Diabrotica virgifera
  misc_feature (2)..(138): n is a, c, g, or t
  misc_feature (140)..(181): n is a, c, g, or t
  misc_feature (197)..(220): n is a, c, g, or t
gnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnctgtcttttatttagnnnnnnnnnnnnnnnnnnnnnnnncctaaaagcttaaatt

SEQ ID NO: 13359 - DNA, 827 bp, Diabrotica virgifera
attatatgtcgaatatgattaacaatgatgttccttatatcatacttgccagttattacctgatgctgtcaacgctacatcaatccatctcatacaatgctgctacatttaacagtaaaccattccaacaaatacatgacatcttatataatagcaagtactcgtctccaaaatattcatctaacacatctcctgaaaatttgaaaaacccgatgcaacattccataatgttgaagtatccttctacttgatcgctaatcagatctcccagatgactctaccgagaaatatctagggctgtgcttgacttactccaactcattcaccttcctcagctagacattacatcccatcatttatagccgcatcctacaactcgactgttccataatgcaatctgactagatgagaaatatccacagtcaatcgcacgaactgcatcttatgctatgacgatcgtgccggacatttatagccgctggcgctcttgaacgacaaatatttttagaggaggcacaaactaccaagtactgcacactacacaagctaatatattgttcccgtgactacaaaactgcttgagatgaaatagaaggacgacctcgttgagcacatgactacatatcacataatgacctccctccaaaaacaatctacatgtatcaagctgatgacgattactactgtcaaaagtgtattccgggtatctgatgaatcaatgactatacatctatcaataaaactgaagatgcacttgaagaggatggactgacggctgagccaattgcaggatgaggcactctatagacgactggcacctgtgcaga

SEQ ID NO: 13360 - DNA, 312 bp, Diabrotica virgifera
catcacgcggccgattttttttatcgtgcggactagggaccctttattaactgctttagggacatctgctatttaaatctccctgaactgaacagtgaacattgaggatggccatttaccgatctttaggaataaactattcaggaataatactgccccccacaaaatgtagcaatagcctgccgatctatacattcctcgcctacgtacaattgcaggatgccgcagagcttctttcgttgccagaaatttgtaatacacgtgtacgttatagctagattagacatgattgactgtagcattcatattgtc

SEQ ID NO: 13361 - DNA, 149 bp, Diabrotica virgifera
  misc_feature (2)..(76): n is a, c, g, or t
  misc_feature (118)..(138): n is a, c, g, or t
cnnnnnnnnnnnnnnnnnnnnnnnnnnnnnnnnnnnnnnnnnnnnnnnnnnnnnnnnnnnnnnnnnnnnnnnnnnncttagggaaaaacagcgtaattttattgggagaagattaaannnnnnnnnnnnnnnnnnnnnggaccccccat

SEQ ID NO: 13362 - DNA, 428 bp, Diabrotica virgifera
agttacctggatgtactaccatggcttttacagtattatttttaagttttctagcagtagctttttctaattgttatacaataacgcaggatttgttaccaatatttccgacgcaagaaataattggtaataacttagttcgtcatcttcctaatggagaaaacgttactataatttgtccagatgataccattctcaacaaggatacattgacctgtgattttaaatcacaagcagatagtcgcaatttagtaaatgaaatcaaaccttgcgacaacaattgcaggcaatatgaactatgcgatggaggatgtgtagacaaattttgccctccgcctctactctttaataaaattttggaagtctgcgattatccaggacgcgccaactggtgtgaatttaatgcgaagaacaacagcaaaatttta

SEQ ID NO: 13363 - DNA, 943 bp, Diabrotica virgifera
  misc_feature (562)..(580): n is a, c, g, or t
  misc_feature (754)..(754): n is a, c, g, or t
  misc_feature (826)..(826): n is a, c, g, or t
  misc_feature (905)..(905): n is a, c, g, or t
tcaaaatcagaagataagttaataaaagcgttgagtatattacaaatatggaaacaacgaatgccgatacttcctgctggtattgaggggacacttagtatattagaggctatactcctggatgaatctaacatccctgaaaattggctaggcaaagtgaaagcgagtgccttgacaacgtttctaaatgtggcagttcacaacgataaacaaggtaactttaacaaaaaagtgtcaaaatcctttccaaagtggataatagatatcaggcacgatttttgtcatgggacaaaagaaatatcaaatgacaatgtgaaaattgcattgaatttatgttttgaatggatcttggatgattattggaagaaagaaaacaatctgagggattatattttggaagatacggcagatactaatattattgattgtttgaacacatatattaagctcactctcaatatatacaaaggagtgacaatgggagacgagtttgaacatttgatgaacaaggctaattatttagctagcaagaggtacaattcagaaacattagatccttcannnnnnnnnnnnnnnnnnnaagaaactttaaagcaagaattatcgaatcctaagagtaaaaagttgagtgccaaagtggctgaagtattagttgataacaaagctttgtttcatgtgcatttgaaaaaggatgaagtagctggtgtaacagtaatccctaaaccattcagagacttatggacaaagttattanacttacttttcgatcacggattcttagagcaagttttagataaacttttggaagtcagctccgattatgcanaagaatggctatgactttgtcttgtcgatggctgtgcaatattctagatgggctagtttaactaaaaaacattgcaaangtcgaacatactgggcagcaacagaatatgaccgattt

SEQ ID NO: 13364 - DNA, 199 bp, Diabrotica virgifera
  misc_feature (7)..(44): n is a, c, g, or t
  misc_feature (64)..(77): n is a, c, g, or t
  misc_feature (80)..(102): n is a, c, g, or t
  misc_feature (110)..(132): n is a, c, g, or t
  misc_feature (162)..(190): n is a, c, g, or t
taacagnnnnnnnnnnnnnnnnnnnnnnnnnnnnnnnnnnnnnntgcgacctcgatgttggatnnnnnnnnnnnnnnggnnnnnnnnnnnnnnnnnnnnnnntgttcgannnnnnnnnnnnnnnnnnnnnnnagtttaaaccggtgtgagccaggttggttnnnnnnnnnnnnnnnnnnnnnnnnnnnnnaacgaaagg

SEQ ID NO: 13365 - DNA, 910 bp, Diabrotica virgifera
  misc_feature (539)..(539): n is a, c, g, or t
atcgaacttgtttttaagcaattgttcattttctttgtgtagaccattatggcttacttttaacagatccctggcagagggccattttccatcacagtttaagaaagcctatgtgaaacccatacacaaatctggtgataagtcatttgtttgtaattatcgttccataacaattctttctgccattcctaagatttttgaagccctggtaactgatttcttggcggataatttgaaaaatcaactacatactgcttaacatggttttctgcctggccattctatttcgaccaaccttctttacacggatcatattgtaagctttcgtggacagtttacaggtggattccatttaggtatactgacctgtccaaagccttcgataaggtagatcattgccttttattgcataaattggaatgttttggtgtgagtggtaaacttctttgctggttgaaaacttacttgcgggacaggtctttatgtgtcaaactgaatggtttcacttctaatgagtattttctactctcaggagcgcnctcaggggtcccacttgggacctttattgtttgcagtttttattgacgatgctattaaatcattgactgactgcgaagtgttggcatatgccgatgctataaagttgttttcttccgttcgggattactctgattgtgctaggctacagaaatctctcgacttatctgcgaattggtgtgataataacagattagtcattaatcgtgacaagtgtcaggttatccagtttcatcgatcagtggaaatggtagattttgattacaattttggatggttttttgattgagagagtcactagcgtcaaggatcttggtgtcatttttcagagaggcttatcctttaatttgcatattgactttatttgtaataa

SEQ ID NO: 13366 - DNA, 991 bp, Diabrotica virgifera
  misc_feature (67)..(90): n is a, c, g, or t
  misc_feature (625)..(642): n is a, c, g, or t
  misc_feature (847)..(848): n is a, c, g, or t
  misc_feature (877)..(877): n is a, c, g, or t
aaatggactacattttttttaactaattttcttcaaaaattaatgcctcttttggtggcagtatacnnnnnnnnnnnnnnnnnnnnnnnncatcagtgaatatcagtaatttgttttaatttacatatttcataattagatatcaaagtgaaaacaatgtacagagacaatgaagattttgaagaacgcaataggcaaattctctttcaagggacagctgcactggaaagaactggtgaaagtctggcaagatcgacacaaatagccattgaaacagagactgttggaaccgaagtaatatctgaattagattcacaacgagaagctttactgagaacgagaaatagactaggggacgcaaatgaagaattaaggaatgctaaaagcacgttgagtgcaatgggacgaaatgttttatataataagttaatactcattttaattataatattggaaatactcatattggcagctatctgcttcataaggtttataaaatgataaataataatatgcaaaatagataagttaccaattataaacaatctacttttagtagtatcagtatgtaacagttattcaaatacaaattagtagtaacagttattcaaaattgaaccttttnnnnnnnnnnnnnnnnnncatattaaaaatactttacaattactatttagatcatgtccttaaagtcattttaattttatatgtatttagactatgttacttcgaatacaatttagaaaagaaaacattgaaaaattcatatataaaattacagagttgtaacactgattaacttttatagccactttacacaatgcaaggtaatttcttgcgcaagaacttnnctgcataagtgcaactaactttctgcaantaagtgattacacagtgcaaacaaattgcacaaactgacatgaaatagacagaaattactttgacagttaacagagaagaaactctcaaaagtcttatttgatttaacctgctt
